United States Patent 11,549,145 (METHODS AND COMPOSITIONS FOR INHIBITING AND TREATING NEUROLOGICAL CONDITIONS) - sequence listing, part 128

SEQ ID NO: 2375 - DNA, 634423 bp, Homo sapiens
aattgacgaaagcagcctccgcccggtcgagccagtctctcggttttctcggcggcttcttgaggatgaggcatttctaggttttctcctcctcgagcaaatcacggtctgcgccttccgcggctctgggaacaggtgagccgtgcggcggcgcccgcgggacgcgctcaggtgccggtccccgcccgccggcccctccctgcagcacgcggtccgggcccaggtgccggggcccaggtgccggcgcccaggtgcgcggggcacggggctgcagctccgctcggcatccgacagcgggcgccgctgcagcagctcgcgggccgcggagctgaacggcttcgcgagttggggcagctcctcgcgctcggccctgctcggcggcgagagctccgcctgggcgccgcgttcctacagccgccggagccgccaggcgccgagggaacggacagacctccgcgcacccttgccgaccggggcgggcagaggcgggcaagcggcgaacgcctgggagcgcggagagccaggccagcccggagcgcgccggggacaccctgtgcgccccgagtcccggcaccatgcgacccgccgcgcgtcctcgcgggcccggggcttcgctcttcgctcgctgagcccctgcgctcgccaccacggaaactcggaaagaggaggcgaggctgtggggagcggcgcggagacggactagacttcccctccgcccccaagaggctgccggtccccggttccctgggcttctccagctttatcatgaacctggcgcaaggttggctttaggaaaaattctggagccagagggagagtcaaggcaattctttggttgctaaggtaattgtagttgtgataaaaaatgggcaagaaacaaatgggggaaaaacatggtttaaaacagtatcctccctccccaccccattaatatgtgttgatttcatctcctgggtgtgggtgcttgtccatttcagatgcgtgacaggtgcccgtgtgtgtgtgtctgcagtttgggactgtggaagcacgagcttacataagtggttaggcaagctggcgtgtggacttgtgtgggatgggtgcaggtctgcatataaatcatgttcctgggtttctgggtgtgaagcgcacaccgacggggacgagagcgcagaggatggcgcttttagatacttccagtcttccgatgttgtgatcgcaggtagggcagctttgcctctaatcaggcgttcattaactttttccctgaacaagctcgcccatttgtggtttggaagaaaagaaagcgagtctccgcggtgaggtgtggagggcaggggcgggtggggaggtttgttgtttgggaactgcgctagcaaaggaagcggtggctattcgcttggagaggatgacaaatgaactggttgcgtgaggagtgaagagaccgtgtttacagtcaccagcaggctgcgtaaagaagtggcccagtgagacagggaaagtgacccagaaaatttagttttgttcagaatgaaagctgctgtatttcatttttgtttcttaatttgacggagtaggaacgttattttccttctctgtcattgagaccagtagcatttctatgttacaaactgaagatatttggggtctcgtcggcttgggattatcaatgcttgggaggtgagttctgatcaatacctttaacaaccccaaagaaaaacgcaaaaataatcaagtttaggtaaaacttccactggactttctttccagggagggtgagagatggaagaactgggcttgtaagtatcaaaatggagttagagaatgagctacaagtttgtgtgtgtatggtctgtcaaaaagtgttaagactgaaaggaaactgttaggtttagttaaatgtgttgacaacacggctcttacatatcaattttcataggcaaataggtaattacatagagtgggaactgggactatggtgggaaactttctgtaagatgtatattctttattcttaatttatcactttttcaatgggtgggactactctgtgaaggaaagtagagggctgagggacatttggtgagactcttgagagagaaacctttgcaagccaaatctcgcatgctatagatgataaattctaagttctttgatattgtaccactcttaagctaaattgtcctgtaaatatgatctcatgcaccataaactatatatatgtagagagagtctattcccaataactcatcctttcctgaaagagtctgcaagttctataaatgtcagctgttgggaggtattgtgatgaaggagagaggccaccagtgtttccttttatatatttattctggcagatcttaactttacttctgattttctttaaggaatttcagttaacattcactgaatttatattgctgagagtttcagtaaaacaagactagattttctttgaagcaataaattcatcttatcaagtgaaacattatgacaatgcttttgtggcagaaatgtttatttaaatgagtccattttaattatttatttatttttgacttgcagaataagatctgcaacatagatgtttttgaagtaagtagacgtttcttgagaaagaaaaataaatttaggttactgtggacaatttgccagtaattttggatgtctctttgtctacagggacataattttgtgtgaaagtagaatcattccatttcttatgtctctcatcttctcccatgcattttatcccctgaactcctaagactttgccaggaattgctgaacattctgtttcgtgccaggggttaaatatcaggggatggaataaggagctgtgtgtcacataaacatttttcaaaaggatgctgtcagagatctcaataccgggattaatttttcctttagctttgcagttagcttgtcttaattggtattgctctgaacctaggaatgcatttaacctcttcattttcagtttccagctggaaggaatatatttaccaaatttcatcttctttgtaacatatggcatgatataaataattactatacacacactatcctgctgtaaggaaagaaatagaattacaaaatcaactttcgtgttgagtgatatggatataatatttcaaaaaacaattttaacttttcccctgattccaaaagtaatatttagctattgaaacagttcaggaaaatacaaagaaaaaaataaaggttatccataatctgctagggagagggagccactgttaacatatctttaactgtatattcttccaaatattattctagtcaattatttctacccagtccccctcccccacacatttttataaatataaaatatagcttggaaatataacttggaaatgtgttaaaggcttgggaatttactgcttgtttacagaatgattttgatcagatattagtttttactggtggtccttattttcaaaaagagtaggttctttctttttctgttctttgaaaacaagtgtttgcactttgggctggtaatgcttggggcttccttttgaatttagggattaaagcatcagaaaagaagtagaaaggtcattggccattgtgggtgggagacctgagttctggttgcagttactccaacttctcctgtggcctctgggcctctgtttccctaaagggcaaaaggtacttttagatttaactaattaagctaatgacgtatttattgctttgacatgagaatgatctttgaagagggcttattcaaacacagaaacacctgggggtcatcctgggagtctctgattgattctgtctgagatggggcccgagaaggtacatatctaacaagtccctggatgatgctgactgctggtttggtgacagtgaaaactagagggttaagtgtactagggttctcttagagggacagaactaataggatatatatatatatatatatatatatgtacatatatatcatatatacatatatgctatatatatgctatacatgatatatatacatatgatatatgtacatataccatatatctataaaggggagtttattaagtattaacttacatggtcccaaggtcccacaataggctggctgtaagctgaggagcaaggagagccagtccaagtctcaaaactaaagaaattggagtcagatgtttgagggcaggaagcatccagcatgggagaaagatgtagggtgggaggctaggctcatttctccttttcatgtttttctgcctcctttatattcgctggaagctgattaggttgtgcccaccagattaagggtggatctgccttccacagcccactgacacaaatgtttaatctcttttgggcaacacccacacggacacacccaggatcaatactctgtatctctcaatgcaatcaaggtgacactcagtattaaccatcaaaagcccaccccttgtcaacttgaacccatacatatctcctgagatcatacataatcttcaaataaagacaataatgaggtcaaaattgtgcataacataatacaactatcctttgtacaaccagaaatgcaccaatccccaatgcaaatactattacataaagttaacaatacttacatgctgttgtgaagtcaataaatcttatgtcacatgataaaggaaaaggaaatgaagatattttcttagtatgagtgtatatatacacaaacatgtttttaacaaaagaaggaggaaatactcttgacaattacagtctgtttctgcagctggtcacatggtcgtagctggtattgatgactaccttcttctacccattcagtattccttttgcctacagcaagcacctcagcaggttcttttccctggtggagtgacccaaacctttattcctgaaggatctggaccatttgtagtcccgcctggattgggctgttgtagtttcctgttgaccttaatcacagggcatggtaatactgagagatgccctaatggatttcctgtgttccatatgtagtcttccttacctctgctgtggagtagtagactgatttcctcttgatagtccaggtcaatcatgccagccaacacagtaattttcttcttagcctgttgactgaaagataggagtatcccaaactgtccaggtggcaatcttaacttccagtttaatggaatcgttgtgtttcctggtggcagtgttcctccctctggaactaagatctctaggccagcagaaggtaatgtcttgggaacaggaagcaaaaattttgctagtggatcagtaggggtgatggtgagtggtgccacttccacttccgccccttgattcctggacctgtgaatcctggctataggagaaacagtaccatatattggatgctgattcagagcatacacggccctctggagaactctgccccagccctgcaaagtattgtcacctagttggcattgtaattgtgacttcgaaaggccattccaccattctatcaatataactgcttcaggatgatggggagcatggtaagaccagtgaattccatgagcatgaacccactgccacacttctttggccataaagtgagtgccttggtcagagacaatgctgcatggaataccacgatggtggataaggcattccgtgagtccacagatggtagtcttggcagaagcattgtgtgcaggataggcaaacccatatccggagtaaatgtctattccagtgaggacaaacctctgccctttccatgatggaagaagtccagtataatcaacctgccaccaggtagctggctgatcaccctgagggatagtgccatatggaggggtcagtgttggtctctgctgctggcaatttgggcactcagcagtgatcatagccaggtcagccttggtgagtggaagtccgtgttgctgagcccatgcataacctccatccctgccaccatggccactttgttcatgggcccattgggtggtgacgggtggctggggaaagaggctgagtggtgtccacagaacaggtcatcctattcacctgattattaaactcctcctctgctgaggtcacccgttggtgagcacttacatgggatacagatagcttcacagtttttgaccactcagaaaggtccatccacataactttttcccaaatttctttgtcaccaatttttcaatcatgcttcttccaagtccctgaccatccagccaagccattggctacagcccatgaattgatatataatcgcatattgggccatttctccttccatgcaaagtgcacagctaggtgcactgcttgaagttctgcccactgggaagatttcccttcacctctgtccttcagagatgtcctagaaaaggcctgtagtgctgcagctgtccacttttgggtggtgcctgcatatcgtgcagaaccatctgtgaacaggccctagtcttctcctcctctgtcaactgatgatagggaactccccatgaggccgtgggtgcaggctaggggagagaaggcagggtggcaggagtggagaccatgggcacttgagccacttcctcatgtaacttacttgtgccttcaggacttgcctgagtcagatcacgtatataccacttccatttgatgatgggatgctgctgtgcacaacccactttatggctagatgggtcagaaagcacccagttcatgatagaaagttcaggttgcatggtgacttgatgacccagtcaaacgttcagtttccaccaaagcccagtaataggccaagagctgtctctcaaaaggagagtagttacctgcagaagatgacagggccttgctgcaaagtcctagagtactccactgtgattcacctatgggcgcctgccaaaggctccaaacagcatccctatctgccactgacaactcaagcaccattggatctgctggatcatatgtcccaagtggcagagcagcttgcatagcagcctggacctgttgcagaaccttctcctgttctggaccccactcaaaactggcagcctttcgggtcactcaataaatgggccggagtaacacacccaaatgaggaatgtgttgcctccaaaatccaaataggcccactaagtgttgtgcctctttcttggttgtaggaggggccaaatgcagcaacttatccttcaccttagaaggaatatctcaacaggccccacaccactggacccctagaaattttattggggtagaaggtccctgaattttagttggatttcttatcctctggcttgcaaatgtctcaccagtaagtccagtgtgtttgctacctcttgttctctggatccaatcagcataacgtcaatgtaatggaccagagtgatatcttgtggaagcaaaaagtgatcaaggtctctctgaataagattatgacacaaagccagagagttgatatacccctgaggtaggacagtaaaggtatattgctagccttgccagctgaaggcaaattgcttctagtgggccttatggacaggaatggagaaaaaggcatttgccaagtcaatggctgcataccaagtactaggagatgtgttaatttgctcaagcaatgaaaccacatctggtacagcagctgcaattggcatcaccacttggttaaacttatgataatccactatcattctccaagatgcatctgtcttctgcacaggccaaatgggagagtcaaatgggaatgtggtgggaatcaccatccctgcatctttcaagtccctgttggtggcactaatctcctcagtccctccaggcacatgatactgtttttgatttgctatttttctaggtagaggcatctctaatggcttccatttgggctttccccccataatagccgtcaccctactagtcagccaatgtgggggttctgccagctgctaagtatgcctatgccaattatgcattctggccctggggaaatgaccacaggataagtccagggacccactggacacactataagctggacctgagctaaaactccattaattatctgacttgcataagcccctagcttaaatggaggaccacaatgatgttttgggtcccctggaatcaatgtcagctcagagccagtgtccagtagtccccgaaatgtctgatcattttcctttcccgagtgcagttaccctggtaaaagaccagaggtctccttggggaaagatgagagaaagatctactgcataaattttcagtcatgtagtggagtccttccttaaggggacccagcctcccctttgtccaaagggttctgggtctgtaaactggctcaagtctggaaattgaatgaggagccgtgattctctgtttttataattcaaattagtcttttgtccattcaacctagaagttttctgtttgtgtaattgaagtaggaatgcagtaggcttcctatcaatttcacttttaggaacaccatgattaattagccaatgccagagctctacatgagtcagactattctgattgccactttgcctctgctgtccattatggtagttatgctcaccttgcctttgatggttgagtgctgccacttgacccctgccacctggtccctgccacctctggatccaattattcccattttgtagttgagtgactgtggttcccaccattagatctgacatacagagaatggcaattacagggctcttcaaagatgcaggtgctgccctcccaagtctattttgcaaggcattggtcaagggtatatcttctggaccctcccagctgggatgagtaggtctaaagggactaatccactccaccaccccaatctccctaagcctttggattccttcctgtacattaagccaagggagatcaggcatttccagctcactcacagtgggccgcctttaagagcttgtgtctatttttccacaatttcggctctttctctaggagataagactctcacttagtgtaatcttagcagatttgaggctcagtatctgcttctgaagctgggagacagaatccctgagttcatcattttctttcatcactttgtccgttgaacttaagagcagccaacctgcttcactgtgttccttggttctccacatatggtcaaatgtgctatgtacagagtcgctaaactccctgcctctcatgagcggtgaattaggagtgtcaaaggcatttattttgcataactctctaaacagtttctgccaaggactatcagtgttttctatactattagaagtagagtccttagcatttttgggtctaatcatattaagcagccaactccagaaaccccaaaaccaacgaaagaactccattcttaatattctgttcatctagaaccactcctggtaccaaaatctgtattaggtttctcttagagggatataactaataagatatatatgtcttagggagtttattaagtattcacttacacaatcacaaggtcccacaataggctatctgtaagctgaggagcaaggacagccagtccaagtcccaaaactgaagaacttggagtcagatgtttgagggcaggaagtatctagcatgggagaaagatgtaggctgggaggctaggctcctctctccttttcatgtttttctgcctgctttatattcgctggaagctgattagattgtgcccaccagattaagggtggatctgccttccccagcccaatgactcacatatttaatctcttttgggcaacacccacacagacacacccaggatcaatactccgtatccctcagtgcaatcaagttgacactcagtattaaccatcacagtaagctccttacaggccaaaatgcctgtttgacttttcacaggctttcacagtaagctccttacaggccaaaaagcctgtttgacttttctttgcagccatccatccagtgccccaaaatatacctgccaataggtgttcagtaagcattggttgaatcaatattagttttctcttatggaggaatatctttctggagtagtcaagacaaaagaataatcatccagaatttggaaacattaagcctgtaataagagttataatcattcatggaccacactacttcaaactgcaaagaaagcaaaaatgcttataagtaggcaattaaattgaacattaaacctaatgagttacattaaataataactaggaatacctgtttgagatgttacaaaccacaaagcctaccaaatacttcaccgttacctctctcaggtctggaagaggccatttattttctaccacatacacatatttcaaaaaatggaagtttcactattaattaccctaattaccaaggcagcagataaagcaagcaatctccttgctcccctctcctcatcccccatccctcccaccaagaaaaaaggctcattagaactctaccaccattctataagataggtcccaattttatgaatgaagaaatgtaaaactttagagaaagaaattaacctgcataaatccacaaagtgaagtagcagcatcagaagtaagatccaggcctcctgataccaaagggtgttgttctttaccacttccctctggtgacattgaatgtgtatatttgatagctgggagattctagctggctgaaataccccagttagaacttttgattatccttatgtggctaccttttatatagaaaatatatcttttccttctacttaggtgttagtaacatagggtggtaccaagaaccaccatttttatgtgtggtaacttcaaaaaaagtgtaaatatttggatatgaacaaaatagatcctcattcattaatagctcaggctatgcaaatgaattgtcttagaggctgtcttggcatttcacagtaatttggttaaactatcaaagagaaagccacctttaaatctgtccatggtagagttcactcattcactagtatctgcttgacccaagaacctattttcttgcacacatggaagcatgcattctacaaagccagctgaggtgaggtcccctgcatgaatgagagctggtggtggcactcccttggaaataccccaggcacctgtgttgctctcatgaagacctggctagtctggagctcagacagagaactgctattatttgttcttaaaggagcacaacaggcattttaaaatcctgttaattgtgtttctgaaccttagttttctcgtctgtgaaagaataatttaaaaaataccctttgagtatgtgtgaccatgagaatagaggaccctgtatgaagtatggggcatagaaagcacagacacgtaagaagatgggactgtcacagcacagttcctgttttctaataatttttagagtgagtctgttgagaaataagtgtttcaggataatggttcctctttattttctgttcctgaggcattgctgtgttagtcaagcatttgatggactcccaagtctctgagaatcctgctccatagttctcacattgggatttgaggaggcttgtagaaagcaagtggcccacacatctaagtgggagaaggcagcgtgggcaagatctctgtggtagccaaagatgcctctgtttcctggaggcgaaaggccattaatcaccagcaggaagagaagtgaaaaaggagactgctgctgcattgatagggcttatgccagacacacagagcaagcccatgttttttctctgcatccttgggatttcttacagtgcttggcacatagtaggagtttggtaaatgtttgctgagttattgagttgcagagtgacagctgtgggtggaggaggaaggatgggctagtattggtaggaattcatggactagtgggggtgcatggattggtatgagtgtggatgcaaggtgcacgtggttatagccttcattcttattgcttgcttgattttgcctggcaagatccacttcatatccatgatatagtgagactgtcatcctagtttcacattattgtgtgtctattccattgggctttggtcggtttggcttttttgttttgttttataatttatgtttgtaattttatctccacctctagcacaagaccaatacacatagtaaatgcttgataaaaattcgttgcctaaacaaaaacttgctcagcctacaaaactatgggtccgtcatatggttgtgggctgatcttacaaaataacaatcagcatttgttaagctttttgcaaatcaaagtcctttaagagatgttgggtggtattatgcccattttatagatgaggaaaccgagtggaaacgaggttcagtcacttgccctaagtcagatagtcattgaggagccaagatttaaactcagatcttttctgaccccaaagtccttgtgctgttttatatagcacaaggtggggaataaacagagaccctacccttgagatcatttcagttgtattggagagatgataggaataaatagaaaattagcaataaaagatgttaaatgatagtttaggaaaaaatgcaggggattttgtaagtcagatttggtagcaaatagatgatgaagacagtaagcacattatagtttagttcagagacagcattttatcatcagatctggaagagacaggcttcaggaaataggaataaactttaaaggtgcaaaaagggataatggcaaagttttcagatgaaaggtgttaataatacagtcacgtgtcacttaatgaccaggatacatttggagaaatgtatcattaggtgattttgttgttgtgtgaacaccctagagtgtacttacacaacctagatggtatagcctactgtacacctaggccatgtggtatagtgctcctaggctacaaactgtgcagcatgttactgtactgaatactgtaggcaattgtagcgcagtggtgttttgtacttaaatatatctaaacatggaaaagatacagtaacaatatggtgttataatctcatgggacccccttcatgtatgtggtccatcactgacttgtggtgcatgactgtaattggttattaaaacaattgtttgatttcagagtaagggctaatataaactccttatagttaaagccatctcagaccaccctagctaaaataataactcctgccccttctcattgctcttcattgtcttacttgccctatttttgatcacagctttatcaccatgacattgcattatatgtacttatatattgtctgtctccctctgctagaatatacattccataaaagcagggactcttttatttcctgttgtagattcagcatctgtcacagattctgattcatactaattgtttaagaactatttgtgaaatgaaggaagaaaatgcattttaaaaatgagttgcaaactcaaacactcaatagaccagttaggtaaaggaaatgagggaagcaagtgaggtttcttccacaatggtaacaagttgtaatttttacaaatcaaaagcatgttttgtttgtacattacacagatagaaagtttttactcccagaaatacatttatatctatttttcttgaaatatggggtcatctgactcattgtcaagagagacctggataccaaataagatttccttttttctagaagcagaacagccatccacgtgtgatgatgaatggcacctgaccttggatctcagggttggggttgcattagggacaggtggagaatgtgtttaagcgagaagtatgtgctgctcagaaagccctgttgttgccaaattttaattcatttaaaaattattaaccaatttcaattagaaaaatattatgtatatctacactgcccaatccaagagaaacaccttttgagctggctgtattttatggtgtgacctctgtagaaaaaaaagattaaataacatatgcaatatattttctccttaaacttctatggaaatgctacagtgtttagattccaaatcaagcaggaagatgccattatattattttgctgaccatacatcctaatacaaagactgattcagcagctggtcaaaatagaaaggacgcattcacaaagaataaatatattgattacattttagacttttttttaggtgaagggactttcattttcaggatagcaggtagtttagggcttggctgttggtttctgccgatagccaggggtatgtgacaggagacaaagtagctgaactctcttgatctgcattcttcccagttgcagaatagggctgagaaattgtgattgctttgagatggttactgaaagagagtgtgtacctggaaacaatctctggtttagtcaactattaatggggttgcgggggcgggatgttccgtaccccaggtcacagctggcctggggtctctgctgctcctccccactccttgtcctgctggtccgtgtcagacagtgcatctatcttcctaccaaggactcatttccagataatgattaattggatatggctcctgtgttcaagaaacttaaaattctgaagaaggaaaacaaatggagagacggaatgtggtaagcaaggcctatatatggaaagttagggagagatgacttcctgctgagggatttcactgaagaggctaagtagatgaattggactttggaggacctagaggtctggggcctgcagaaatggggccaggggacagagatggcaagaatgtacttggggcatttcaatgtaaacaaaattatacaggtgatcaaatgcaaggaatgtgcaaagaatatttaataccccccatacagagtgaggtccttaaaaacctttctggcaggaggagtccgtgttgatgaacttaaaactttaatgaaaacaaggataggggaaacctaggtttaagcaaaactgttcaataagtatttgtcatatttactgaaagtaaaatgagaaaacaaaagtagattatgagtgacattttactcaccttatgttggtaagagcagtgtgccacagtgaatttccagttacttcttgctgtttttcaggctgtcagccccccttacagtgaaatgcttacaggtagttttgctttattacagttagtgtacaattcttatgcacaagggcactcctccatgccaggctcactatacaaatgttcaatgcctttcagtcagagaggctgactgctgactcctgggtctccctgtggctaaagggtaaagtggatagatacatcttggggtaaactttatttaacttagttggcatgactgatcaggaagtcctcagatacctcacccccatgcctagggtatttagtgtcatgccaaagcatatgctgccaattccaggttttcattttttggtttcctttaagctttcaaaagcttctctgcaaaaatcacttccgctgcctgccatctgccttaaaaccccctcccccacttaaaaaaaatctgtttctaatcccaagagtcttttttgttgttgttttcgagacagggtctcactctgttgcccaggctggattgcagtggcgtggtgttggctccctgcagccttgacctcccagactcaagtgatcctcccacctcagcctcccaagtagctgggactacaggcgtgtgccaccactctgagctaattttgtgtttattgtagagacagggtttcatcatattgcctagactggtgcgagattcttatattttctaattattcttaaaatgaccaattgactatcaaaaatgtatttggaaataggtataagttgaactttgcttattgggaattcttggttgggggagttttctgtagttgagattaccatgttgttgggtatatgaagatgaacagtgacggataaaactagaagtgcaagttgaggccagtgtgcgaaggaacttgaatgccatataatagtgttgatagtgatggggatttagtcttctctctgatgcagactaaacaaaaaaataccaataacccaactgaactgaagcaaaatccaagtatctcgagcagaaataaatttatctgaccacataatctgagaattcaggcttagctggatccagggacttagatgatgtggtcagcactcttactcaacaccttgtcttcttgacttcctccttctatggcacgagagaagaagaagatggtcactaatatttctaccctcacatcttttcaacagtcacctcacaggggaggaatcttctttcttccagcgtccttatctcagtctcagggaaggactttggtcctgattagtcacatgtctacgatggttcgatctgtgtgtctgataatgaggcatactctggccaggacagtccacagtggtaacagacacaacctctggctccttcatcatccctgcaattataaccctgccatgatgtcattttttgcatcactgtatgtgagagggctgcaatgccaccttgagaacccaatatgctgcatccttcctccagatctgcatttatttgcactattctttttcaaacatacagttctactgaagtataacatatttacagaaaagtattcaaatcattgttcaataaattttcaagcagtaaacacatccatgttatctctctgagatcaagaaagagaatattaccgttcttccagaaaccacctcatgggccctcccagtaagtacatatttcttttttcccattggtaactgctaagctgatttcctttctctctctctctcttttttttttttttttttttttttttaaagagatgaggtctcactgtgttgcccaggatggccaggaactcctaggctcaagcagtcctcccacttcagcctctcaagtagctaccactaacctgatttctaacactgtaactttctcttttttgaaacaaatgaaataaatatgaaatcatacatatatgcctgtacactttctttctagatccttatgcacaacattgtttgtgaaattcatctatgttgcaatgtgtagcagtagactatttttattactatatagtattctactttgtgatattccacaaactattcatctactgttgagggacatttgggatatttctaggttagacatatgaatagtgctgctatgaatatttttgtatgtgttttgtgacacacatatgaatgtgtttctgtttgatatacacacctaagactggattgctgggccatggggtgtgcatatgttcagctttattcgatccttacaaagagttttcttaagtggctgcaccaatttatattcctatcatcagttcatgagtgtttcagtttctttatatcattggtaagacttgagattgttaaatgtttgaattttagccattctggtgggtgcgtagtgatgtcttattatggcttcaatttgcatttttctggtgactgatgatgatgtgcctttttaatttttttttgccacttttatttgtcttttgcagtgcctattcaagcttattgcctattttaaattagatttttaatctttttctcattgagttgtagaaatcttcttttaaaaacaaatttttaatacaaatacttttgcctgtcatatgtatttaaaatatcttttcccggctctagtggtttgcctttcactctcttttgatgaattggagatctcactttgaatataatctaacttatcagtctctttctttatggttattgtttcctgtgcctacttaagaaattgttgcctaccctaaggctatgaagctactctgttttaatttatagaagctctatttttttttttttttgccttttagccttttatctttaggttgtaaaaatctacctgtggatgattgttgtttgtggtgtgataaaggcatccgtatttgttttgttttacttatggatatccaataaacccagcaccacttattgaaaaatctcttcatttctactactctgaaatgtcacctttgttatcagtcacatttgtggtctgtctctgtgttttctagtccattccatttttctatttctctaatataatattgataacgcactgtcttaattacgtgagctttataggaggtcttgatattcagtagtgtgcaccctctagtttgttcttatttaagaataacttctaaagaacaaagctggaggcatcactctacctgacttcaaactatactacaaagtgacagtcaccagaacagcatggtattggtacaaaaaacagacacatagaccaatggaacagaatagagatctcagaaataagactgcacatctacaaccatctcatcttccacagacatgacaaaaacaagcaatggggaaaggatttaataaatggtgctgggagacatggctagctatatgcagcaaactgaaactggacctcttccttacaccttatccaaagattaactcaagatggattaaagatgtaaagtaaaaccaaaaactataaaaaccctagaagaaaatctaggcaataccattcaggacataggcacaggcaaagatttcatgacaaaaacatcaaaagcaattgcaacaaaagcaaaaattgagaaatgagatataattaaggagcttctgcatagcaaaagaaactatcatcagagcgaacaggcagcctacagaatgggagagaatttttgcaacctatccacctgacaaagatctaatatccagagtctacaaggaacttaaatttatgagcaaaaaacaacccaattaaaaagtgggcaaaggacttgaacagacacttgtcaaaagaagacatttatgtggccagcaaacatgaaagaaaagattaacatcactgatcattagagaaatgcaaatcaaaaccacagtgagataccatctcacaccagtcagaatggtgattattaaaaattcaagaaacaacatgctggcgaggctgaggagagagagaaatgcttttacattgttggtgggagtgtaaattggatcaaccattgtggaagacagtgtggtgattcctcaaagacctagaggcagaaataccatttgacccagcaatcccattacagggtatcaacctaaaggaatataaatcattctgtgataaagatacatgcatgtatgtgttcattgcagcacttttcatgatagcaaatacatggaatcaacccaaatacccatcaataatagactggataaagaaaatatggtaatatacaccatagactactatgtggccataaaaaggaacgagatcatgtcctttgcagggtcgtggatggagcggaaatccattatccccagcaaacaaacgcaggagcagaaaaccaaacactgcatgttctcactcataagtgggaaccaaacaatgagaacctgtagagagagggaggggaaaaacacctgaggcctgttggggatggggggatggggagagggacagcatcaggaaaaatagctaatacatgctgggcttaatacttaggcgatgggttgataggtgcagcaaaccatcatggcacacgtttacctatgtaacaaacctgcacgtcctgcacatgtaccccagaacttaacataatatataattaaaaagaatagcttcattatttctaaccatttgcattactgtataaattttaaagtcatcttctgatgggattttgattgggattgcattaaatctctagcctaaattgggagtaaattaatgtttttacagtgttggctattttaatccattaatatggaatatcccttcctttatttagatctgtctctcacgtctgtcagcatttttgtatccctctatattgtaaaattattgcacatcttttaaatatatattcctagtatttgaaattattcgatgctattataaataatacctttaaaaatatatcattttctgattgttgctgatatacaaaaaatacaattgagttttatatattgaccttgtattcattgactttgctaaattcactgaatcctaatagttctgtgtattaggttggtgcaaaagtaattgcattcataaattattatgaatttccatgtacacagttaaattacttgtaaaagagttattacttttacctttctaattatcacgacttgtatttgtttttcttgcctgttgtataggctaagacctcaaatataatggtgaatagaagtggtgatagtgagcattcttgtctaatttccaatctcagtgggaaagttttccatgttttactattaaatattattaaatatttctgtaagtgttttacaaataccgtttatcagatcaagcaagcccccttacatttaaaattggccaagagtattttcatgaagaggtgttgaatttgattaaatgccttaaagccataattgcacagaatagcgggctcacctctgtacttcctttttctcttggatcatgatcccatgtgtcctcattgccttgggagctcttctttttataccatatctacctttctagattttcttgagggttggactgttacaagttagatcatcattgtaggaattggtactgtaaattcaaattgtactatttttgtctgccatctacacggtatgagtaaaactgtaaaacccccgagaacctattcaattgttatttctttgatctatattgcttttggctggtaagctttatgaaaagattttcttttgttaaattttgctatcttaagaggaaaagtctaccattgctgctacaaatggaggcattatggagtcattgaaagggtgcaccttatattacatttaaatgccatgttttacatataaacatactgattttacctgttcctttttaaaaaagaaagaaaacaatgaaatcccaaggaataaaactgacattctttaaaaaagaaaaagccaataggagtgcttttcttcttaggtcccctgggaacatgtcatcctcttcatctcttagtcatccacttcttgtgtataaaaattggcaacgcttctctgtcactcccacttcttctctagcagtgatacaatctttcatgcgaaataagagaataataaaatgttatttctgcagtcccaatagtcagtagtattagaaactataatcttggaacccatacttaacaaaatataagccctctcatgtgagaagagagggaagacccaagctctaaatgctgactcattgctaaccaggagggtggcattagaacgcaacttgaccttcccaggtcttagtgccatcctctgaaaaccaaaggcttggacttgttcaagggacagaaaaaattgtaatgtaaagggctaaatagtaaatattttgagttctgtgggccatacagtccctgttacaacaactcaattctgctgttgtggcacagaagtgatcatagacaataagtaaacaaatgggcatttatttataaaagtgtatttatggacacaaactcaaatttcatacaattttcatgtgtcataaaatactgttctttcaacttttttttcaagcatctaaaaatgtaaaaacaattcttagcaaagagatcatataaaaagaggtaacaggcttagatttgtcccatgggcccaagtttaccaacctttgagtcagttaaattgtcaagggctgttccagagctctgtgttaggcattcatatgctagccttttaaaaaatattttttttgtcctatgaacattattcaaaagggtctatttttttcttttagaccaattatgaataagaaaaatacaatatgttgtttttacctttattccttcatcagtgcttgttctttctttttagagatccaagtttctgacctgtataattttcctctgcctgaagaacttctttttgcatttcttgcatagcaggtttgctggtgataaatttcctcagtttttgcttgtctgtgaaagtctttattttttctccacttttgaaggataattgcactagatgtagaattctaagtgggcgtttttttttttttttttttccttcaacattttaagtatttcactccacactctggcttgcatggcttctgtaattcttatcctcattcttctataggtaaggaatctggcttcttttaagatttcctctttgtctttggttttctgcagtttgaatatgatatacctagatgtagtttttctttttttgggtgtttgtcctgattggtgtttactgacttttctggatctgtgatttattgtatgtcattaattttggaaagttctccgtcattattccttctaatatttcttctcctttctttcttctcttcttggaattctgattacatttatgttacagctttttatattgttctatagttcctgaatattctgctctggtttttttcctcccttaattctctctctctttttagtttggaaattcatgattgactttcaagctcatggagtcttaaaaaatttcttaaatttttaatttttatgggtacatatgtgtatacttatggggtacatgagatatcttgatacaggtatgcaatgcataataaccacatcatggaaaatagggtgtccatcccctcaagcatttctcctttgtgttacaatccaattacactcttttagttattttaaaatgtacaattgagttgttgttattgacattagtcaccctcttgtgctatcaaatggtaggtcttactcttcttggccatttgagtctgctgatgagcccatggaaagccttcttcatttgttacagtgtttttgatttttagcatttccttttcaaaggagttttaaaaaaatgtttccttctctctggtttcattaccatttactttctccattagaatccttaacatttttcatcatagttattttaaatttcctatctgttaatgacacagataattccaacatccgtgacatatctgagtctgattctgatgattgcttgtctcttcagaatgtgtttttcttacctttcaccatgcgttgtaattttttgttgaaagccagacatgatgtgttgggtcataggaactgaggtaggtaggcacttagtgtgaggttttacttaatctggctaggagttgggttgtgtttagtgtttgctgagctgtaggtgctagaggcttcaaatccccccaagggtccttgtttttgtctcctctcttgactttaggtttccctaactactattcctcagggacgctgtgtcttggaagtcttttatctgtaatccactgttacacctgagcccggctggtgtggtggtagggcatatgtgagcagtaatgttctattaaccatctaattaagagcaaggatggaataacttccctttggtaaatggtaacgttacaggaaaggggtcccaatccagaccccaagagagggttcttggatctcacgcaagaaataattcggggcaagtccgtagagtaaactgaaagcaagtttattaagaaagtagaggaattaaagaatggctactccatagatagagcagccctgagggcttctggttgcccatttttatggctatttcttgattatatgctaaacaaggggtggattattcttgactcccctttttaggccatatagggtaacttcctgatgttgccatggcatttataaactgtcatggcgctggtgggagtgtagcagtgaggacaaccagaggtcactctaatcaccatcttggttctggtgggtttcagctggcttctttagtacaccctgtttatcagcaaggtctttatgacctgtatcttatgccgacctccagtctcattctgtgacttagaatgcgtaactctctgggaatgcagcccagtaggtctcagcctcattttacccagcccctactcaagatggagttgctctggttcaaattcctctgacagaaaaactttcccccataagaaaaaggaagatggagaacatggtggcttcagtgagggtgtctgaagatgagggacttgccttctgctggcttccatttcttccatgaattttgaagtgagctcatcagctaagactatgtgttaaatatgagctgggaaaagatatgacatagccatctcagaaagggagaaacaagcttggtaggaaaacattttgggtttggcaggcagtgttgactattcatttaatgtttgtggccatgaatttaatgcagctagtcagcctggttgtgtgacttcctctccatcccaaagtgttcatctgtttggatgggagcttggggttggtggatagttgggttccatcagtgttggaatttggtaaggatagtgtgacacagaaagggggtgtattagtgttccctagagggacagaactaatagtgtgtgtgtgtgtgtgtgtgtgtgtgtatattctatttttatatatacaatagtatatatataacagtgtgtgtgtgtatatatatgtaggagtttattaagtattatcttacatgatcacaaggtcccacaagaggctgtctacaagcttgaggaagaaggagagccagtccgagtctcaaaactgaagaacttgtagtcccaagtttgagggcaggaagcatccagcaagggagaaagatgtaggctgggaggctaggtcagtctcaccttttcatgtttctctgactgctttatatttgctggcagctgattagattgtgcccaccagattaagggtgggtctgccttccccagcccacggacttaaatgttaatctcctttggcaacaccctcacagacacacccaggatcaatactttgcatccttcaatctaatcaagttgacactcagtattaaccatcacaaggggagatgcaggagtagagggtatgtgcaagggagtgattatgagtgagtataatgatggagccagtgtgaatagtgaaggtgaagcgaagggtaggaatggatagtaaaagtgctgtgtgttcaatggattaaatgtctaaataagtttgaagattgtttgcagtgaatgcagagtaagtaagtgagctgaacagaggaagggtggacagagtggaggatgcttgtagtgggatttgaggtgatgacaaagtttaggatgtggccatgtgagatagtgactcagaaggaaaaagcttcaggtgaggaaataaggaactgagaaactggcttttctggtaggtctttgactctgatgttaaagtcactgaaagtggtgaaggtgttagggaagcagaagaaaccctctgagaggcggaagctggagtcttcagggaatgagaaggcataagcaggagggaggtgaaaaacagcagtgaggatgagcagaaagtggcagagccagatggcctgagtgccacagagcagggatttgtgttggagggagggagggaaatcatttgaaggagcggtggagagccaggaggctgcctgccctactccctggtcttcagatatatgacgtgaggacagagggctgtaggagaggagaaggcaagtttccattaaggtcacagaaggttaaagttcagagaggagatggaaggacatagtgggcatactatttacagaaatgttgaaagggtgggatgagtctgtggggagtcggaggggttggggtttccagagcagcgtggagttcagagccctggtgagagaggatgactgggtagacctggctttccagcagagattgcagtaacaggactcccagggccagcatgccctgttacatggctatctttccacttctccctcctagcttaatttttagaaactttaacagatggaatgcaaaatttttatttttatttttacttcagagatcagtcctcaccctgtcgccctggctggagtgcagtggtgtgatcatagctcagtgtagcctccaactcctgggctcaagtgatcctcccacatcagcctcccgagtagctgagactacaggcaacgcaccaccatgcctggctaatttttgtatttttttgtagagattgggtcttgctatgttgcccaggctggtcttgaactcccaggtttaagcaatcctcatgcatgcatatatatatatatatgcagctttgataatttaattagtttagcctgtcaggcagctgtgatagtgtagagaacgttgtatttatttgtaagtcttaaggtaggattggaatggagaagtcaacttcactgaaaactagcaagtagaatgaaggaaacacagattagttgaggacctactatgttccaggctttgtgccaaacatctactttatgtaggtgatttcacaagatggacatgttggaaaaactgtgggcattggaatcagtcctgggtttgaattttagttgcttggctgacaaactgtgttactttgggcaagttacctgtgctcttcagtcttacttttctcatccatagcgtgggaataataacatccacctgttgtggttgctgtaatgagctgtgcaagaaattctaatcagcaggccgggctgagaaccactgctgcagagtgattagcatttgttccattttataggtgaagaaactaaggcccagtggggctaaatatgttgcttacggccacacagcacttaaatgatatagccaggattgaaagccagttttttttgaccccagaaccttgttgtatccatttcattgagtttttgccttaatacatgggaagctaaaggagcccccccattagcatgtctgcccaaacatcaggcagcatgggatgggaggaagggatcaagtgaagggaaggcaggctccatggaatctaggtcagcggtttccaaacctggctgtacttacaaatcatctggaaaatggttaatctgtaaatctccagggaccaccctaggcctattggatcagaacttctggagcatgggaaccgggagtatgtatatttagaatatctcccaggttattctgagactgctagcctagttccggtccttgggcaagtttttgggaaccactgaattctaatcgatgtcctaaaatgattaagtgattatatcccagtaaaatactgggtgtcttccagtgccaccaaaattggcctttaggggttgagtgctattgccgtactttaagatcttggtgcattacctgaaacggacactctgtctgtcattgaacatttgaacttcgaatatataggaaatgtcaagttggcatactctgctataacaggaagagtgatttgttatttagagctgttgttcttccttctttccccttgggattcctgcccactcagtcagattagagctatataaacaagctcgtactactgagctagcacacatcttgtaaattttttttcctgaagtgcttaacgttgctgatgtcagaaaaaaaaaatccattgggttttaatgggctgaggcaaacaatgagaatttgatataatatggaggagaggaaataacttcaacagaaattcttatttggcagcataaatattcaaactatattacagtcagagtttgattgcttctcctacatggcatttccctgaatagggttttgagggctgggcactaagagtggcaggcatgatgtttaaagcatttagttgcaagccatggtaatttcagtgacattgtagggtaattgtagttggttctcctcttagctctgtgtcaggatcacctgaggaggttgttggaccgctgaaggcttcatctctgatgcacgagtcagaacatctgagggtgggggttggggtgggattctccattgaatctgatgccagtggcctgggaatttcacttggccaaaccctggcttagaacaaggtcactggtcagtttcgatattcattctgtgctggggcatttccatgacttagtgtcttccctcttcaaaagcaaccctgcgtgatggaggggtctcatcttccaggcaaggagctggaaacgtagggtgggagagcccattgtcaaaggccacatagtagccttaatgaggctagagctgagatgtgattcccagtctgacttcaaagcccttccttttcctataccatcgaggcccttccttcctgctctgctcaacattgttagctgccgaaccctaggctttgcttgttccagaggggctggcattataaagtaaacagcaggcatttattgtaactgcaagttacagatgcagtgtcagtttggagtagacttgcaggcacaatcctgactttcaatgattcacgaatctgtttgtgtcacaggtgctcaattgtcctattatgcatagagcatccccttcactatattttcttccctcaccacatattccttcttacctaaattgcttatgaattccagaagtggattgctgagtccaggctggttcatatcaataaaccttggggaaaatctttatgtgtgatgctatacatgggtctttgttgatcaagagtcttctttattggccacttttaatggcttgttatccagatgaatcttctggaaggaggacactgcatcctggtggaattttatcagttccatcattcattcaaacatatttaagtaccttctatgtgccaggttctgctctaggtgccagggagagaggggtgaaccccaacgataaagtccctgcctatgaagaactgactttctagagaggaagtccctgatagacaagtaaacaaagtcccgcagattcagatagttgcgaatccctgttatctcactctccacacttggctgtctcccacttaatctttctgggatcagattatctttgtggcttttttctcttgactgtctagcacaaagctgagccgcttctggggcttcagatttctatgcctgtgtgtgtgcatagccttggctggaatggcaaactttgcctctcccaggcttctgctcatctgtcacctcctcctactctgtgccatcataattgagcaaccacatattacagtgtcctttctgtgaacacatctgttattcctaccggtctctgaacattttaaggagaggatctgtgtctgacttatctgtatatccccagggcctagcatggaaccttacaaaagtagatgctcagtatatttgctcaaagaataaatgatgagttccaaagaacctgagggtgggtggtgtggtataggaattccgtcatggggagggatgctgagtcagatgggggatgctccaccgcagtggttttgtgatttattctttgagacattgagtgctgtcatgaatagaggagatgggctgggatataggcagtattgacagagacacgtggcatggaacattctggtgagaacctttgaaggaaagttagaaatgtgaggttctgagggtctagctcagagctggaaggaactctaaggttgctggattttatagccaatgcccaactgaggtccagggaagctgtgtgtcctggttctgatagttggttagttgcaaaggagctaggggtggggtgataccaggactcctagttcagagggctttccactatgctggggctatggtgtgtgacagataacagattaaaggcacagagaggagaaggaacttgcctaagatcacacagctaggaagtggtggagcctggatttggacatggatctgtctaatgagaggcatcttgtaaccatcaagctgtattgtctcttcttgaagactgtgaaatgcaaggtcctagcccattttcagttttcctcttgggttagctgtgagtccatataggaaaataatattaacatgctttctttcttttggtatgcagttacatgttttcagaaaaatgttcacattcttcaaatgttaatattgaagcccctgggttgtttactgtgtgtatatatatgtatatataagtacaatgaagaacattctgtttttctctaccactaaatttaaacccatttctattgtactccatttaaaagaagtattttacatcatactataatgaatgaaaacctagtcctttaatttcacaagccccagctttaatagtcaatgaatttaattagaaaatctttacctatgtaggtttcacatccagttctctataacatctgttgacctatggactagaaagtatattattattttagaaatgattctttctagacacaggaaagctaaatagcttgtctgagtttcaaaacgagttaatagaggaaccaaaaatagaaacatttctactgaatacgaggcttactaaaattcttcacacagagactatctgcattcacttagtagtttccagtctagactctggaacatcagcctgttttaacacacacaaatgcttctgttggtgggagggggtggctgggcagagggaggccgggcagagggaggcctgacacgtttgtttctaggtcatttctaaccttgctattataatacagttttctagatagaagagaatgtgctcattaaagtgttcattttaaaataaagcgacagaaacttaaaacgtctctattacatggatacatgagtatatataaatgaactcaatttttgttttcatgctctgttgtattctgtattaaggcaaaggagtaggcaactaagtagttgtttaaaaataaaactgtgtgttgttcatttaattttaaaagccattggttagaatggtaatcagtgtttccatgtagtactatattcatagaaatcctgatattacagtgtatagagataatattatagaatgatgctctttacctctttatgtaatctaattttaaaaaacattgtaatttataaatagtgaagaaagcaggtagtgttattcgaatgggatattttcggcaattaaattcttagcataaattacaaattcctctctctcccattttccacccaaatttgtttttatggaatgacctttggtagcaacttgttttataataaaatgtttcctgaatttgtattttgaattgaaatggccttttctgtcacgtatggtatttataagagtttctttgatgaaaagcctctgaattttgtgcaaataacccaggcagcctcttagatgagggataacatttgtataggacttttatggctttatactctgctctcatactcagcttatttgacccttacctgcggggaacttggtggaattcacattttactgctgaggacaatgtagaggaaggtgccttggcatgactcagagcatatagcaggtgtttggtatgtttgttttaaagggaaattaacaaaagaaacccaaaagattcttgtacttgctcaaggtcacacaataaatatagtgtcataccaaggattgaacttccttcttcactcaaaacttccatatacttgttcttatctcactgttatcttttcaggcttttcaaaaaggccacattaaatatatttatttttcttaattgaggtgaaattcacataacacaaaattagccatcttaaagtgtataattcagtggcatttcatgctttcacagtgttctacagccatcacctctatcaaggcccctgaaggagaccctgtatccattaagcagtcacccattccatcctccctgcagctactggcagctaccaatctgtttcttgtctctgtggacttacctattctggatatttcataaaaatagactccagcaatatgtgacgttttgtgtctggctttttacacttagcgtgttttcacttagcatgttttcaaggttcatccacgttgtagtgtgtgtcagtactttatttctttttattgctcaatgatatcccattgtatggatatacacgttttatttatccattcatgcactgatagacatttgggttgtttcccccttttaactattgtgaatagtgctgctatgaacatttgtgtacaagtatttgatatttgttttcagttagtttgtgtatgtacttagaagtggaattgctagatcatatggtaattctgtgttcaacttttttgaggaaacactaagctgttttcagcagtgactgtgtcattttacattcctaccagcaatgtttgaggattttgatttccctgtatccttgccaagacttacttgaggttttttttttttaaattataataatcttaatgggtatgaagtggtatctccttgtggtctggattttgatttccctaataaaatattcatattttaatgcatagaattaatcagaaaatgagctttggcaaggtgaactcaacagcaaaatgattggcttcaactgtcttcaggagattatttaagactgccgtggctgggtgcggtggcgcacgcctgtaatgccagcagtttgggaggctgaggctggtgcatcacctaacgtcagaagtttgtgaccagcctgaccaacatggagaaaccctgtctctactaaaaatacaaaaatagctgggtgtggtggcacatgcctgtaatgccagctactcgggaggctgaggcaggagaatcacttaaacccgggaggcggaggtttcagagagctgagatcgcgtcattgcactctagcctgggcaataagagcgaaactctgtctcaaaaaaaaacaaaacaaaacactgctgtatattcactcctggggtgtgcgattctgagctgaaaatcaataacatgttgtttggggattagaagaatatttgtggatagtaagactgcaatcatcccctaactttaaaaaatgtatcatgtaatatcatgtttttgttcatggcatctgccaaaagttacttaattctttgcatttcaaagccctctttatataattccttcgtgacttaatggtttattcatttatttttgcagtgtgagtgaagacactcaggatggctcaaggatccggggatcaaagagcagtgggggttgctgacccagaggagagttctccaaacatgatcgtttactgcaaagtaaggcgcctggtcaagtgccgtgcgtgctgtccgtgtggactgttgtgttctgtgtagggctgataaaaagacaaatgttttctgcctaaactgccttactgataaatgcatattttcttctcacatcctctggttctctagttctaaaattcaaggaagttcatacttgagcacttggtatttaacacttgaaaaatattatgccatttagttttctttaaacccaaaggttgcctaagcaatgcagatgggaagacacattctccttcagtggaaaggccttagtgtaagatgtatgaactgaaagttcttcagactcgtagtatgtacaaaatctgggctgaatgctgtgggagatagagaggtatatttgtatgagatgcttacagttggtaggagacataagatgtacacaaataactgttatagagtctaaatgttaatttccaaaatagatgtgcaagtagagtgttacataatttcagaggaggaggccagttctcccagcctcagaggtgagaatgggcttgtggaagagtggtctttgaactcagttttaaaatatgtgcaggattgctttatgtggaaagcagagaggaagaacataccaggtgatgagatgtttcagcaagggcacagagctgaggaaagtaacagcaaccggaactggttagcttggacataggatgcattacaaggagtaaatggagataggattttgggaagagaggctggctggagccagatgttagtgttgaattagacaatttaatcaagaaaaacttctgtgccaagagttgcaagattgagatctctttgggattatgactgttgccccattgtgctgaatggattgttatcaagatagagcggaggctctaggagagagatttctgtgtctgtgtgaaaggtaaggagggaaaggagagacactaatccagcctgtgaaatcaccttcagaattaagagaaactgataagaggaattaaagtctggattaaaaatgacttggaaactgaaggaatataggcggcaagtagagggtcaaagatgacggggtttttgacgttgggtaaatgaaaatcattggtgctattaattcaaattgggatatttggaaaaagaatacattttaaaggaagaaaatggcacataagtttattttagtacatgctgaatttgacataattgcttcttattgtacacctttttgatgtttgcatgtttgtgaaaatttaaactaactctcttgtatgttaataaggaaataagttaatgttcatttcactaactacttgagtttctactcagttctgtgcattctgagaggctctgtgtattacttatatgggcaatgtggaactagatattcctggatgatcaatatggtgaatttttctcttttccttgtaaaaatagagttctcaaattattctggctttgagtgtaagattctgtaattctttgctttgcaagagaatgtctagataacccatctctaagaatcatgcttattaaattgcgataaagaaaaaaataggttaatgggactcagcaattagtgaaacatacagaataatagacattgagtcattgttactttcttaacccacccccaaactgggagaccccgtgccaggctggtaggaacatgggctttggagtgagacttaggttaaaatgccaactttaccactctttagcagtatgactgtaagttagttctttaacttccatgagccacaattttttcatctgtaaaaagaaaaaaaaatgtgggaggaaggtaattgtgaagatcactttagataaatcgaatgaggcatcttatatcctacttagaccacaatgtggtccgtaatgaatatctctttttcttttcatgtttaggtcttgtagagtcagtgacacttggagaggaaataaatgataaaatctctaaatgttggtgctgttaataagttgtctagagcaaatttatacagtgagtttttttttaagacacaggaaaacaataaaaatatttttatattcttcagaggattgcaaattcatggattattaaagaataagaaatgcaaaggtcatgtaacccaaccacctttctactagaatgtttgtattatgtttacaggaaaaaaaaacttcctgcaggtttatgagaacttggtttttactttttggtggtagtaaggggcccttttctggtttaatttagtaactaacatgtcaattgctgtagttctttagagaaatgacaactagtaatgaaactatatcttactttcgtgtgacaaacttgtgtaaagagtatatatatatatatatatatgttcatgtttatttgctatattaattaccataaaagggacattgaattggttcagtctgttagaaagaagacacacttattgcacagtgtgagctcaggtcctgacaccattttaaacctagttaacctgactgacttaaaccatggttgtacttgaactatgggattttcatatagttttctactcctgatgctgtaggctgccttttggctacaaccaagaacttacttgctgtaggacattatcctcaaggtatcatcagtaagggttggattgtgaagccaatgacaattcaaagcattttctttggaagtccttttgtgtaatcaattattcaaagtcatagccataaacccaaacctttccttagatacccacgactacaatttacatttaaaaaattgtgctttcatttttgttttctttctcttgtttgttgttgttgttttttttctcttgttgtcagacactttcagtgtgaaatttttgcttggactgcattgtgttgattcagatgctgacatttaaaaagccaaatctagagaaatgaagcttttgggtaaactttcgagtaataagtggatgattatgtccataatgttgttgtgacttttaaatgacatttaggatggtaacctcctgacatatgagtaatgatgggtgggtttttaaagcccacacttttcagaacactcttcatttccttttcatgttttcatgtcattaactgtgagaagttgtactttcccaaggcatgacttatttattgacttgaacagactttctaatttagtttttcatccctcatattcacagtttggattggaggtgtgtatgaaaaatgtattggtcacattaaagatctatttaaaagaaaaccttaattattcatgaagacacccagacctgttaaccttttttatattcctgtatccttaggatcctgagttactgaattgcccagtgtaatgatgatatttgaacctagctatacatcacatcatttagggtgctttataaaaatgttaatcctcaaaggaccccctccacaaggtatttctatttaataggtctgagctgggtcctaggaatctgagtttcaagatgttctcaggaaaatctgatgcccaactaagtttgaaaagcacttacttagtcttttacaatatccagacatagtatgtgttgcaaagtaatgagagagttggtgttttgaattagatttttgatttcataattatttgtagatctctcaaaacgtagaagaaccaagctcttgtcatagggattttagtagcttttccttagatattttctagtcttattttatagatgaaagaactaaaagtatagagagggtgagtaacttgattaaggctcctcagcactttcccatggaagccataatggtgtccagggagcctggccactccaatcagttgcctttctagcaccctatgcgactaccatgttatcaaccacagactactgttaccacattgttggagctgagtagccatggggcacattaaattaatgaaaataatatgtggcagatctttgactttcatgtttcttctgggagagttgacttggattaatgtctcacttttttattgatttttaaaaaatactttaagttctagggtacatgtgcacaacgtgcaggtttgttacatatgtatacatgtgccatgttggtgtgctgcacccattaactctcatttacattaggcatgtctcctaatgctttccctccccactcctgccaccccacgacaggccccagtgtgtgatgttccccttcctgtgtccaagtgttctcattgttcaattcccacctgtgagtgagaagatgcagtgtttggttttttgttcttgcaatagtttgctgagaatgatggtttccagcttcatccatgtccctacaaaggacacgaactcatccttttttatggctgcatagtattccatggtgtatatgtgccacattttcttaatccagtatatcattgatggaatgtctcacatttttaatgctaaagtttcattctactcattggtgcttttgcttcttcggtaaagattttctaaaatgtttacataggtaagattgcttttgagtaagagtaggttgctttctgattttgtttggatctttggtgttaacaatgcctcttgacaaagttctcctaactagactggtaatttgatttgtttgggtcaggaggcatggaagacatcacactctggatgtcttctacatccagaaggatggaggcatggcagatgtcacactctggatgtcttctacatccaaaagctggaggctctgcctgtctggtcccagctttgtgtggagaacttcactttcctgattctacttcttgttttgttttctaccttcttcattcttttcctccttccttttcaattgtgagatacttctaacacaaaaagaatatattcagtgtccatgtaaagtagaaagaattaaaaaatgaattatatgcactcaccattagcttaataaataaaatgtaatactttggcctcatttccccttctgtaaagggaggaaattggtctaaaaatgtacaaatacctttctgcaatgatttcaaagttccattctataactttttgatctttcgtaaattagtacacttccctgatatcaaaacaatgttgtgagactatatgcacgtttaaaggtcttttgagcttttgaagaaatattttagatagttgtaggtaatctaaattggattgagataaagcccagttaagtcaggcattagaataaaaagctttaattgtaattatttaatattcaacagtggaatttagatgacatcttggtggcaacctgtttctttggcttgctaataacatttaagacatttataaaattatcattttgtagtattaattatatgctatatacataacaagtggtgtttaagtagcaacactgtacattgccagtagtatatagtgtcatagatgaaataggggttttagaggaagacaaaaaaggccaatgttcttgtatatcaacaggttagttgcctagcctcgtcactgatggcttccttcacctattcatttctagttattgactccttttctgctggaatttgagtctagcctttatgttgctctgataccccaaggtcactcttcctaatgatttagggcccttgaagtcctgggcagttgttggtttaggcatacatccagaaagtaaatgtcacactattttagttacattggctgtggtatgcagcaagaagggaaggatctagcctggaagaatccgatgctatggaggaagctagggatagagtgtggtttggaattcatagagggcagtggtagaagccagcacaattgagagtctggggacctgcaggtcctggtgactaaggcatgatgaggattagaaactgtcgaatcaggaaatacgtattgagtgtcatttgtgtgccagacactattagatgctaggaatgcaagatgagaactgagccctgaatgagcccacaggccagctgggggtaaatggggaactagacaattacagtgttggtagaagcaactgaggggcatgggaggaggtagaggggtcatgtagtccatcccaggagaggggatgatgatgtagaagacatccagaggatttggcacctgcttcgattcttgaaagatgactaggaattaaccagatggaggaggagagagaaggtgtaggaggcaggactagcacctgtaaaagagcagatttgtgatgtcgtataccgagttcaggagactttaagtggttgatatgaagctaggtttctgtgatgaaaggttgaggaatagagctagacagatggattagggccagatcacaaaagaccttatgtaccatgccaaggagtttagacattgtaaaagtatcttccctttgggcctccacacccaagttcaactcctttgcatgctgctgtctgccccagaggctgagctgtgaggactacatttacagggctcctgtgacctctgggtttcagttgggtttggttagtaaaagtctggaaagagatgggagggaaggagaatcgcaatgtcagagaatttcttctcctgggtctcactctgcaaaaccttgcactggccatatccgtctactgaagtttgttgattctctcaaggcagactactttcctcttctgggtccggacatcctttttgtctactcatccttttgggcctttgccgactactttcctcttctgggtccggacatccttttcatctactcatccttttgggccttggggtggttccagtttgtatttgttatctcttgctgtgtaacgagttatctcaaaactcaatggcttgaaaacatttattatgtcacaatttctatgggttagtaatccaagtgcagattccgtgagttctccagcacagtgtctttttaaaaggctgtgatcaagatgttgactcggattatggtttcgtctgaagtctcagctggggaaaagtctactcccaaacttacttgtgtgactgttggctggattcagctccttaggggccgttggaatggtggactcggttcttcgttggctgtttgccagaggccattcttagttatttatgacacgtgtctctccatatcgcagctcataatatggcaggttttttttttttttttttttttttttttatcagagtgacaacaggcagagaaggaagatgggtggtagtagtcttagtgttttataacctaattttggacatttttttctttattatactttaagttctagggtacatgtgcacaacgtgcaggtttgttacataggtatacatgtgccatgttgttttgctgtacccatcaacttgtcatttacattaggtatttctcctaatgctatccctcccccagcccaattttggacatattatcccatcccttttgatagtaagaagtcactaggtccacccctcactcaaggtgagggatttacacaaagatgtgaataccaagatccagaattcagaaaatctttgtgggccattttggaagccatctaccacacagctctacttctactagccaggggtttctgagtgttttttttttataatttccctgtaccctagaactcctttaaacttggtccttttggaaatacattttccttaaattgtcctatgtatatcatctgtttaccaataagaccctaacgaatgcaagtattatcccacaagcaaagggaagcgattgagactctgcgtttcttgataagggaattcttcatgaaagggtttgaagcaggggagtcatttgtccaaagtggaggatgggatctgaaatggggaagtcaatgtggagaagattcagtgtggaggtcaatgggtgatcgatgtggaagggttcggtgtggagggagagtgttggagaagtggtaggattggaggtaggaggacagtttagagattgaacaggaatccaggtgaggaaaaatgatgcccaaatcagtggcagtggtaatacagatgggaggatgtgtttgagagatgtttaggaggttcaggcaacagaatttgggggctgagaagacgtagggagaatttgagaataatgaggaggaatgaggagtcttttccctaggctatatctgtgattctcagaaagtctcctgggataaacttttgaagcaaatagctgtagaactggattgcctgcccctctcttccctgtatgtagataaattgagagagcccaagacagagtctgtaaatggaccaggatatctgggtatttgttctggctgccccactccactagctcatttatggccatgcgtaagttgttcctactttttgttaagtctagttctttaatttgtgaagtaaggggttagctatgctgggtgatctctaaagcatttttttagatctaacattctaggtcttttgtaatctaaaatagagaaacccacattttattattttactacttcatagcctcctttactttatttttaattttctttaaaaagtgaaccgagccaaaactttaaaaacaggtaagtcagaatgtttaaaacaaatggcttttggtcttcagcacttagggcttgttttttttcactctttttttttttttaacattaaataaaattcctggccacatgcagtggctcatgcctgtaatcccagcactttggaaggccaaggcaggcagatcacctgagatcaggagtctgagatcagcttggccaacatggcaaaaccctgtctctactaaaaatacaaaaattggccaggcatggtggcacacgcctgtaatcccagctacttgggaggctgaggcaggagaatcacttgagcctgggaggcagaagctacagtgagcagagatggtgccaccgcactccagcctgggtgacagagtgagactctgtctcaaggactaacttcagaaagtgttcagggtaactaatttaattgttcagtctacattttaagattcctttcattaaattttttgaagctttttttattgccttaggaaaaaactgttctgttttccttttcccccaggattagacttgctggaagaaaagctcccccatcacattatcttggttggcaggagacaggcatgcaggcaagtcccagaccagtggtatcagtgtccacagatgaaagggatggtatttttagtgtggggaatagctcagtgtggtttcatatgatgcattttgatgagtataactttctaatttgaaaagcctttggtgtgtttacgtcttcatttaatctttccaatttctccccctcatttcatttcaaggagtctaagatttttcattttggcaggcagttgatcactcttgttattgacactcctttgcagtattcttacactgtggagaacctgaatggctgtaaattccctattggcaggattttggagaaaaaaaaataaaagcgaatagatacctgtgaaagaaaaaataaatacattttaaaataattggaggatagaaggattacttttaaaagttctgttagtttgccagtacagagcaaaacagaaaatggacacatttttttgatcagcattctctgttctaaaaacttatttcaataagggaaagaatatgcaaagacatatatatagatatagacatacacccactccaaaagaatagtgatatctttctggtaaataatatccaaagtttggaaagaaatcaaatatccattgaaaggaaactaattttagggggataggattcacatttggaatgatctcatagttagtttactggatttctgttctggtcaacctaataattgtcttgaaagtgagatggctactgacattctagggtatggttagggagaatattctttatttttaaaaccctacaagattttttcattttttaaaataaaatgtcttatttgttaaatatgatggttatgtaggtttactcaaaagtgattttttccattgctctttattattttctgcatctctgtgcttacagctgaaataatttttagtattttctttagtgcaggtctgctgaagataaattctctcagttcttgtttgtctaaaatatctttgggccaggcacgttggcttacgcctgtaatcccagcacttgggaggccgaggcaggaagatcacttggcccaagagtttgaggccagtctgggtaacatagggagacaacatctctacaaaaagaaagaaataaaataaaaaaaaattagctgtgcatgttagtacatgcctgtagtcccagctactcaggaggtggaggtgggggaatcacttgagcctgggaggtcaaggctgcagtgggccatgattgtgccaccacactctagcctgggcaacagagtgaggcatggtttcaaagacaaaaagaaagtctttgtttcatcttcattttgtgaagggtgttttttctagatttagaattctagattgtcggttattttatttatcataactgtcattgtctcttggctttcattgtttctgttgggcagttggctgtaagtttgattattcctccttcgaatgtaatctgttttttcctttggctgcttttaagatttatttcactttggttttagcagttttattataaggtgtgattttctttttaatttattctccttagagcttatgagacttctttttatttggttggtgcttggggattctttttttttttgatggaggcttgctctgtcacccaggctggagtgcagtggtgcaaccttggctcactgcagctgccacctcctggaatcaagtgattctcctgccccaacctcccgagtagctgggactagaggtgcgtgccaccacgcccaaataatttttgtatttttagtacagtcggggtttcaccatgttgaccaggatggtctcgatctcttgacctcgtgatcctcccacctcagcctcccaaagtgctgggattataggcatgagccaccatgcccgactgtgcttgggaattcttaaccattaacttttcaaatattgtttatgcctagttttctcatttctctcttcttgggattgtgttcatatgttaggacctttttcctctagatttcatgtgtttcttatgctcttttctgtattttttattcctttgtcattttgtgcttcaacatggatattttctaccgacttatcctccagttcactaattctctcttcaatatattagataatctgtggttaaagtcatcccattgaatttgtaaccttagttattgattttttaagttctaaaattttcatttaattttctttttatagtttctagttttctgctaaacttctctattttgtcatttaattcctaaacttattaatcataattgtttcaaagtccatatctgatactttaaagtctttatcacttgctggactgtttctactaaccttttctttcttttttttcttttttttttgttcttctgtttatttattttattttttattttttttaattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgatctcattgttcagttcccacctatgagtgagaatatgcggtgtttggttttttgttcttgcgatagtttactgagaatgatgatttccagtttcatccatgtccctacaaaggacgtgaactcattcttttttatggctgcatagtagtccatggtgtatatgtgccacattttcttaatccagtctatcattgttggacatttgagttggttccaagtctttgctcttctgaataatgccgcaataaacatacatgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccaacacctgttgtttcctgactttttaatgattgccattctaactggtgtgagatggtatctcattgtggttttgatttgcatttctctgatggccagtgatgatgagcattttttcatgtgtcttttggctgcataaatgtcgtcttttgagaagtgtctgttcatgtccttcgtccactttttgatggggtggtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgacctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttctccattgcttgtttttctcaggtttgtcaaagatcagatagttgtagatatgtggcattatttctgagggctctgttctgttccgttgatctatatctctgttttggtaccagtaccatgctgttttggttactgtagccttgtagtatagtttgaagtcaggtagtgtgatgcctccagcttcgttcttttggcttaggattgccttggcgatgcgggctcttttttggttccatatgaactttaaagtagttttttccaattctgtgaagaaaggcattggtagcttgatggggatggcattgaatctataaattaccttgggcagtatggccattttcacgatattgattctccctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatggagttcactcatgatttggctctctgtttgtctgttgttggtgtataagaatgcttgtgatttttgtacattgattttgtatcctgagactttgctgaagttgcttatcagcttaaagagattttgggctgagacaatggggttttctagatatacaatcatgtcgtctgcaaacagggacaatttgacttcctcttttcctaattgaataccctttatttccttctcctacctaattgccctggccagaacttccaacactatgttgaataggagtggtgagagagggcatccctgtcttgtgccagttttcaaagggaatgctgccagtttttgcccattcagtatgatattagctgtgggtttgtcatagatagctcttattattttgaaatacgtcccatcaatacctaatttattgagagtttttagcatgaagggttgttgaattttgtcaaaggccttttctgcatctattgagattatcatgcggtttttgtctttggttctgtttatatgctggattacatttactgatttgcatatattgaaccagccttgcatcccagggatgaagcccacttgatcatggtggataagctttttgatgtgctgctggattcgttttgccagtattttattgaggatttttgcatcaatgttcatcaaggatattggtctaatattctctttttatgttgtgtctctgccaggctttggtatcagggtgacgctggcctcataaaatgagttagggaggattccctcttttcctattgattggaatagtttcagaaggaatggtaccagctcctccttgtacctctggtagaattccgctgtgaatccatctggtcctggactctttttggttggtaagctattgattattgccacaatttcagatcctgttattggtctattcagagattcaacttcttcctggtttagtcttaggagagtgtatgtgtcgaggaatttatccatttcttctagactttctagtttatttgcgtagaggtgtttatagtattctctgatggtagtttgtatttctgtgggatcggtggtgatatcccctttatcattttttattgtgtctatttgattcttctctctttttttctttattagtcttgctagcggtctatctattttgttgatcctttcaaaaaaccagctcctggattcattaattttttgaagggttttttgtgtctctatttccttcatttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttgaaagaacatctttatttctgccttcatttcgttatgtacccagtagtcattcaggagcaggttgttcagtttccatgtagttgagtggatttgagtgagattcttaatcctgagttctagtttgattgcactgtggtctgagagatagtttgttataatttctgttcttttacatttgctgaagagagctttacttccaagtatgtggtcaattttggaataggtgtgatgtgctgaaaaaaatgtatattctgttgatttggggtggagagttctgtagatgtctattaggtctgcttggtgcagagctgagttcaattcctgggtatccttgtggactttctatctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatctgagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggtatgattttgcagcggctggtaccggttgttcttttccatgtttagcacttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggcccccactctcttctggcttgtagggtttctgctgagagatccggtgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaaagttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacatagttgtcgagccttggttttcagctccatcagctcctttaagcacttctctgtattgattattctagttatacattcttctaaatttttttcaaagttttcaacttctttgcctttggtttgaatgtcctcccgtagctcagagtaatttgatcgtctgaagccttcttctctcagctcatcaaagtcattctccgtccagctttgttccgttgctggtgaggaactgcttccctttggaggaggagaggcgctctgctttttagagtttcccgtttttctattctgttttttccccatctttgtggttttatctgcttttggtgtttgatgatggtgatgtacagatgtttttggtgtgggtgtcctttctgtttgttagttttccttctaacagacaggaccctcagctgcaggtctgttggaatacccggccgtgtgaggtgtcagtgtgcccctgctggggggtgcctcccagttaggccgctcgggggtgcctcccagttaggctgctcgggggtcaggggtcagggacctacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggtgggcacccctcccccagcctcgttgccgccttgcagtttgatctcagactgctgtgctagccatcagcgagactccgtgggcgtaggaccctccgagccaggtgtgggatataatctcgtggtgcgccgttttttaagcccgtcggaaaagcgcagtattcgggtgggagtgacccgattttccaggtgccctccgtcacccctttctttgactaggaaagggaactccctgaccccttgcgcttcccgagtgaggcaacgcctcgccctgcttcggctggcgcatggtgcgtgcacccactgacctgcgcccagtgtctggcactccctagtgagatgaacccggtacctcagatggaaatgcagaaatcacccgtcttctgcgtcgctcaggctgggagctgtagactggagctgttcctatttggccatcttggctcctccctccttctgtttattttttattaagttctgggcattatacaaataatatagaagacatcatttacggctctaggacaatgttacgttacttctgagagaacttaactatttttttcttttatgtcagtcaaaataggaatggattaccttaatcaagtcagacacaaagattacttgtagctggacttcagttcttcttagggctagatatatttctagatctcctttactctctgtagggagcccttctggttccaaccaaaaccctgggtgcccctcctccttggaggactctgacctctaatttttgtcctttaaactctatgacactgccaaaagctctgttcagcttcttgatcatgccttttgtttaagaaattgacaatgctcttgagaagaacaagcagctccaattgctgggctcatcttcttagttttcttctttcaggtcatggcctcacaaactcttactgtcttggttgcttttcagtgccctcaaacatgtttaacaaaatgtttttcagcatttccagttgctctcatcaggagggtgtttctgaaacatctagttagccattgtcagaagtagaaccccagaacattggccttgagagaaggtggatccatcttttatagccttggtttgctcttaaaatgttttagaaaagacatatcctgagtgtcttagtggtctagcgtgatggtggtagaggtgaagaaaagtgaaacttccagtatatttaaaaagtggaattaacccgttattagttttagatggagatgagagaggaggattcagggctaatggccaggatctggactgggcatctggatgtccagtcactaggataagtggttgggttagtgacactggagcctcaagtcaccacagtaacagaatgacattcaccacagcctagttatgtaaaactctggacagagggaataaatccaggcaaatacctctacgtatgaaatggacctgaaaagaagctttacctggaggaaaccttacctgactccagagacctttttggtttagaaaacaggaagtaacttgtatctgtcagtatgacacttttgaacatttctgtattagtttgctaaggtgctgtaacaaagtcccacaaactatggcttaagacaacaggaatatattctgtcacagttcaggaggatagaaatctgaaatcaaggactgggcagggctacgctccatttgaaggcttagggaagtcccctttcttgcctcttccaggctttctgtggctgctggagatccttggtgttccttggcttgcagcagcatcaccctggtcttcgcctttgtcctacctcaccttcctcatgtgcctacctctgtgtttcacatggccttataaggacactagttgtgggatttaggcctacatccccatacccccaattgattgtgacctcatcttaatgaattacatctcaaagaccctaatttccaaatgaacttacatacgcaagtcccagggtttaggactacaaaatatctttttgacagacacaactcaatccacaacaatttctagtttatcaccgcgtgaagcttagtgctctctgcaaagatcaaatgaacaagtagtgtacttattgagctgttgcttctgacaaagcactgtgtggggaataaaaagtagcgtggcacacagtctctgtcctagacaactttactgtccaactggggagaccaagagtgatgcagaactcaggaggaaaataagctttggttggccacctaccatttaccagatactgcagtgggggctatacatatattgagccatttaatcatcagaatagcttgctaggtaagtggtattcaccctatattacagataagggaactgagggtcagaaggagtaaataactagtattaagtggtgctatcagaatttgaatctagatttgttgtattctaaagcctgtggttttggggaagaaactgaattatgttaaaaaaaaaaaaaaaaaaaaaaaacaaagctgttagaaattaaccataagagagttagtgtgagagctgggtgtggtggcttgcatctgtagtcctagctactgaggaggctgagatgggaggatcccttgagcccaggagtttgagaccagcccgtgcaatatagtgagaccctgtctcaaaaagaaaaaaaaaaagttggtgtggacaaggaaggcttattgaggaagaagaaatttgaagagaaatcatctgaactgtgtttttaagaaagggtaggagttggctggtggaaaagagccaaaaactgattccaggtgatgggagctacgtgaaccaaggcaaggggatagaatatatcagatgtatttaggagaaaatatattttataacactatatataagatacgtgctttatataattatagcctcattcttcatatggagaccttgaagtaagaaaacaaacatttttagctctgtgtctcacatggtaaggtattggtaaagctgagccttctgccaatgaattttttttccattcctcttcagaaataatcgctttccatttaaaaagtaataattcaatttagaaagaatcaaaatataaagtagagaaaaaatctcacatattcctatcatgcaaatatgactaaagttaacattttggtctcttcctcccagtccttgaatatgtatcagtagtatacataacacattaacctagagagtaatcatagtgtatgtgctattttgtgcttttctaccataacctaagcactaatctgtgccataatatgtcatcattatcatagttttatttatttttattatttttaattttgagatggagtctcgttctgtcaccaggctggagtgcagtggtgtgatctcggctcactgcaaccgccgcctcctaagttcaagtgattctcctgcctcagcctcccgagtagctgggactacaggcatgtgccaccatgcccagctaatttttgtatttttagtagagacggggtctcactatgttggccagaatggtctcgatctcttgacctcatgatccgcccaccttggcctcccagagtgcggggattacagctgtgagccaccgcacctggctatcatagttttaaaggttgaataatattctaagtagataatgtaccatgatttacttatttagggtttgttattaatagcaaattaaaaaattcctaggtcaaaatgcatgacctgtgttacaactcctattatatatatggttttctggaaggtcaatattgattttggcatatatagactgggcttctctgggttgttgtaaaagttctatgtcattgaactacagaaagagggtgaggggatttctaacaattagggccagtgttttcttcacctctaaaccgcatccccatcctagtgtctgcttggctttgcaacaccatccttatcctgagagctttgttgatgcctggggatattcagaaattttcgacttggaacccttccaagacatttgctattttattctctatttgtttttcttaagcaactaactaaataagaataacatttcaacctctttctactccccacagcattttttcctgcctgcaccacctctgcctacagtttaaccatggggttgcttcttatattttaaagctaaatacaaaagcacagttctgagaagcagccaagttctgcagccaagtttgaagaataaaactttaaaacagctcttctgtcacacacttgagaggggaggcaggctttgctataaataagtcacattccatttctatctcatcctttgcagtcctcttgggtaatgctttttgtatatgactacagtgttctcgaactgcccactcacccctttcaaccttccattttgtgcctcactttatttaaatgttcaatagttttggagtttagggaccctgcatgaaaggagtagacctttcctttcattcttcaggcttagatgtaatgagattcagtggctaacttattagaaactatactttctctttgtctgtaacgttttcagcagctgcctggattagtttcctattgctgccataacaaattgccacaaatgtaatggcttaaaacaaggccaggcacagtggtgcatgcctgtaattccagcactttgggaggctgagatgggattgcttgagctcaggagttcaagaccagcctggccaacatgatgagaccccatctctatttaaaaaaaaaaaaatacaaaagttgtctgggtgtggtggcgtgcacctgtaatcccaactactcaggaggctgaagtgggaggatcacctgagcctggggagctcaaggctgcagtgagccatgatcgtgccaccgcattgcaacctgggtgacagagtgagaccctgtctcaaaaaacaaaaaaccaagaaaccccacaaatgcattttcttataattctagaaatcaggagtgaaaaatgatttggcagagctgcatgccctcagggggctctaggagaattcatttcctccccttttccagcttctagaggctgcctacattccctaagtcatagccccacatcagtcccacctctactcttggcatcatatctccttctccaactctgaccttcctttctctctcttataggacccccggtgattacatggagcccacacacataatccaggggtacctccccatctcagagtccttaacttagtcccacctgcagagtctcttttgccaagtcaaataacatatttataggtttgtgggattagggtgtggacatctttggagggccgttattctacttatcacactgtcttagaaaaggaaaggaaaataattttggaatttttgtctttttcatagctagggaggaggtacgctgaagttttgtttttccttcctgtatttgtgatggttgatatgtggcaatctaaactaagtctgggatgtctgtttgtattggctgaagttcattggagggcagaaaagaggagagtttcagagactggcagtgaggatgggagggtggcttaaagaccttcacaacctgctcactgggtgctcctgttaggccccacaaacaagcccatgccatcgaggagaagtgaccaagcagatacattcaaaatgaataaaaggaagacctcatttactgtagtcccatccagtgtggcttccttataggactatttgtctctaattattttatttattttttattttttcagagagagtctcactctgttccccaggctggagtgtaatggtgtgatcttggctcactcagccttgacctctggggcttgatcctcccgtctcagccttcccatagctgggactacaggcatgcaccaccacacctggctaatttttaaacttttttgtagagacagggtctcactgtgctgcccaggctgggcttgaactcctgggctcaagtatatcctccctcctcagcctcccaacatgctgagattacagatgtgagccaccatgcttgaactatattttaaaaaaatattaattatgatactaaacaatacagtgaataaataaccttctcatgactgtccatctggcatagtagaagactttatgtgcttttttcaaacaatgagagaaagtgctggcatatcgcacttcccttagcttgagagacatgtgccaatctgcttgttgactctgccaaggcctctctttccgtcattttccatgttctggtcaggatttgtgacatatagtggctgacaaaaggcacacaagtgatagtgttggtggccaatctgccagggaagagtctgaccctgggcgctaatgtgactcaaggtagatgagcccttcgaggagctagtcaaggaaacagatgataaagtctaactatcagtgagcgagcagggggtgagcattttctttctgaagggagttattactgtcattaacttcattgcgttgctgggaaggaggggtcagtagttgaaacaaaagtctcctatggctgatgacatgttacaactttaggacagttgtcagcaagcaacttgctgttgggcctaatctgtccccatgcctttgatcccttgagcctcaggatggtttctacattttgcaatggttgaaaaactttaaaagagaagccatattttgtgacatgtgaacattatgtgaaattcaaatttcagtatctgtatatcaagttttattgaaacacagccacatcatttgtttatgaattatctatggcttttttttttgagctaccacggaggagttgagtggttgtgacagagactgtccgtatgaccggtgaagcctaaaatatttactaactggctttttacagagaagtttgcagcttctgttttcggagatttgaaagagactgaaaaagcatcggcaaatgtccttgttgggacaatatttccataggaaccaagacccagtgattccatgtggtgctgatttatttccaggaacccatggagggtctaactggggagggggtatacaagataaattagaaacaagtgcacattcctgtactacaaaaaatatacaagacctgccattcacccctcaaataatatgtttcctttcctgaggggtcacataatttatgccagtacattattgatgagatttttgtttgtttttttaaaataaaaaacaggcatattgagctgctggaagtgttgagctggctgttctgaaatatcccactaggatattccacttgctggctggctacctccatctcagatgcaatgtccaaatggctgtcaatttctgcaggacccactttgtgccaggcattgggccagtgctttgggcacgtgaattgctcacactgagagcactgctgtaaaatcattgttattcccatgccgcatatgaagaaaggagcttacactgggtaaacccatgcctgggcctcccctgtaagtgggaatcccgagttgcaggtcaggctgtctcttcttcacagaccatgctctttcacaagacctggaaggaacaagacaaccacctggggagctgcttacttctgatctttcctctgggatgccagggctatcacaacctcataggcaagatactctaatcactgagttatggtgttcggtgataatatcgacttccatttttataatttcttctagcactctgcatcctgcatgttatatttgtaaaaggcctgtgaaaaacataaggcagacatatctatttctgctttgtaaatgaggaaactgaagctcaggggtaaagaggcctttctaggctcaaccagcttttagtggcagagccagacctcttgacctggggtctggtgcctgtacactacttcccatgggccaggtctttgggaatagagctgcgtcactcacacttaccttagcagaggctgtgatagactctaagccgtatggtttttagtttatcctcagtgaacctcaggtcatcaactgacctccagagacgaatttcacgttgtagatggttttttttgttggcattactttacaactgtgactctgctgaatgcactgtacctttctctttcctattaccacatccattgcttgagtttcagtcctgtcttagtccattttgtgttgctgtaaaggagtaccagacactgggtataaagaaaagaggatttataaagaaaagagggttatttagctcacagttctgcaggtgtacaagaagcatggcaccggcatcaacatgtcagagaaggtcaaaggagaagtgagtacgtgtgaagagacaccatacccaaagggcatcctggctttacataataataaaccaacctaatcccatctcgccagagtgagaacagcagcccagcacgaagtcattcatgagggttctacgcctataactcaaacaccttcccctaggccccaccttctgacaccaccacagtggggagcaaatttcaacatgagatttgatggggacaaaaaatcccattatccaaaccatagcaagccccaatccaaaccaaaagcagatccccattcgtggttcccctttccacatggttccaaatgaggaagggcaaaattcatgtgttctgctcagtaaaaggttgaaaagttattgggaaacacatcttccaaggtttgtgtcctttgggacatgggaatatgttattaaccaggacagctgctcacagctgcacagggatgtactgaaacagctcattttaagcaaattttaagtagtggagaggatcattcctgggcacatttcacaagcattctgtcttggttttaccccaatctctgcatattccttcttcgtcttcattcccggggcagcttcttctgcccaccccgtgaaactttggcccattcttttctgtatgctgtccaggggccatctcctcctctctacatgctgcattgaggatccccaaattgctatcctctctccaaactccaaatgcctatatccagctaccaaaaagacatctctgtttgaatcttcctcacttaccacaaacataacaggtagaacatagcttatttcttgccctgccaaaactgttctccttctgagcttcagtgcttggtgtagcatcctccacatagttggcatcggaggcagaacctgaacctgattctctttgacaggcctaatcactcaccactctacgcaatatgaaaatgacatgccatgtgaatccaatgccatgtaaaaaaagataacattttctgtttgtctccctaggatattgtaaatgcttggcaccaagtaggtgataaataaatgtgaaggacaaacctgttgattaagcgttcctgagacatatcctttatctttctcagatgagattctctgccacatagcttatccctgtattgggtggattgtgtaactctgaggttcaaacattgggtattgcctctaaaccttgcacagttatttatctcagaactattgagtttggcggctgtccacatcatgtaacaattctgctgttaccttcctttccttgttttcttccttccctctctcctcatcttccacattcctatctgtgagagaggatgagaaaaaaacagacaagaagacaaaccaatatttctctcaccaatgaaaaatacctttccgttctgtttttaccattaaatgtggtatttgccctctgtgtctcaattaaaacaggttatttccttcttagtttcttcttttatattttttttcttgtttcagaaatggttcatgttaattgtaaaagaaaaattccgaaattatagataagccaaagaaataaataaaacatgtaacaaccccctgctcagagagttgtggttaacttttgaagtacctacttccatgcttcttttctaggtacatattttaacagaaatagagacttactgtacttgctgttgggaagcttcttttcacataatagattgagaatattttcttgtgacagtcaatattcctctagaccagcaattggatcactttgtttaaagggccacatagtaactattttaggctttgtgggacttactgtctctttcagctaatcaactctgctgttataagtgcagaagcattcacagaaagtgtgtaaatgaatggacatgtctgtattctaataaaactttatgaaaacaggcagtgagccagatttggcccatgggtggggctgtagtttgcctatgcttgtctagaatatcttttttttttttttttgagacagagtgagacagagtcttactctgtcacccaggctggagtgcagtggcatgatctaggctcactgcaacctccacctcctgggttcaagtgattctcctgccttagcctcctgaatagctgggactataggcctgcgccgccatgcttggctaatttttttgtagttttagtatagacagagttttgccatgttggccaggctggtcttgaactcctgacctcaaacgatcctcccaccttggcctcccaaagtgttgggattacaggcgtgagcccacactccactagaatatcatttttaatgcctaaatagtgttctatcttattgatatatcattatttacttaaccagtcagagtaatagctaatgttgtttgaggccttactctgcgcttgcaacattgcttcgtttgttctatttgcattctgacttacacctgcccacagccctgtgtagtgtaggtattattctttctatttaacagatgagggaactcggataaagaacaggtgggtaatttgcctaaggttagatggttagtaaatagaaaactcaaaatttaaatttgtttgatttttagaagccatgctcttaactactcattatgtttttacgcacgttagtaattatttgcttggataaattcctagaattagaataacacatgcattttaaggttttgatatttgttgtcaggttgatatatttggccaacttatatttcttgagtggtatatagcagggctgtgtttctacacccttgtctataacaaggactcttttgacgctttgctactttaataggtaaaacaagcttcatctttttttatcttatgaatactctctatatttcttctaaggtgagtgtctgatgcatgttctttctccattgttcaataagagcatttgtcttctctattaatttgttggagccttttatgtaagggacttctgtggtttttaagttgatgctacatgacgtgttatgaacatagccttttactttaaggagatgttgtctttacaattgaagataattaaatggaaaagtatttagttttaatgcagcattaattagactcctggaattgaaaaaattcccagaaactgtaaggtaagggaggacttactcctgttggggaacttgtccctttagtttccatctcttaagtactagaatttgtgttctttaattggaaccattgctttgctgtggccatggcaacacatcttagctgccatgaacagcgcacactttgacaaaatattttttttagagagtggcttttagatggaattcattttccaatgtattcatggagtctagatgaattaatggatggtagacccatacttttataataatagtaataataatgaaatgaatagttactatctattgatcccttactgtattctagccacaatgctttattttatattatttcatcggatctttgtgataatcttatgtcatagatattgttgttatccttactttatacataaagaaattaacacagaagagttaagtggcttgctctggcttatacagatggtaagtagtggagtttgaccttgaccttaaccttgattttctactgcgtgagtcttacaggtttattatagcctttagggtatatactgaattcaacagtggtagcatggatggcaaatcttgatgtcatctagagtctaagatgacactagcatcagtgggccacagggaatctgacccagactttcataacttgtattattatgaagattagagttctgaagcttactggattagaagagcacgagggggtagctgccccaatatattctaatttctcttgaggaccaccaaattggcagagtgtctctgatagggaaaaggaagagttggaaggcatcttagcctctaggacagaagaaccatttttattggccaccaaagttacatctagttgcctacaaatttatatccaaactccttatcctgccaattcagggttctgcaaactgatgccaaactatagtttagtcttctatcacatgactgcattatacatacccaattatctgggcaaacagacctgatccaaacacagtttgtactttcctttcctttcctttgtttagcctgttccgtctacttggggtgtctttgatttctccagcctcagtctcccgctgttagaattctgggcctccctcaataccaaggttaagtagtacctaacgaagaattttttatttttacagacaaaagcagtttctctcctcctctttgattcttatggttatttatattactctcaagtcaatcataaccttcttatttgtaggatagtttctccctgtaggacttgcaggattcctcgaatacagtgcttttccaaaggtaaatgacgacataccttaatcttgttgttagggattctgactctgagagacatgaaaccactgtttagagtcttgttatgtatgaattgtgtccccctccacccagtccatatgttgacatcctatccgcccatgtctttgaacgtactttgaaatatgattgttgcagatgtaattagtaaagatgaggtcatacaaaagtagggtggactcctaatccaatttggccgtcacactggaaatttgggcttgcacccaccgagaacattgtggaaagattggaatgatgctgtcagaagccaaggaactaccagaagctagaagagaggcctgaacatacccttccccagagccttcagagggagcatggccctgccaacacctaggtcccagacttccagcctctggaactgtgggacgatacatttcttttgttgaagccactcagtttgtggtactttgttgctgtggccccaagaaagtaccacaagcctgaggttttcaccgtccttacagccagcaagacgggatgtttcagatgaccctgtcctatgtggaactgggggctgaggtggggtggcctgataacagagtcaccaaagagctgcctctcttatctgtactcctgagttctcacagccttctgggcatcttcagcaccagcaactcagcatgtcaaaactgaacatctttcctctccaaaccccttttccctcataagcccatctaaattatggttaccatgtccctctcagtccctctggaattcttcccttttctcatccccaattgaaaaaaaaatctggaattctatgttcttctggaaaataaggaagatctggcaacaccaggcctttgttactgcatggctataattggccagatggatgggctgcccctgaacatagagaatgtgtcctgggtcctgtttgacatcgcatgccagaccctgtgggcattggagcctggcccctggcagggtggaagtgattgcctctgcctcacagggacataagtggaaagcttcagatcattctctgagtcaagctgtccggtttatgtcctgctgtgtcgcttactggctgggggcagccatgggaagtttccttgatctccctgtgcttccgtttcccagtctgtaaatggagataataatggtgctcgcctcataggggtgttgagagaattaaatgatttaatgcgcatcaggagattggaacctgacacgtagcaggtgcacctgaaatgttcccttatattcttatgtagtcaagaaaatcttgtcaccctttatctaaactgctttattatttttcatgacgcacggcatatttacttcttggttttactttgctactctccatcccccaccagcttgacacacattcagaaaatgtggccatagtttatacacatagattcagggctggcctaccaaggagtttggacaaagctcccgggatctcacttggtggagctcctgggcctctcctggctgccgagtcccctgtgctttctgccttctgtgttgtttcggttccagtgaccaagggcacagcttggtgactggcctcccgaggccttccgagtcaccgggggatccctctaattaggtacactgttgagcatgcaggtgtatatcctgcaggcaagaagggctgctgaaatagtagcttaacatgaaatccaggcagcaagtcgggtgttcgttagaagtgtgtttttttttttttgtgatttgggacactgacaaagcccagacaaacctccccacaccaattgtttcccccagctgtattccccttattgggccactcctaagcagtgctgatgacttatttagctaatatttgttgactgaatttttattaatcaatagagatttgttaagtaaatggagcattattcagacatgtggcatcagatccattactagatgtaagtgataaataaagtggtaggtaagacacagtcctgcctgtaagagatgtgcaatctagtcattgagagagaccctatgagaaacagtgggtggagctgggggattaccggtgttgtttatgggatcccagagaggaaggaccctgactcagcctgaggttgggactgggggcaactgggggatcatcagacttgtcattattgatctaatgtcccagtaaaattgggcgttttcaggacagggactgtgactgtctttttattgctctatgtcttgtcctagcccagtggttgacatataacagacggtcaataaacatttgatgagtaagggaattaagtgacatctaagctgagaactgaaggatgaggagtctgccaggaggaaagtgtgggaggtaggggaggaagggggtggcgggaggaagtaaaatgatgacgaaggatggtacagggagggaggagcatgtgctccttgagggtgacaaggactgcagttctgggaactgttagcttgtatggtgggtggcatggagccatttcaaggtgggggcctgggcagagctgaatggtgagaataacatagagttcttagtttttacatgatgaggtttgatatgcatgatccaaggtgcaggaaatggattggagaggacagggtggaagaggagaggccattcgatggctattgcagcaatcttgagagatggtggtggcaggacaaattactgacacctgagatggagaggtgactagattcagaagcaactagggatgtagaattgtcagaacctggcaattaggtgtctgtggggaaggaaggagagatgtatgaatgatgctcaggcctccaggggatgtgggcaccacttacttgtgatagatgagaagaggagctgtgagaaggttaaattcacacttgggcatggtgagtttgagatgcctgtgggaagtccagagcgcagttgtatacagcaggcttcacctccagagagtgatcagatttgagatacaggtttgaacactcattggcatagagggtcagggcttcatagcctagaaggacatagataaaattaagaaggcctatgaacttcagaaattatattaaaatcataatgcatgtgcattgttctgaagagctagctttgtatcaacttttcaaaatgtctgtgtcctcaaaaaggttaacccttggtgcatatggttaatgaagccagaaggagagatgagatttttcaggcagcaagaagggaagagagccagggtttgtgctgcagaaaatatcaacatttcgggggtgggaggcactgtgctgagtcagaggcctgggggtcagagttctgggaatgagataaagacttacaggtagcaatagctttactgttcataaagcacttttacatacaatgccattttatctctcaggaactcaactagatctttataatttggctctgtatcagttagagttcagtacaagacatgaaaacttggctataaattttaaagaagggatttcctagagggaataggtgcttactatggacccagaaaatctgagataggtctcagttaatgtagaaagtgtattttgccaaggttgaggatgtgcacccatgacacagcctcaggagggcctgacgacgtgctcaagctggttggaatgcagcttggttttatacagtttagggagacatgagacatcaatcaatgtatgtaagaagtacattggttcggtgtggaaaggtgggacgactggaagcaaaggcaggaagactcaaagcggagagggagcttccaggtcatagataggtgagagacaaacagttgcattattttgagtttctgattagcctttccaaaagaggcaatcagatatgcatctatctgagtgagcagagggatgactttgactagaatgggaggcaggcttgccctaagcagttcccagcttgacttttccctttcacttagtgactttgggggcccaagatattttcctttcacattacaaaatctctggaagggcagccccagggaaagattcccagaacaatatagaactaaggtcagagtacatccctgtagctgccaccctggcatcgaaaagctgggactggaaagccaccatggctgcagctctttctcggccttcatggagctgaaggaaggatgctggacactactgtattaagaaatctgttttcgtgacctgccttgatagcagtgaacagtcaaatagaagccaaagcatggccctcatctcacttccaccttctagaactccttgcttgagtacatttaattagtggaatccacttcagtcctgaatctctagatgcagagaagtctggaagatatctttataccacctctcttcctaaaaggagtgtgaaatggagctagagaaggggtcttattttgtaagggtcaagttaagaactgtttcagtcttagtgagccatgtggtctctctgcagccttgccattgaagtgtggaagcagccagagaccatacagaaatgagtgagcatattgtgttccaataaaactttatttataaaatcaggcctggcacagtgtttcacgtctgtaatcccagcactttgggaggctgaggcaggagtgagcttgattgtgccacagttctccagcctgagcaacagagtgtgagaccctatctctaaaaaataataatgataaagttagttaattaaattaaaatgagtgatggggcctaaaggccacagtttattgacctctgaggtaagcaaatcaattctcaataattatcgtaggttcttttttacagatgagggaattaaaaccggagagcgtcagtcgaagtgaaaataagtcctggttatttagttttcaaagttcatgttctccaggaaatcctgatgctcagcctctcctcttacaaggcttgtgatctaaaagaggagataaaatatgtactttgttggtgcagaccatggtaaatgctcccgggatggtgcggaatgcttttgcatacaaggcatttttgacaggagaaatcagaagtatgatggtgaaagtagttttagctagatgttgaagaaaggtataactctaacaggtggagatggagaagggaggagtcaaaagagctgatagggtttggctctgtgttcctgctcaaatctcgtgtcaaatcataacctcaatgttggaggtggggcctggtgggaggtggttggatggtgggggtggatccttcatgaatggtttagcaccgtccccttggtgctatccccgcaatagagttctcatgagctctggttgtttaaaagtgtgtagcacttcccctctctctttctcgtgctctggacatgtgaattgcctagctcccccttcaccttccgccatgattgtaagcttcctgaggcctccccagcagctgagcagatgctagcatcatgcttcctgtacagcctgcagtgcatgagccaattaaacctctttttttttttttataaattacccagtatgaggtatttctttatagcagtatgagaactaatagagaatttttgatggagtcaaaaactgcaagagaagtttaggaaaacagctagaaatggaaactcatctgaacattgtgaccttctatggtgttagtggagataagactggatcagggagaaccttagatagtaggattaggaatccgaacttggaaaaggggaagcactgatagtcttcgagcagggttgtgatacacacattacctcaggaagaattatctggttttgttctacagaattttgtgtaagtcagaagatacagccagcaagaattcgctcaggcggttgttgtaatatctttacatgaggatgcaaaggaagaagtggacatgagtcttgggccattcatgggacagggcaacttgtaaatgtaggtggaatagaaggatggctttgatgggaagagatgaaatgaataacaatacttgggaaatttgaggaatgggagcttgttttgtgggtaaagtaatgggccccatcttggatatgaggtgctgaggggcagaaacggaaatatggagtaggcgattggaaatgttggcttcatcttcaagatggggttggttgggagtcatcccatacaggtggatagagagccaagtaagagctcagctctctgagggagtgtgtacagtggaggatgccggaaggagaacccaggagacaaaggtattccagaactgggagagggacaagagataggaaaatgtagtaggcagggtagtgagagtggcaggatggatgttgtaccagaggagtcaagttagggagctatttccagaaaaagaaagagccaggaatgttgcatgccacagaaaggtcaagaaatactcgaaaaaccactggatttggtgaccacatctcaaggtcatgggcgaccctgagagagctgtttagtgtgtgttcttctcttgaggagtttcatattgaaagaaaagaggagagaaaatgggagattgaaatttgtggcttgttttaaagtggattaattcttcagtgccagaagaccacaaagaacttggtctgagaatatatcctgatttctccccaagacttttcttaagaaaaagcaagttgaaagaggaacaccctttagtttcgttctctcttgatttcaggattcggtttttggtcagttgtttgtgtctgactccacttttggccctgtcgtggggccgctcctggcaacctgggaggtcacgcacaagtgtgtgcagttgttaagcaactgctcgcagtcgcggtggccctgctaaattgggaacatgtattcgtcccagtctgagtcttcattcagtgggaaacaatgagtccctgactttgaaatctcagaggttacacatttgtggaatatgaaatcagtgtgttgatgatttttcctacctcatagaattctttaaaaataacactggagaattgctatgcaattctgtgaaaatttagttctctctagggccttttctagaaaaaacgttatgcccaaatcccaaaaggaactgagtattttatatcaatgctttctaagataaataaaaacagaacacacacacacacacacacacacacacacacacacacacacacacacacaacgcagcaacaacagcaaaagtcaataaaacaactcaccaaactaactctagagtttcagatggaaatgatgttatcagtccaaattaaagacatattctcttattttcttttacaccttggtttgtggcttccataatacaatcatctgagtcttgtatggtttctgaaatggatgctagaagagataacttgaatgagtacttttcccctggtggaattctcttcctcatctatatttaaacagttgttttgcacctaaagggccctaagttacgtttctctggagatatttagagataagaagtgttgtaagtactctttcacatttgtgcagaactttagtctttgaagtgtttagacatccattaatctttttttttttttttttttttttttgagacagggtttccctctgctgcccagactggaattcagcagtgcaatctcagctcactgcaacctttatctcctgggctcaagtgatcctccctcctcagcctcccaagtagctggcactacaggcctgcaccaccatgcctggctaatttttgtattttttgtagagacagggttttgccatgtcacccaggctggtctcaaacaatctacccacccttgcctccaaaagtgctgggattacagacgtgagccactgtgcccagcatccttaatctcattctacctcactttctgcctattgagagataggcaccccaagtaggaagtccaaatgctgataaagaaattgggattcagagtgacttactaactagccccagatcacacagcttattagaggcagattcagggctaaaggtcagattttccagctgcagatttattctgctttgagtggcattttagacattagtgttttctttaatccttaagcatttcagtgtctaaggtttgtataacatcaggttggtttctggtagtacgttgattgtggagagggcccagaagcagaaaccacagtctttacatgatagttactcttatctgaggtttggcctttattgaatggaagtctcttgttaaagaagggtatgcattgaggcaagagtcttgccaacttttcaaaaaaaaaatgggaacccctgggctccttggggatggctaatgacaatgattatggaggaggctgcaaatgtgaagtactttataaatcctggaggtgtggcagtagactgtgtgtttctggggagacagatttttgcatacattatcctctggacacttctgcctttggtgcatgcttgtttttataaaaaagcttgttttgttcctcctgtagaaatgagcctatcatctagagtcatggtggttttctgtatgtgtgagcttatgcttcagttacactgaacactcgtactactgcaaaatcgaattcagtgacattgccaatatcttcgctctcagtagtctttaaatattcttagccctgggaactggcccaagaaactgcttattcttttccctgtatcacttagcatataaatcctgaattactgctgactgaagatacataaagtacaaatcaataagtattttgtttctatattttggagaatgagacaatgagtgaaagagaacccctcaatgagggctttaaaatattgtcattgttctatggattagtagagctgcggctactattttacttacccactggccaccaggtactcacactgcagtgaaaggattcctaaaaacatctttattaagatattcacatactatacaatccacccatgcaaaatttaccattcgacgttgttggtatattattactttgtaaaaatcatggccctatgcacaacatacaacttgccactttaatcattcttaatgtacggttcggtggcactaattatgctcacagttttgtgcaactgtcactgctacctatttccaaaactttttcatcatcccaaacagaaactgtgtacttattaatcaacacctccccgtgaaagaatttttaaacataccttgattattagctttggatgtatataaaacctttaaggaagattttgtttagtctgttttttttcagggaaagtttattttttaaggggcagttccatacagtaggtgacacaggttaggttcctccagaaagcagcctcttatagtagcatgtgggacattgccagagtctcaggagcaacacttctaggggatgggggaagggatggagggaggactgggtaaaaggagaacgtgtactgtgttgtcattggaaggcctcaccctacccagtggaactctggaactggcatttcccaagttggggcaacagggatggatctttgtaccatatcattcagtcatagggttcagctcccaggacggcgcatgagcttggacaaattctctccagccaagggtcagagaaggttgacagctgagagctaagagccagcagctgaggggtgaaatgctcagtccatactttgccaaactttgctctccactggaatcacctttgcatcctcaaaaatactacgcctgatttaattggtatggggtaagagacaagtggaatgcttccaaagctccccaggaggtttgaatgggcaacacagattgggaatggctgctttcagtcttgaaggggagtcagcatagtatacatcatcatgggaaatgcctggactttggattgaaaaaaagttgaacttggctcaaccatttactgacgttgtagttcttatttatgttctgttaagattttgctactaggctttaaaaaatatgaatggatggtgcacctgggtggctgagagggcacttacaaattaaaacaaaaacagtgaacacctccagaatttgatagaacacaagaatgcataattcataaagaagaaattcaaatgctttttaacatttgaaaatatagtcttaatagcaactgaaagaatgaaagttaaaactatattttgcttattatattagcaaagatgaaaaataattgctattgctcagtaatggtgaaggtagtggcagaagacactctcaagctcagcacagtggttcatgcctgtaatcccaacattttgggaggccaaggtgggtggatttcttgagctcaggagttcaagaccagcctgggcaacatggtaaaaccctgtctctacaaaaattagccaggcatggtggcatacacctgtggtcccagctactcaggtggctgaggtgagagaatcacttgacccccaggaggtggagcttgcagtgagctgagatcatgccactgcactccagcctgggtgacagagcaagaccctgtctcaaagtaaataaataaataaataaaacaaacataaaagaaggcattctgatcctcttggtatgtccattggtgtaacacgaatggtggaccatttggcctccattcatgtgtctaccaatgcaatgtagataaaaattcataaaaagcgaatgccttttgacataacaaatctaattctagaagtttatcctgaggaaataacagaagagtatgtaaaaatgtgtgcataagttgtaattgcctgggtcttgctggcaattaggagaagcacaaatggtcattaataaaatattggttaaataagttctggtacatacctatgtacttctaatgagagaagccattaataaaatagtgtgagcctatttttgcattaaaacatttgcattgaaaaatgactttgagaaaaatatcagatgttaatggtaaacagtgtttttccccctgagtataagaattatgggtgaattttattgtctaactcatatctctttataatatttatacttagaaagtattacatgttatttaattatgtgttaattttatattcataaagagcatagagctatttccaaaaattacatatttccaagattacacacctgcatatctctatctatctatctatctatctatctatatctccctattcattcagcaacctaaaatgaaacagcctataatccaattagtagttatccctagaatttgaggtcacgggtgatttttattttctttcttgtgcttatttatactttacagatttttataatgagatcatatctctcttataatgagaaatgttttaaaaaagcttttaatatctcagtgcacttgcctgacctattttatatccattcttgcatctatttcatttgaagggtcctttggatagcatttctttctccatgtctttcttcctgctgtcctatttaaataatcacaattctgtgttgaaatttttgtatgctttacctaattaggacaaatattctgactcttgcatttgttatcaagatgtacatttttactttattcattattgttttttttttcttaagcaaagtttggcctttagatgatgcatttccaagcctagcatccatcatctaccattatgcttttgactcatctattaaatagtaatgtgtcctccaaaaatattgatgttaaattaaatgactctatatttgtccttggaaaaagctttgaggctataaaatttaccaagcaggtaggacatgcaaaaagagaaatgcatgcaaatgcttcctataggcaggagctcttcaatgtgtctgacaaatctcatctatcctttaggtcctaaattaaacatcacttctctgtgatgcccaccttgactttcccagggtaagctggtgctgacttctccttatgtttattatgcctcttattaaatcttattttaagtagttattgatgtctaccaatgcattagaccaccagataggaaatatggttgccatccaccaacactcttccaacagtccctacctcctcatattcaagcccctgacaaatagatgatgacagacgcgaccatatgtcacttccaagattaggttttgaaagacagaggtttccgtgttgggctgtttctcttggcccactaacctatggaaagctagctgttgtgacgataggcaatgtatgcagagaggctcatgtggcaagagctaataaaaaatggaagctggccacacacatgtgagtgagctttgaagcagatcctcccccttgtcaagccttcaggtattacaggcctggccatcagcttgattgcaaactcataagaaactctgagtcaaaaccgtccgtctaaatggctcccaattcctgaccttcagaaaatacgtgaaacaataaattcttgttgttttcagttttgagttttaggatagtttattatgcatcagtagataactaatccacattggtactagaggtgcagtgcttatgtaacaagaaactaaaatgtgataggactttgaacgaggcagcgggctgtggaaaagctgtaaggattaaggaccatgttagtaaaagtgtaaagtgccttgaacacactgtccatagaagtttggactttgaggaggctgccattgaaggcttcaaggaaaatgggagaaatcctattggaaactggaaaacagagaatctttgttacgtagtggcaaaaaaaagaaagaaaaattaacaacactgtcacctgcagtaatgtagaaagtagaaaatgtgcctgataaactggtgatatagttaaggagatttctaaccagagtgctgaaagtgctttctgattttttttttttcctgttgcttagagtaaaactgcaagaagagaggagaaactgaaggtaaaactattaaataaaaaagagccaggacttgctggttttaaagattcccagcctccccacatggtacgtgatgctaaaattaagaaatggcatctgagcaaagaccaaattcagggcacttttaggaaaacaaggtccaaacattaagccaaggatgcgactataaagtcttttcttaacatctcagtaaacaaagatagtgtctcagaatactgtttagtcagaaaaacctaaagatactaagacaagcttgtccaacccttggcccgccggctgcgtgcaacccaggatggctttgaacgtggcccaacacaaatttgtaaactttctcaaaacattatgcgtggacctttatttttatttttattttttagctcatcagctattgttagtatattttatgtgcggaccaagacagttcttcttcctatgtatctcagggaagccaaaagattagacacccttggacgaagggcttgccttacagatcctctctatcaaccagtagtgctccctggaagctcacagacattgtacctcagtccaagctcaagaaggacctgtttcaaagagatttgtgggtgtggcttttgtgtagtggaattaagcctaaagggattcccagaagacccatggagttgaaagggggttgtgcttgaagaaacaccatcagctggaaagaaaagagacataaagagtacaaaatgcagagaggcctttggaccaccaagtgtcaacaagtaaaaagcagactgagaaaactaactccccaagcacatgttacctttcatgaaaatgaaaggatgcctgagagggcacactcaagatttcaaagggtgagactaaagccatagagaaatattcctaggccttaattagagaccaaatcaaggagcttccatcatttgcttgcctggatttcagaactactatccttgcatacttcccattttcccctttgtgagttggagtgtctatggcagttatcctctccttatcctgcccttgcatgttgggtgcatggggccagataacttgtttctttatttgcacatgcctctatatcaagaagaaccacattcaattgttgtatgtcagagactacacccaagaaggctgatttagatgatgagggtctggacttggaactgatgctctgttgggatgagacttttggggacagtaggaggggtgggagtccttgggagccaaagggtgtcctgtgttaggcagcctccaagatggctccctttgatctctgactcctggactcacagagttgttaatcccctccccatcccacattgtactagggttggcctgtgtgaccaattgcaaatggcataagtgatggtatgtcgctctcaatattagtttattaaagactgaagcttccattttggtcctgctctaatcccgtgctttcctggatccctcacggtggggaaagccagctgccataagttgaggacattcaggcagtctggtggaggcccacatggtgaagcagttccagccaatagccatgtgaccctctagttccaatcaaggcttcagatgatgcagaccagattgacagtttgactgtaacctcatgagatactatgtagaaaaaaactgctgtaggccttagacttctgtacttacaaagacttcttgcaaaattggcttggctggcatccaggaatttggatttaggggaggcctgacaccatttcctaatggataagagtggttcactgtgcctaaactgtaaacaatattatttatgctgagcacttgctttccatatgggagtcttggatttttatatgtgctaggcagagggtgtgtaatgagcaaccctcagtaaaaaccttgggccaggagtgctggcttacgcctataatcccagtgactcaggaggctgaggcaggagggtagcttgaggctgggagttcaagaacaacctgggcaacagagcaagatgccatttctgaaaacagaaaattagccacgcatggtagtgtgcacctgtagtcctagatactcgggaagctgaagtgggaagattgagcccaggaagtcaaggctgcagtgagccattaactgtgccactgaactcccgcctaggtgacagagtgagaccccccaccccaaactctaaaaaaaaacagacaaaaacattgagcactaagtctgtgataagcttccctggtagacagcattttccacttgtcacaatacgatgctggaggaattaagcccatgctgtgtgattccacagcgagagaactcttggaaacttgcatttggttccttgtctggcaaagagaaaaggtgctgattttgctttatattcttttgctataataaatcctagctatgaataatattatatgagtcctgtgaatcctcttagccatcactgaatctgggggtggtcttgaggacctccaacccagagctcctgagctaggagcacctagatcttcctagaccctcagaaaccataggataataaatatttgttatgttgaggcactgagttttggagtagtttgcttcacagcaataggtaactaattctggaagccagtcatttctctcttcccagcatttagtttagtgtcttggaacataggtgttaaagaaatatttgttgagtgacttgacactatttctgcctttgaagaagttcatagtccatttggttcctttgctggaggaatctaaatcctggcttggtattatgaagcaggcttactctcttttttctgtggcctagaagaatcaatcgcagtggcagcagcctgccttaacgttgtcaggttctgccatcttccctgttgaatgagatccatgggtataagaattagtgtatgaccatgcctcttctcttttactcacttcttaggtcctttgatttttattttctctcccttctatgtcatggcagtggtagctattcttactattgaaataaaaacttcttcctgctgaaaaattaattaccaaatgtttcagggccttataagatattaatatttccatatcgagtcttgcctcttactctatcatatgattgccttgaggaaagttcagacaaattaactttccattttacattgcaccccactttcccagcttctgcaaactgtcttgaaatagactttatagaaagataggaaccatttccactaaaatgagtttaatgtagggaaaaaactcaaagtatacactgaaagtagacttctttgagtcatttacagttaaaaattattttaatctaaaggtgtatttgagtgtgtgcacaggtatacacatagaccgccccccaccccatactcattcctgtggcacacttcttgctagttgttggcactgttaaataaaaattacagggggccatcgttttggactaagcttctgcacttggccccaacaaaccagattgaaaatcaaaatggagtcactcatgctaaagttccatgtcaccttccaataaatcaggggaggaagataacaatctaattttccaaacagggcagtttcaatcttcaatcagcctgatgaagttctctctgctttaatccttacaacaaaaagtaacctgaaggaacgtgatgttaactagatatttttttctctattgttctgttttcctgttcctggattacaaagaaagtaactatgcaatgaccaattgcttttgttctgtgtttctgctttctctagcccttttctgcttacaaagccaaccatctctgcccactcattgcagcacttattaatggcaaaaccgcaatacttttgcaccaaaatatttaatggaatgaagtgttgttctattctaaaattgcaaataaagctacttgagctcctgaaagtaaatttgttgtaattttgtcctttgacagatccttttcctcctctttgagtctccttccggttcagcagatgaccttggttatgagtttcatgagaatcccagggtgatctaatagaagctctctcatttatcttctttccatctaattttttacaatttttattgttttttcttgtgtcagagaatcatctacctttgtttcaaagggttctagtcctgctttcaatcccatatacttgggcctgatggatctttcgaaagtgaaattgtggcctcatgatggcatcatttgaaagcctccgatgactgtttcccgaggagggtgaactttctctccttacctgctcttgctttcctgcctccattttgctcatggcattcccttgaattaggttctatgagtggaatacagctttgaaggcaattccagagatccaacaaaaacccaggagattggaaggaattcatatttgtcaaaaaatgtgtagctcaaaaatataaaaaaaaaaaataatgcaaataaaacccaatagagtataacaactatttacatagcatttatattgtattaggtattataactgatctacagatgatttaaagtatagaggagggtggcataggttatatgaaaatactacaccactttatattaatataagagacttgagcatctgcagattttggtatcctctgggggggtactggaggcaatcttcctgggatactgaggggtgactgtaacttattttcagtactttggtaatagtgtatttaacggtctattgtttctcagggtttgtggatgatagtccattaggatctgaaaataagatattagaagttctatttacttttttttgtttttctgaaattttaagtgtatatgaagttaagggaatacatgtaattttgaaataattaaatattcatgtttggaaatctgttcaaatttttgggtggctgggaacacaaccaaaaagatatgaaaaccaataacaattatgtatcagtaggcattttataaatagtctttgatattattttggatataagtgatttgattggcacttctcatttaattgcttattaggtgggtttctgttttgtagagaacatttaaaaaaaatttagacaagcaaaagttaataaaatcacctgtggtatgaccactcagaggtaagtataatgaatgttttattgtatcttctttgcagctagttttctatacacatagacatgattttcttctaaaaaaggaaagatcatgatgtatttataatttgtaaaacttttataccttgctctttgaactttaaagaatgtcatgaacatttccttagatactaaactctttccccatatattttaatggccttattatatgaacatataaaaataatttattttgataccttaattcatgtgctgttggatttttaggctcttgcaccattttccccacttctctgcttgctgttataaacagttctgaaaaccagatgctgttagccacaccatacatatctgtgatgtttcctgacaagattcctaaaagtagcaccttcctttcataggtgaggttttacctctacctttgttgtctgtctctaaggcaaaggcaattttgtgtaatggtgaagaactcaggacagaatttgaattgtgcctcaaccagttactactgtgtgactctgggctagttgtgaacctctctattcctcatttcccctcatctgtaaactgggggaaacactaataccaacattgctgggtggttgtgagcaaacaataaacaaataatagtgtaagcaaacaataaattttagcaattgtttataaggtatttctcttgtcaagtaagccaagttaatcatctaatggctcctataaaataaagcatagggccaggtgcagtggctcatgcttgtaatcccagcactttgggaggctgacgtgggcggatcacctgaggtcaggagtttgagaccagcctgaccaacatggtgaaaccccatctctactaaaaatacaaaaattagctgggtgtggtggtacgtgcctgtaatgccaactactcgggaggttgaggcaggagaatctcttgaacctgggaggtgggggttgcagtgagccaagatcacgccactgcactccagcctaggtgacagaacaagactccgtctccaaaaaaaaaaaaaaaaaaaaaaacaacaacaaccataaaataaagcatagttatagtattcagtaaggtgaatgacacattaatgactccattttccatttgatcagttcttacatccaggaaccatgaacacagctatctcaacatatggtagtttatagggatagtctgtaatcttgcaaatttaaaaggtaaataggagtccttcagtaggcagattcatatattgacaaatgaaggaagaattagtcttgttagaagaaacttgccatttcgtttgtgaacaatgtagttaatttatcacaggctcagtgagggcaaggatggagctatttcactttactatttgtgtacagatccagctcttgggccgtggtaggcactcagtgaatatttgtgaaatacataaatattcatgagcaaatatatctatactttgttgaatgtattgcaatgtatgttgtaaacataatgaaggctttgtgtgatgaaccgacaattgacaatgaaattattgtctgcaaagtgggctggggccttcaggcttttctcctgattatagattcagaaataatgcaagaggctgttgctcaaagtgaatcccttactccgtgctggtcgtgttctttaattcatgtgctgttcccttgtgtgtgctcagtccttattgcagctgctgggtctgagctcactgtgaaaatcgtgtttcctttctgccgacccatagggctcagtgtttgattaataagtttcccattttctgagaaaaatacctaggtaaatcccccttggacagcacaaggatctgcagtaatttacaaccaccgtgtgagccttgtgttgaatgacatgctctttgtaaggatatggcataatttataatgctggccccaacgtccactcctagggcgttctcagtgcagtgccttgactctgatattggataatgttgacagttaagagaggaatgactttagttgctgctgctgaattaaaaaagtcagacacacagtctaaatggattttgctgtcttcaaagtagtgaccttgggatagatagaactctttgatgcttccattgatgttgctattgccccaaacatttccggaatcctttaaaaattacctttaaagcatgtggcacattcttgtgaatatttttgagtctaacaaatactcattctttgtatgaggctttgatttttggaaagagtgaagagtcactggcatcaagtgcaacaactgaggtgggtgatgagggcagagagtgctggttttgtttagggcaacatatggttttagaggccttttaataatgtcatgagacttgagcatttgttctaaacatgatttccttttaaaataatgtttgaaatgatgaaatagtccaagcctacagaacacaacattacatgccagataggcacgttcccagcatggatgttaaacagatgttaacgtgctgtgtttgtttgcgtgtgttctttcatcttgctctccttccctgttttttctttgaaagacagtgttttagatattcctaaacaccccccgcttccctccatacccgtctgccttctcccctttttccatcaatattcatacttctgccaatgttgccatgcttcattcccaggtgtgcttgtaccttttgaggaaatgtttagaaatttaaaggaattatcttgtgtgtgtccttctaacattgtctttgaggtttatccatgttgatttgttttaactgctgttttagtccatttgtgttgctataaaggaatacccgagactgggtaattaataaagaaaagaagttcatttggttcctggttcttcaggctgtacaggaagcatggtgccagcatctgcttctgctgagggctcccagctgcttccactcatggaggaaggtgaggggaaaccagtgtgagcagatcacatttcaggaggggaggagagaaagagagagaaagggaggtgccaggctcctttcaacaaccagctcttgagggaactagtggagtgaattaactcattactgcaagggcagcaccaagccattcatgaggaatccgccattatggcccaaacacctcccatcagttccaacctccaacattggggatcaaatttcaacatgagatttggagaggacaagcaaaccaaactatagcaactgctccataggattccagtatatacgaataaatcaagagtcttcatctgttcacctgagagaaagttcagatgctttcaccttttttgttattacaaatagtgatacagtagtaactgtgtgcatatctatctagaaatatgtactagaggttgtctagagccagtactcagaggaaaaatggctaggttctagaacgtgcacattttaacttagtggacattaccaaattgctctccaaagcagttgtaattatgcttccattggtggtttcccatatcctcttagttatcagatttttaatttttgctaatccgattggcacagaattgtatctcattgttttatattgcatttctctgcgttctagtgtgattgagtgtctcttctgtactcagtggccgtctgagtttcgtcttttgtgaattgcccatttatattccttgctagtccttctattgccattggcctttttattaatgatttataagaatcatttataatctagtattctttgtcagtttaatgggccccaaatatctttactactctgtggcttatgttttgactttttatgatgtctctaattaaacagccgtgctaaattttaatgtaatcatatttatccatttctcctttgtggcttgtacttttttatgtgtttttaaaaagaaatactgctctatcccaatgtcataagaataatttcctatacattcttttaaagttttcaaatgtagtgtttcacagacacttagaattgatttttgtgtatatgtaacattggaatccacttttatctttttccatatggatgtccagttgtctcagttacatgtatcaaatcttttcccactgtcatacaccacattcccaaacacgtgtgactgtgtgtggcttctgttctttattttatttttatgtttatttttattttttgaaacggagtctcgcactgttccccaggctggagtgcagtggcttgatctcagctcactgcaagtgctgcctcgcgggttcacgccattctcctgcctcagcctccagagtagctgggactacaggtgcctgccaccacgcccggctaattttttgtatttttagtagagatggggtttcaccgtgttagccaggattgtctcaatctcctgacctcgtgatccgccctcctcggcctcccaaaatgctggaattacaggcgtgagccaccgcgcccgactgttctttgttaatggtgtgtttgcttactctggctctaccctattttaattaccttggtcttataggtttgggtagtttaagtttcacttcagttttcttttttggaattttttttggctattctaagctcattatactttaaactgtattttaggaatgtggaagccctattgggcttttgttggaattactcagatggtttacagataaatcgtaagaatttgctctcttatcctgggtcttctcatctacaactatggtatagctatgtttatttagttctctttttaggtctttcagtagaattttgtaatttttgccatacttttcttacatatctttgttaaatgtctttgtaagtatctcatttctttctttcatttgttcctttttttgagataagatctcccaggctggagtgcagtggtacaatcatagctaactgcagcctcaaccctcctgggctcaagtgacccttgtgccacagcttctttctaagtagctgtgactacaggtgctcaccaccacatccagctgatttaaatttttttatcccacattttttgttgctgtcaatgatatctttttattgtatcttttcctattattgctggtgtataggaatgttatttttgtatatcttgctgaactcattaattttcatggtttagatactcatacattatgcagacagataaaatcttttaataataatgacaggtcttttccttttcatgttatgtggcattcacttctttttcttgtcttgatgtactgacttggactttcatgatatcacctgtttttgttaataaagttttattgaaacacagccacatccatgttgtctgtggtaccattgtattataacatcagagttgaatagttgcaacagagactacctagtttgcaaagcctaaatacctgccttcaggctctttacagaaagtttgcctatcttcacaaaacagggttgaacagaggcagtgatagtaacctttcttgtctcatccctggctttaaaaggagagcttgtgccaccaagaataagtgctgcttctgggttggttgatgtgtgccttttattgggttaagaaaatgtcttttttttttcttcaacttttattttaagttccagggtacatgtgcaggatgtgcaggtttgttatataggtaaatgtgtgccatggtggtttgctgcacacatcatcctatcgcctaggtattatgcccagcatccattagctattcttcctgatgctaccccacacctcacaggccccagtatgtgttgcttcctcccatgtgtccatgtattctcattgttcagctcccacttataagtgagaaaatacagtgtttggttttcttttcttgtgttagtctgctgaggatgacggcttccagctccatccatgtccctgcaaaggacatgatctcattcctttttatggctgcatagtattccatggtgtatatgtaccacacaagaaaatgtctttcttagatttgtaggaagtcttttcttgtttgttttgttattaaaaaaaatcatgattgaatgttgaattttatcaaatgtagttttggcatctgattattttttctctcattttaaacatacgcaattatattcttttgaatttttctattatttctagtccttggggctagaatccgcccctttgatgtgcttttataacttgtgatctcagtgggtctcattttttctgtaggaattgtctgcagcatggattgtgggaattttgctctggcattttccctgcccattcattagtccaggaccaatttttatgtgaatttctcagattgggcatttccggaccatataggaagcctaaatttgtaccgccaaaatgttccagaggcggtggtctggagtttaaactttgcaagggaaggcttttattctcctcccttggagacagacagaaacatacgagtctctttgtggttgcagctctttgaggagcctcactcagggcagcagccttctacctcgggcagagcccacagactttgcctgtttctcctctgtgctagttgaaatctaaatgcctactccccctggaccaatacttgtttctctccttctccctcaccatgatcctgtcactctctaaggggagtgaatttatgcttgcttctggttttagttgttgctttgtttctggcacctggtaatttcttctttcttattgcaggttcagctatgaatttaaaaatatatataatatttccaggtgcttgtaggaggtgagtgtgaatgtgtgtcttctcaccctcttgctgaaatgagaggctgccctctaaatgaaatttcaatattgaaaagataaaacccaaataaaacaaaaagcaaccccccaaatcagctccctaaccatgagccaggcagcacgtgaagtcctttgatattagctcatgccattcttatagaaactctgtaactctttttaagtggagaagttaagaaactggcccaatcccatgtcagggcagagccaggccaaaaacccctctgttttattggctgttacctcattttacatgtctgaacagtaataacagtgggtgtcaagtgtacctttcctaaaggtaactactacaaaggtcaacactattttccatctaacactcctaatatatttttacacattagtctcacctggtaattctaagatagaataatgatcatgcttgtctgtgagaattagcaatttttttcatggatttaagttcaagaaaaatcagaaattagcagttcaggagttttcaacatttgtaaaaaggcagatgggtgcaccattagcacttccttctgagtgaggtagatctccagggaattaataggaacccgttgttttccatgttggcaagatattagagaaatatgtcttactctcaggtttactaagacatgttttaaagataatactgtcatgcatgtggcttatggaaggctatagggatgtggatttttatattctctctagatttatttgcccatactctgaaatcaaggcagacggtaaaggtggagtcagtggtcattctgtttttttgattaggggtttatagatggctgacattttaatctcagttaatgactggggatggactccagggtccttcaccacagctcacccttgtttgtgatctaatttagcagcatcttgatttgaattgaaagacagccttgggaatattagctcggcccttgtgagagcattctggaatgctgcatattacctgatgctacctgagatgtaggtggttgggcagtgacagcctctctgagccctgacctgtcggggagaggttgagaagtggcaaaactttgattctaccagctgcaaagaccgatgtcaccatgaagttatattaatgactttgacaagaattttctcagtgtacagtaggcatatttgctgaatgagctgatcttgtaatcccagtatatctggagtagtcaattatgaattttctaattagcttgatgtttggtctcccagctaagtgagctcttgtgaactctgccagaatctggatttccaaattatctgacaggaggaaaggaaaggattgggccaaagtggccattgcaagtcagtttcttataagtcaaaaatttaatcagaccaagtgcctttcttttctgtgttcagaaaatacccattctttgtttctcacaactgttaacctgtcctaggatgaactggttctgcctccctttgctgtttcctgcattagtacttggaaaagcctgtggctgcatggtctgaggtgtgaccttcatggtgggcacaccttgtctctcttctctgcccgaaaggaggccactgttttcttgtctctgtaactgctctgtgaattcttcttcttcctgatgactaagtgtgactattctccaaggtctttatctttttgcaagttttctgagatcttcaccaataagcacgaatacttactgaatatgttttgtgtgccaggcactttttaaagcactttaataacaataactaatgtttattaagcatctactgtgtgccaggcactgcttttggtacaaaagatgtgaaataaaccacacaaagaccatccctcttggaacctatgttttattgagatccagccaggtggtagaacacatcagtaaacaaacatagacttcagcaggtggtgacatgtgctctgaaggagaaatggagtccgagtagagagtgactatgcatgatgaactggtcaaggaaagtctgtctgataagggggtatttgagaagagcacttctccaaggaagtggaggagcaagcccagtttgcttccaatttcttcctccttgtgtcttgccaactgggaccaagcatgcctggcgtggaacaaactctttctgttctctgctgatggagccattttctcccagagcccaggctctaggtctgaaccctgatccttctcttcacttttcttttctaatggccagacgtctttgtccttcctttgaaatagaagtgacagcaaaatcttctttcccacagccgttgtggataggaagcctctgcctggctgagcactttgctactttatttctgaattcctgtgccagcctcctcaatgatcttagctgctagtcttgctcttctcacccatctgtggccaccaaagcactggaacacgtaagccatcatttgagtgcttactccataccacacactggatcctcacaacttgctgatgctattacaatatgttttttttcttttttcctttttctaactttttttttttttttttttttgagatggcgtttcgctcttgtcacctgggctggagtgcaatggcacgatctcagctcactgcaagctctgcctcctaggttcaagcaattctcctgcctcagcctcccgagtagctggaattacaggcgcctgccaccacacctggcttatttttttttgtatttttatagagacggggtttcaccatgttggccaggctggtctcgaactcctgacctcaggtgagccaccctcctcggcctcccatagtgctgggattacaggtgtgggccactgcgcctggccttttttttttaaagttttatttaggttcaggggtacatgtgaaggtttgctatgtaggtaagctcatgtcatggggagttgttgtacagattatttcatcagccaggtgtattaagcctagtacccaataattattttttctgctcctctccttctgccacccccaccctcaagtagaccccagtgtctgctgtttctttttgttcataagttcttatcatttagctcccacttataagagagaacatgcggtatttggttttctgttcctgtgttagtttgctaaggaaaatagcctccagctccatccatgttcccacaagagacatgatcttgttattttttatggctgcatagtatttcatgatatatacgtaccacattttctttacccggtctgtcattaatgggcatttagattgactccaccatgtctttgctattgtgaagagtgctgcagtgaacattcatgtgcatgtgtgtttgtggtagaatgatttctattcctctggctgtatacccagcagtgggattgctgggtcgaatgatagttctgcttttagctctctgaggaattgccatactgctttccacaatggttgaactaatttgtttttcttttacaaagttttttttcaagactagtcaagtacactagtgagaagggagaaaaaagtagagcaaggagtttgatctgtaactgactgaacaatcaatggagatacctcttacctttggaccagttgctattacaattatgattcccattttgcagagaaggaaacagactttcctatggtcacttgctaatacaggaggtggctaagccaggatttgaactcaggtccaatggaatccacaggctccttccagccaccagaccaagcttcacataccctgctgtggagcaccatggagaccctggttcgctctttcactctttggctggctcaggattctttcatgcttcctattatcagtgggataaaagtccaaatgttctggaataatatttgagatctttcatgcctggaccgtacttcacctgtcttctggttttgtatctgagctccctcctgtaacaacctttgctgaacatactcaaatgtatcatggaggtaaacacagcgatgcctacgtttatacagtgagtgctttttctttccctttacctgaactcactctttcttcatgccccagctcagactccacctcctctcttaccttcgtctgtgttcatctatacttccaaactctcctgtcagttagaaggcgtgtcctgcctgtttcatgtcattcctaacatcagaggacatagctcttaaagatcttattaccaacttgccatttccatgaatttccttagcccttgatcctaaactattgagaaagcttacatatccaaaatgagtctaacttttctaagcaatggtcttgggagatgtacatatttcactagggcttcctggagctggaaatatatttggtggagctcctttttctaaattgccttccggctacccaagaaagtcaatttccttctttaatagctgtgactcatttttggactgatgatggcactattccagttcagtcacctatctgagtcatcagtagggactccatttaaaatttgactctttccctaaattgaatcaattctcaagggattaaaactagatattcactagaacattccccaggaaaatttagaaatcagagttctgaaaatgtttgctcaaaatgtcaaggggtgaaactgagagaaggcaactggaacgtttctcttaatccactgtccctcacttacctgcttggcagaaagaaggcgggggaaggaaagcattagaataaaaagagaaatgttcagaggcagtttgagtcatgaggaaacagctaaaacttccaaaacagaaactgaatgacatcctcttcctaattcaagccttcctcaggggaaaattgaacagaacatttcacttgataaatggaatgagacctggtcctggagtatttggaaagatgaatgacaggcaggaggaatacagtggaagggaatgccatttatttacaaatgcatctcctcaggtaagggaggggatttcacagagagagggaggtggaaccgcagagggcttggtccaagttagaacatgaacttactccttgctctcgtttctgggggagaaagccatgtatacctccagcactcagaagtgctcgcgacaatgagctcattgggatttgctactcaattagattctgctttgtacatgtagcacttagcactgtgtctagcacataacgaggactcggtaaatatttgttgaatgaatgaaaaataattgctgcctgggagaagttgagaggctttgtaattctgccctgtcatttctggtagtgaccaccaggtggtgccttcttaagaacaggaggaaataaaatcactccagtgaacacagaaggcttggggttgactcagaaccttgcccctgtgcacaccgtctaacagtacatcacaatttcttgttcctaacgttgaatgtgcacacaggattcagatacgtggctggcactgactttctttacttgagtcaaggtcaagtaaggttttcatcgttggctgagctctgggatttaaaaccagttctatcccaggccaagtgggtttctgttgttcctgcttatcccctgtcctccaggagaacacatgctgcccttgcttccatattttctcagaaattcgtccccagcatcactaatggattcatatccagctcttgcactcacgggttgaaaaacttggtacccctgtgtattttaagcagctacctgatgagtacctatgttgaaataggtttctgtggtcgaaattctcagaaaagtcccacaagatgggcataaatgaacaaactagctcagcaggcttaggtggctctcccaaagtaacacagataagtgagttggcagagaggattccagcccaggacagtctgcccttaggttgtgctgtgatctctattctgttttatgtggagtgagtttaatgtatctgcattaacgagatccagggacaaaaatataacaaaattcaaggaatgtgaagcaatgtcctatagaaggaggacagttcactatcagtgtgagccaacacactcagctcttggcagttttcagacagttgcaaagaaatacttagcctgaggcttcttcgtgcccataaacctaattaagggtactagagattctgattggcaagagctagggacagagaggctgagtgagactatacgtgtccctatgtttctgtatataaagacagaaagagggagtttgagagagcgaatgagttaaatcctaagtagacctggaaaactatcattttgctaggactggacttaagcaaaacagcagagcaaagttcagagttaagccagaactttgccttgaacctcaggcccattgagccctctgctccaacagggccaaatcagcatccaatagtccccttcaagttgtatctgtcccgtgtctcggtgtttctggtttctgttatttggtaggtcacaattaattatacagggttaacaaaaatagattaacataatgtacttgccgaatagtgtttctttgggagaaaatgacttaactcacctaaaatatctccaggcataaaagatattaatgttgggaatatcaggagtgattaacctctgagagaggttgaagggaagcaaaattggacaggaaggataggaggaatggagataggggatttcgggtggggagagcctcttagagtcttttatttcagaccttactctgtgcctttccatagggccaagtctgatcatcctctttttatggtctgaatatctttgagcccttcagaaactttcaaattagtaatatacatgattaatatttttgacacttacatgttaggaactagacattatttcagtaatcctcagaggagccttgagtggtagatgctatcattcttccccctttcttttaaataatgaaatagaggtttaggaagacccaaagctagttgatgtcagagccaagatccaaagcccatgtgtggttataaagccgtgttcttaccactatattatgctgtaagaataaagggacaaacctcaaaataaaagctttcactatcagtaacacagcaaaaaacaattattcattcaataatgagcaggatgaataaaaacagacaaacctcatcacatgaagttgaacttcagagaatagtcgaataaaaagttccctcaaacttaggagaaacctaaggctatgaaactgattgtttcatagccttggtaataagtagccatcaggggccgggcatggtggctcacacctgtaatcccagcactttgggaggccaaggcaggtgaatcacctgaggtcaggagttcgagactagcctggctaacatggtgaaaccctgtctctgttaaaaatatgaaaattagccgggcatggtggcacatgtctgtaatcccagctactgaggaggctgaggcagaagaatcgcttgaacccaggaggcagaggttgcagtgagctgagattgtgccactgcactctagcctgggtgacagacagagactccatctcaaaaagaaaaaaaaaagtagccatcagaacccatttaaaatctgttcatttggtcaacaacaacttgtcttagtgaaagttggttttaaaactggcagaactgaccagtgtcaaatccttacttcagcccatcagggatgcagtttccagtaaacatctctctgagtgccagccaatcaaagaatcaattacagcctcagctgagcacccacgtgctgtcaacccacgtgtgcctctgaacatctcacaaccacagagctccatgctttcaaagccctctaagccatcagccatctgtcctgctcacagacactgtttggccagcatagctctcttctgtgatgagcaatgtattcagccttggagttctgtgtcagatactaagtggtgatctcattgttatttgaaaaaacaagcacacatcagtatgtatgtagtgtatggctacagagacaatagcacaggtaagaggttgggtagggcaggtgctagggggggctactttggatgggaagctcaggagagcctctttgtgggtgcaaggtttatgaagagacctatatgatttgagaagagtccagacattcacagatctaggcctggggcttccaaaaagaaggaaaggtcttaaggtaggagaggatgcctgcgtgtctggggaaggagtagaagaggaggctggagaggaaatgggtggaggctgatccttcagggccttgtgggtcatggcatggtcaggatttgggattttgcttcaagtccaacggggaggcaggaaaccacccagggaaggactatgtcctctgctttaagagagagagagagagagtgtgtgtgtgtgcatgtgtgtataatatacacttgcacatatgtgcatattgaaagaaaggggatggaggcttagggtcaggagtgcctcttagagtctcttactttataccttactgtatatctataaatgcacatacatgcatatatacacacaagttttgcagttaggttcaaagatcctgtagatctagaagaatgtctatgacattgacaatgtgagtcagtacaccctccactgtgtgctaccaaatctgcccaccctcttccactgggagtcccataaatgaagtggttttactaccctgttgtagcccagtgacagatgatcagtgatgtcaaaagcgtgattctggagaggttggtcactttgttgcaaagctgctgtatcatttcaggtacatagtctgggaggtacagagtctagggtcagagtagagtctcaagccattgtgcatgcctgcccaagacagagtggagttggtctactcctgaatatattaaccattttttcccttagtcattacatgtaaagcttcatgtctgcatttgtcagttatgatttatccggatcacctttcttacagaaagcggtagatgccaaccagaagactggaataggcttccttttatctcttttgcacagttgtgtcttcggtgagatgacttgactctctgatgttgagagtgtttttgttaatttttgaagcatgatctcagttggtttaggatatgaatgccatacacactcattgttttcgtttggggactgccgctgtgctgggtgactgcgtgtttgtgctgctggcccttgctgacactgatattggatttacaaagccaaccttgcagttttgtgtgggcaggtaggctgcctttaatttgtggttgctttgcccttctgaaaacacgaacttctatctggttggaagtcattttctttttcatcaatctcaactactgaacctatttcttcaggcacatctccagactgccttggatatttcgaggatatgttctgcgtgttcacatttgaactgcagcttggtttgcagacaccctctccttagattggcagctgtttgtggaattcctgagtaccaattacatccagtagcaggaaataaaagacaaacaaggaactagtagagctcaaggtattctttcatccttcctccttcttagctaatacatcttacagttagctctgaaaggagaatttatttaaacatactaaacactgtgcatagtgactcttacatcttttctggtaatagcatgctaatgctatacttcaaagtgcagtgaataagccctgtagagaaatatcctcatggtatggtttcaaaggacaggcatccttctggaacatattgttatcttaggtttttgttttaaatgtcagcacatggagaccttattctaaggctgcgtctgtgctccgctagtgagtatggaaggcttaggtgattcatggtgggaagttgaagtaactagagaagacttggtgctgtttggctttagtgaaatttttagaagctgtagttgaaaaaccaacacagattggccctctgtttgttgcttttggctgtctagggactgcaaagtaaaaaatgacattttcttgatgtctttctgacagtttctcacctgtaggtcaagtcctaattgaaatatgacataaatatttggcgtcataaaagcagaatctccataacacattaggtgatttctagagtaatgctcacttttattgtttgggttccattgatgagttaggcagggttatattttaagaattttcttacatcaggaagagtcaacagaggatggataacatattttgaacgtggacattgcttgtaagttgcaggacacttgtaaacactattgagtgtcacctatagcaggaaccagtttttctttatccctcgttctgtgacagctacctgggttctatgttggagccccgtagtatagtttcaaatgcaatagccactgcataatccttgtcacccaaagactgcagatcttgacagaacttgtacaacagtggccttgctgaggagtgatgtacatttcttttgtcatttggccacataagaaaactgcagccatcactgtattttgatgcatcagactctgtgtcctctgagtgtgattcagctgttggatttcttgattatgaaagtatctagagtacctcatgttcagtgatgtgaactgctatgaaagttccctccgtgtattctgctggatttcttaagttatatcttcacagagagggcttgcctcttatacagtctgcatccagcacccataagtactttcctttgctgcaggagcaggaactgaacccaactgtggatggagtgggaatgtgtgttctgattcctgcttattagcggtaggatgtgataaatatgttccaaagcaatgcctggtagaagtgttcccctacctgcatgtgacaagaagcattttcctcccttcatttggatagaggaagggctttggataaggaaaaaaaataaagaagatcttggaccttaagctggagacaggaaggtcaagtgctttattttttctgtgatgagaaccagctcatttgagaactgaaggtgaatactgactgtcatatttaataagtagtgatggaatttgcatttcttccttgaggtcagtagtctgctttcatagatagaacaggagtttaaattctgagcaaaatatgcaatcttttctctttctttgattcttatcctgtcaattatctcgtcattctacagaggactaaaaggtaaagagttctaagatcttcgcattgtctgggaagaagtggaaatgttaatattagtctttaataagttattaatgacacatattataattgttaggataactcctaaaaggatagtgaagagcatataacttccatattaatggttaaagatgtgccaaacaatagcaacaaaggaggaggaaaatttgaacattgggataaaagcactgcacacagtggtagatgtaaacacaaatatttcagcaattacattacatataaatggactaaatgatgcaattaaaagataaagacatggatgaaaaaacttttcaggaggcatatttaaaagataaggaaataaaagtttgaaaaaataaaaggatagaaaaatattatgcaaatactaaaggaaagcagctgtaggttggctggtatcagtgttgatcatatcatggacatggttgattatggtatgagtttgtgccttatgttgtaagtattcacaatcagagtttcttatagttagaaaaaattagatgatcaaattataaattactagaaagatttcataattgttaaggtgtaggctttttactgcacctggagaggcctttcagccatgatgtgaattatgtaccattatgtaagataagtggagcgtaaatgctttgttcaaacaattataatgtaattggaaacttcttgtgttaacaatatcattatcttaaaggtgaaaggggtgggaagaatgtggtagaaatcaagttccctggggaataggctttacagccaaaagtaaagtcattttttcctgaccagtgacttagcttaaaacaggtcaatgatattctttaaataaagcaatatttaattggattcatttgcagctgatatggattctggggcttgatagcacttacatattaagctggaaatctagaaataagaactttagcaacaatttttttttttttttttaggatttgagattagttattaataacacaggatgcaagactcttaggttgtagttgtgggtaagcataaatatatactgaatagattcagacattggccaagtagactcagtttttttcaggagatcatgttcattcaaagggataatttcttctttctgaaaaacttctattttgaaaatattaaatgatagaattccccctgaaattttttattgtgctgtttaaggaatggtattttacccattagtgataatccatgaatgcatgctatgaatggatacttaggaaacatttcctgcatgtccatggaaagataattatttttaatatttgtatggactgttaggcttttttctgtgagtaagatgtttttaatgtagaggtgtacttatagagtatacgatttttattgtattcttttaaatggactatttaatataattgacatatttcccatggagtaaaaacactatttagatgcttgtggtaacataactcctcaaatcttagtgacttaagacaacaaaggtttattacatggataatgtagatcaacaggaaactgctcattggaattgaagactccatgctgacactgatgggaggctccatccatgcacaggcactcacagtcaccaaagcagcataggaaaatatggtaatccttgcactggctgttaaagcctttctagaagagaaataacacttgcttatatttcattgaccaaagcaagtcatgtggccatgctaacttcaaagaaggtgggcaagcgcaatcctgtatgtccaggactggactattagggaacagcctaattgactactccagattgctactgacaacacttttttaaatgattgggataatactccaataaatgcctatgccatagtttacagagttagcccattttaatgtttgcagtgccaatagtttattaataatgctgaaatggacattttggtatagtcaccattcctccacactgctccttttctggggtacttaaactaatcctagattaagtctcctgttgtatagtttaatggactgctgtatgtctactttgtagcacttattttctaccaacacgctataaatttcatatagagaccacacctttttttcagtgctgtgtctgctaaccgttacataatagatattaaataaacattaatgaaggaatgaattaattggggaagtgggaagggtaaattggtaaaactactattaaggctttttctatatgtttccaaattgctttccaaaagaattatagcaaattcacatgtgagtcagcagtggtttatcagtttaccacccattgccaccactggttattttcctttgctaaatggaaagtcaaaataaataatatctcaatatttttagcactgtaattggcatatctttgattatcaataagactgggtatttttcatacatttggtttttgttattgtgataaaaacataacaaaagttaccatagtaaccattttttaagtgtacagtaaaatataactatgtgtacattgttgtgccacagatctctggaaacctcattttgcaaacctgaaactctttaaccattgaacagtaacttgtcttcaccctcctccaacacttggcacccaccattctactttttatttctaaaatttcgactacttaagtatacctcatataactagacttatgcagtatttgtttttttgtgactggttaatgttacttagcataatgttctcaaggttcatctatattgtagcttattgccagatttccttctttttaaggctgaataatattttattgcatatatatatgtatatcaaattttaaaatctgttaatccgttgacatttaggttacttctacgaacttggctattgtgaataatgctgtaatatacatggtgtgcacttatctcttcatgattctatttttgattcttttgaatatacagatgcttgacttacagttacgtcctgataaaacccatcatcagttgaaactatcataaggtgaaaatgcgttcaatacaactaaccaattaagcacaatagcttagcctagcctaccttaaacatgctaagaacacttacattagtctatggttgggcaaaatcttccaatacaaagtcaattttatagcaaagtgttaaaattgtcatataatttattaaatactgtaccaatagtaaaaaacaaaatggttgcattggtgggtttttgatgttggttatcatgacaaggtctctcactctgccacccaggctggaatgcagtggtgtgatcacagcttgctgcagcctcaatcccctgggctcaggtaatcctcctacctcaacctcccgagtagctgggactacaggcatgagccaccatgtctggctatttttttttattatttgtagagatggggtctcactatgttgccccagctggtctggaactcctgggctcaagtggtcctcttgccttagcctctcaaagtgctgggattacaggcatgagtcagtgtgctcggctgatgctttggttatttaccctcatgatcatgtggctgactggaaatggtggctctttgccactgccccgaatcataagcgagtatgttactgtatattgctagcctgggaaaagatcaaaatttaaagcatggtttctgctgaatacatatcacattcacaccatcgtaaagttgaaaatagtaagtcaaactgttgtatgttgaggactgtctgtatatctaagggcaggattgctggataatatggcaattctacttttactttttttcagaactgctgtcctgttttccacagcagctgcatggttttatattctccccagcagtgtacaagggttccagtttcttcacctcttcaccaacacttggtattttctgttttgttttttgtttttgtttggttttgatagtggccatcctaacaggcatgaagtgattatggtttttgattagcgttttcttgatgtttagtcatgttgaatatattttcatgatgctcgttagccatttatagtatatcttctttacatagatgtctctattcttcaagtcctttgcccaattttaagattggtttatttgttttgctgtgtgaagagagataattttactccaatttggatgccatttatttattgcctaattgcttgggttaggacttctagtactatgttgacgagaagtggcaggagtgggcctctgtcttgtttctgaacttaaaggaaaagctttcagtttttcaccattaagtttgatgttagctgtgggattttcatatatggtctctgttatcttgaggtaatttctttctattaatgaaattttttgtgtgtttttgtcatgaaagggtattgaattcttttcagtgcttttttttttttggcaccaattcagtcatgtggtttttagccccttattaatgtggtatatcacattgattgatttttgtatgttaagccatcctatcattccaggaatatatcccacttggtcatgatgtataattactttaatgtgctattgaatttggtttgctagtattttgttacgaatgtttgcatcagtatttatcagggatccttgtggttttcttgtagtatctttgtctgctttaggtatcagagtaatgctggcctcaaaaaaatgagtttgaaaattttccatctttttcaatttttttgtaagagtttgagaagaagtggtgccaattcttctttaaatgtttgatataattctccagtgaaaccatctggtccggggcttttctatattgggaggtttttgattacttacttagtttcctttccagttaccatattcccctattatctgagagttcactttctgcagtttcaggtactggcagtcaactgcaatctgaaaatattaaatggaaaattgcggaaataaacaataagctttaaattgcatgtcattctgagtagcatgataaaatctcccactgtcccatttcatcccacccagaacttaaatcatccctttgtccagcatttctacgtatacactactcccccattactgtataggaaaatacatggcatatagagggctcagtactattcagggtttcaggcattcactggcggccttggaatgtattccccatgtataagggggaactgctatattgctatgttcagattgtttattactttatgattcagtcttggtagatggtatgtttgtaggaatttattccttttagattatccaatttactggcatatgcttattcatagcaatatattataatcctttttatttggacatcaggtataatatctcctctttcattttgatttttgttatttgaatcctctatatttagtctgaggatttatcaattctattggtctttaaaaaaactcaatttttgttgtttttttctattatttttctattctctaatttgtttatttttactctagtctttattatttccctctttctcgcaactttgggtttagtttgtttttctagttccttgaggtgtaaagttaggttgttaatttctttcttccttgttaacgtaggtatttactgctataaaattccttcctagtattgcttttgctgcatcctatatgttttgcaatgtgaatctcaattgatagaggtttatttagccaaagtttgaggacatgcccaagaaaaacatgggtcacagtagcatttgtgccctgtgcttttccaaagagcattttgggaacttcagtatttaaaggggaaatagcaaaaatgaggctctgattagtgctcagcacatctacattttatttatttgttttaacttcttaaaattttactttttaaataaacatatggtaaaattgacgttgtatgtgagtacagttctatgaattttgacacatgtatacatttatgtaaccactgccataatgagaatacaaaacagttccgtcaccccagagaactccctcatgtcatccttttgtagtcaatatccctagtcccacccgtaacactaacctttagcaagcactaccctgttacccatcaccaaagttttgtcttttccacaaggtcacataaatgaaatcctaccgtatataatcttttgagactggcgtctttcactctgcataatgcctcgaagactcatccaagttgttgcatgtaaacatattattattattattattattattattatggctgagcagaattccactgtgtgaacataacccgttttgttttgttttgttttgttttgtttttcacccattgtagagcatttggctgtttccagtttttgataattaagaattaagcttctataatcattcttatacaggttttggggtacagatatgttttcatattgtaatgcttaggtaattcctagaagtaaggttgctgagtcaaccggtagatgtgcctgtaactttatgagaaactgccacactgtttgccagagtattttcaaatttcagccattctaatatgtgtatagggtattttatcatgattttaatctacatttttcaaatggccaatgatgctgaacatcttttcatgtgcttatttgccgaccctacgtcccctttggtgaagtgtctgttcaggtcttttgctcattttaaaaattggactgcttgttctctcaatattgagttttgagagtccttaatatattctgagtgcaagtattttgctggatatgtgatctgtaaatattttctcccagtctgtagtttgcctttttattcttttaacagtgtctttctaaaaacaaggttttaattatgatggtgtgatttattttttctgttatagatcatgatttacccctttagttataaaaattttataattttatattttacatttaaatgtgtaacttagtttgagttaattttggtataaggtattgagaggtgtagccagctgggcttctgggtcaggtggggacttggagaactttcctgtgtctagctgaaggattgtaaatacaccaatcagcactctgtaaaaacacaccaatcagcgctttgtgtctagctaaaagattgtaaatgcactaatcagcactctgtaaaaacgtaccaatcagtgctttatgtctagctaaaggattgtaaatgcaccaatcagcactctgtaaaatggaccaatcagcaggacatagatggggccaaataagggaataaaagctggccacccaagccagcagcagcaacctgctcgggtcccttccatccacactgtggaagctttgttctttcactcttcacaataaatcttgctgctgctcactctttgggtccgcaccacctttaagagctgtaacactcactgcgaaggtctgcggcttcattcttgaaatcagcgaggccgtgaactcaccagaaggaagaaactctggatacatctgaaggaacaaactccagacacaccatctttaagagctgtaacactcaccacgaaggtcccaattcttgaagtcagtgagaccaagaacctaccagaaggaaccaactccagacacagtatgagatttaggtcaaggttcattttcttgcatttagatgtttgaatgcttcaaacaccgtttattcagaagactgtcctttctctgatgaattgcctctgcaaatttatcaaaaactcagttggtaaaactgtagttgcccatgggtatatgcagcagagcagaactttctgaagtaatggaaatgggaatacacgttacagggtgtgttatgtgggcatatgcatttgtcaaaacatcaatttacacactttaagtcagtgaattttactgtatgtgagttatacttcaattaaaatatcagttggccatatttctgtaggtttatttctggaagtctattctatgctgttgatctacatgtttatctttttgccaataccatgctgtctttattttttattattttattttatttttgagattgaggctcgctctgttgcccaggctggagtgcaatggtgcaatctcagtcactgcaacctctgcctcccaggttcaagctattctcctgcttcagcctcccaagtagctgggactccaggcacatgccaccatgcctggctaatttttgtatttttaatagagacgaggtttcaccatgttggccagtcttgtcttgaactcctggcctcaatcaatccgcctgcctcagcctcccaaagtgctgggattacaggtctgagccactcccggccaaccatgctatcttgatctcaattactttagctttatagaaaccttgatgaagtggaaaagtgtgattcctccaactctgttctttttcaaaattgttttggctattcttgtttctttgcctttccatatacctttagaatcaccttagttctacctacaaaaatcttgttgggattttgattaggtttgtgctaaatttatagattaattaggggaagattcacatcttcacaatactatcttccaattttgaacatagtatgtttttttcatttatttaggtcctctttatttcattagcattttatagttttcagcataccctctaattgtttacataaatatttattagatttatatgtaagtatttcaattttttggaattgttttaaatatcatttttggagttattttaaacagcatttaaaaaatatttggtttccagctccttattgctaacacataaaaatatgatccatttttttacatgtactctacaactttgctaaatacattcattagttgtaggaggtttgtatgtatgctatttcttgggatttttcatgtaaacaataatttcatttgtgaacagggacagttttatttcttcttttccagtcaggatatctttatttcttttccttgcctgattgctctggcttggaattccagtatggtgtgaaataggaatggagatagaagtttgccttgttttcattcacaggaggaaagcattcagtcttcatcattagatgtgatccttgttggttttccaatgatatgtcctttattaggttgacaaaagtctctttttgtagcaaatctacattttacatgtcaaaagagggagtagatgaaaaaagtaaattacatattcatctcatactcagtgaatctacattttactaaataagttgaagtaaacataaaaagaggaagcagaggaaaagtcaattatgcattaatctcagggtaggtgaagagataatttctggtcttgtccttgtcctgtacccgcaaagataagctggtagttgacattgtgagggtgagagtcaacagagctcagttttagggctagtttataggagggatatagatcctgaacgatttagggcctcacgtttatacttattgtatcttccctatgaattggcccttttattgttgtataatgtccttttttgtttcttctgacagttttgacttaaaatctatttgtctaatattggtatagctacctctgttctcttttggttactatgtgcatggaatatctttttccattctttcatttcagcttatgtgtgccattatatctaaagggaatctcttgtatacatcagatagtgaggtcttgttttttaattccttcagccattctgtcttttgattgaggcatttaatccatttacattgaagcaattactgattgggagagactttctgttgtcattttgttaactgtattctgtatatgttgtatctatctattcctcttttcctttttcctttttatttgctgccttcttttgtgtttcattgatttttttttttttttttttggtgacatgctttaattcctttctcattttcttttgtatgtcttctataggtattttctttgcggttgctatggagattacaaaaaacatcttatagttgtaacaatctattttaaactgttaactacctaactttgatcacataaaattcctttacatcccccgtcctactttgttaccaatctttcaaattatacctttttatattgcatatccaatcaagctttcaaactatatccttttatattgcatatccatttatagagttttataattgtagttattttttaagcttttatcttttaaattctataccagaatttaaaatgacatacaacctaccagtacagtattacagaattctgtatttgtctatatattgacctttaccagggagcttacattttcatatgctttcatattgatatctaggatcctttcatttgaaggacttccattagcatttcctgtaaggcaggtctagtggggatgaactctcccagcctttgtttatttctccttcatttttgagtgacagcttttttggccatggtattttgtgttggcttttttttttcttttagcatgttgagtatattatctcacttccttctggcgtataaactttctgctgagaaatctgctgataatcctatggaagatttcatgtacatgatgacttacttttctcttgctgtttttcaagattctctctttgtttttgattttgacagtttgattataatgtgcctcagtttaggctcttcaggttcatcctagttggagtttattgactttcttgaatttagatgttctttttccccctagatttgggaagttttcagtcattattttctcctttctctcactgttctttctcagggactctcataatgtgtatattgatctgctcaatggtgtttctttctttgtttcttttttggctttgactagaaaatttcaaatgacctatcttcaaattcattgattctgttttgctcttgatcaagtgtgctgttaaactcctctggtaaatcttccaattcagttgttgtattcttcagctcaagaatttgttaggttcttttttaaaatagtttctatttatattctcattttattcattcttcattttttggatggtttattttttattgctggttgtctgtacacccagttaactctttaaacttctttaagatggttattttgaatcctttgtcaggtaatttatagatatctgtttttctgatctgcttttggagatttattttattcctttgattgggccatgttcccctgattcttcatatgcattgatttttgctgggatttgggcatttgaaaaacaactacaacaaccagctcttccagtcttaatggactggctttgtgtaggggaagacctttaccagtcagcctggctagagattctgagggtctctgcgaccttctctggagatgtgtcttgtctgggcttgcatgtaatttcccaattagagaagtttgctaatttctttttcaacagtttgtgttctcttgctttctctgtgacactccacagtactgtaggttctccggtacagcaagaaaacatcaagttcttttgttctctgcagccctagatgtccaaagtataccagtttcccgttagagtctgtgttaagcaaaacagaaactagtctcttaggcagccccctgaaaaactggaacactggatgtgcattcactcctcttttcctcccaaaggagaagctctgagtaggttgttttctcccaattcattgagctgtgccagcctggggaaaggctaagaatagcaaaataaaatgacttttcctacctgttttaattctgctgttcttcactttgtatttgcctaggggcactgtggtttcataactggtttctggaggtcttataaaggcattttgtacaatatattgttggtaagtctgtggggggtgggcagggaatgagatctggggcatcctattttgtaatcttacttatatcacctcccaggaagatcaaattttatacttatcagtgtatgagagtagaaatgtcattgtattggggggtcagtagataagattccatatctgtttctatcactaatgatagaactactgctaaattataaaaatgtaaaatggtgctagaatagagattagagtaacatatttttgaaactttaaaatctgaaggaatttactgcttaacttctgcctactttcagggtattaatactagagaaatttcctctaatactttcctttttctttttctttttcttttttttttttttttgagatagagtcttattctgttgcccaggatagagggcagtggtgcagtctcagtttaccgcaacctctgcctcccaggttcaagcaattctcctgcctcagcctcccgagtagttgggattagaggtgcatgccaccatgcctggctaattttttgtatttttagtagagatggggtttcaccatgttggccaggctggtctcaaactcctgatctcagatgatcctcctgcttcggcctcacaaagtgctgggattatgggcatgagccaccgcacccagcctctaatacttttctaattatgaacctgatgaatgcttagtaggatatatatgtaaatcatctgcaattcattcaacatgagtaattactgttaacattttatagtattttctttacattttgtatgtatctgtataatgtattcaaaattatgtatatttaaatgttctctatacacagatctgtttgctctctgatcaccaggctttatataataaactttttttttcatgttaaacattcactggtttttcaatatctgcatattttcctaataatatattgctgtaatatacctcatttgaccatgtaaccatatctcatatttctattttgggaggttattataaatatggggccatgaaaatgtttgtagaaatattctatatgcttttaaaatatcctgttttcttcaagtagattgctggagatggaatttctaggtcaaagaataatgtggacataaatgattttagaactttttctacctttgccagttacctttgaaaaagtgtgagagtgttacattgcttttgtttctcatgaatactatcttttaaaaattttagctaacttgataggtaattttatttgtatttctttgaacattaattctgcttctgtggcttgtttattcttatcccctttgcccttttctttattgtgatattggaaatgtccctttcaattagtttttactctttatttattaagggtgttaatactttttttagatttgtggtaaatattttcccctgattcgtagtctgcatagcttttaattgtcttatgttattgtgggttgaaacttttatttagtcaaatttgtacaactttctttagtaacttttttcctttgctgttgtgcctgcagtcacacaccatccagatattaatcacctagattttaaattttctatatatatacaaatttctgactatactatattccttctctatgaataacctcttttaacatttttttgatgggcaaatttgctggcaatgaattccctcagtttttgtttgtatgaaaaagtctttattttttcttcacttttgaaggataactttgctgaatatagaaatctatgttggtggactccccccatttaacacattaaatatttttctccattctcttcttgcatggtttctaacaaaatgtctgctgcaactttcatcctctatagatgtttccctccttttggcttctttcaaaatttcttatttgactttggctttcagcagtataaatatgatagcccaggtgtaggtatttttgacatttattgtgcttagtggtggtctctaagcttcctagattggtattttggtgtctgtcatttattttggaaagttcttggtcattattccttcaacatttcttttgcttcattctttcttccccttctgttcagttacacacatgtcgcacctttgcaattattccacagttcttggaaggtcgctgctgctgtcactgctgctgctccttcctactcctcctcttccttgttccgcttctcctcctcctcctctctttttcttctctgcccacctcccactctgttttcttctctctttgcatttttatctgggaggtgtctattgagctatcttcaagttctctgattctttcttcagccatgactagtctcctcatgagcccatcaaaaacattcttcacttctgtttgtctgatttctagcaattcctttagattctctcttacagtttccatttccctgttgacattacctgtctgttcttgcatattgtctgcttttcccatcagtgttcttaacatactgtgatagttaattttaggtgtcaacttgactttagaagggatacccagatagctagaaaagcattatttttgggtatgtctatgagggtgtttctggaagaaattggcatttgaatcagcgtactgaataagaaagatctgccctgccccaatattgacaggcaccattcagtcagctgaggtcccagatacaacaaaaagggagaggagaaatgaattcatattctctttctctccccttctctctcttccttcctccctctccctctccttttccctctctccctcccttctagagctgagacattcatctgcttctgatcttgaacatcagaactccaggttcttggctgggtgcggtggctcatgcctgtaatcccagcactttgggaggccgaggcaggcggatcacttgaggtcaggagtttgaaaccagcctggccaacatggtgagactctgtctctactaaaaatacaaaaaaataagctgagtgtggtggtgggtgcctgtaatcccagctacttgggaggctgaggcaggagaatcacttgaacttgggaggtggaggttgcagtgagccgagatgatgccactgcactccagcctgggcaacatagtaagactccgtctcaaaaaacaaaaaaaaccaaactaacaaaaaaacccaaaaaactccaggttctccaccctagggattctgggtcttgtatctgcagtcccgcagtttcttaggccttcagccttggactgagagttacattgttggctcttctgattctcaggcttttgagcttggactgagccatgctaccagcttccctggttctccagcttgcagatggcgtactatgggacttcccagcctccataatcagatttaattcccctgatgaatcccctcttgtctatctatttatcctattggttctgtttctcaggagaaccctaatacacatattaatcatagttattttaaatttcctatccgataagtccagtatttatctggtttgattattactttgcctcttcaaattgttttttcttgccttttagcatgccttgtaattttcattgaaagctgaaaataatggattgggtaatagacctttagtataaggttttatgttaatctagactagattaatcacagactacagttggcctgtgtttagtatttgctgtagctgtaggtgccagaggcttcaaattcctctggcgtcattgtttcagtctcccctgttgtctttgggattccctaagaactcctcagatagagtttgcatcttgcagctcttttagacgtaatctaatgtaatctgttattttactggtgaggtatggtgctaaggtgtagggaaggggaaacattctgtaatcttaggactacataccagtttcttagtgggcttgcattcatggcctatgaccttcacaagtgtttcttagcttttattttcttaaagaaaaaaaaaaaagctcccataatgagataggaaggctagagggggccagagtaggaggaatgtccttccctcaggtggataaggctctggtaaagtctttttggattccactctggagagtaggcctttatttttgaaactcctctgggcatatttcacaatagttaccattagggatggaatatttgtgtccccccacgcccccgcaccccgccaagtttatatgtggaagtcctgacacccaatatgagtgtgtgtggtaggctgcgtgtggaggtattgggaaattcaggttcccaaaagtttggtcgtagtgaagtcctcagaggtcttcttgagtctttccttttcttcaccaaaggctcactgacgtcatccatcctcctgatggaggtcaaagcattaaagtcatttttctccctaggagcgtctcccccattgccaaattgccaggctagtattagggagaaatgtcctccctgaatttcattgttgggtttttttttttttttttttaaaccttattatggctttaatgttgaaatttctgttttggactttttagcatgacacatacacacacctctcattttattttcattgctttttaaactcccatgtccaatgtctattttaatcttatgtttggcagcctgaaacattttatttctaaaattaattctctaattatacaacatctacatggcttgtaatgacatcagtagagcagaatctagaatccaactcaaggttttcgttttgttttttaagagtaagtaacttattttgatcaatgtagtaagaggagattgaaaggtaccagtgtgtgtgaaagtgaatagttgcttcctctccccatctcctcttcttcctcccctgctcctctcctcttcttcctccccctcctttcctcttcctcctcccccaacccttcttccttctactcttcctcctcctctgcttattccttcatcttaactcatccttcactaaaaagagttatattagcattagaagtattccttaatggctatacttttcagatattataacttcagaattttctagccaataacaggattctagggcaaatgtcatgtaggatatggctcttcgagtaccaacatggcaagaaattgatttcctctattgaagacacattgattttcagctgtactgaaaaactcacagccttccagtatcgacaaatagtaaaaattgacttcacataataacacctttatttacctagccttgtgaccctctgattttgttagatgatcctatggtgaaagaatgcaccaggaccaatgcttggacaaatagtaagtctccattttctttatagtagatgcttctacataaaattccgctttgggcagtaacttgcgtagacagctgttcttgtgacacgacataatgcacactgagcacggtgacagctccagacgatggtctactctggagtttccaactggactggtaatctactggatactctcatctggaattgtctcctagctgagtggttaagctatagaagcccatgattaaacaatgttgtttctggaaagaataatagaaatggttattattagtgagtacttactgtctgccaggccctgcactaagggctttttatgtgttagttttgtttaatccccacaatatatctaagaggtattatcccccttttcccgtgaggacactgaaggtccaacagctaataagtgaagctggcgatatgtcctgttttagctactaacatttatcagcttcatcatacagacatactttgtcagattggttagccaggcaagtgaccgctgagagaatggggcacaggagaagtaagtgatgactgcgaacacaggctggacaaagatcactttcttatacgagtctgcagttcttgaaataatacctatcagatatggcattaacagtgattggtagccttatccaaatgcgatatttgacttttgccttcatatcatggtttgaatttacaaacttcatttctttttctttttttttgagatggaatctcgctcttgtcacccaggctggactgcaatggcgcgctcagttcactgcaacctctgcctcccgagttcaagtgattctcatgcctcagcctccagagtagctgggattacaggcatgtgccactatgcccagctaatttttgtttttttttttttttttttttttagtagagacagagtttcaccatgttggccaggctggtcttgaactcctgacaaacttcagatgggggcattgccttaagtgtatgatgcccaccattgaggtagactaccacatggtacctggatgagcatcttatgtttcaccaaaccagaaatttcccaggcaaagtgaacggaacaagagagactgcggattcagacgtttcctatgcagttatacttctgaatgggtagtcacagtgtgttcaagggtaaatgatagctaaattatcacccatctttaaatgttttcactttaacggggttaccaaatcgctctttaaacttgaatttctatcaagcttcagaaccataaatgttttcttagaatttttccaagattatctgaatcagtgagtcctttaactcacttctccaggtatcaaaagtcttttaagtcttttttctgccaaaggtgaatctatgctaacgccttctagtactgattctcctttccattttcccatgcaccctactgctttctgtctccctttgcaattcaacagaaagagaaatcatgaggcagtatgaaatgaaggacttttctgggctgattttccttttgaatcagaatggaaatttatggtcatagtgctttccatgaggtatttagaagtttccagtcaatcattgctcttatcaggggttcttaaaggctttgggagatactaggttagctttcttacaatataggctgccctttgttacagcgacactttctttttgcagattttttttttcttaacagagaaaattgagatatgaaattatttccttaatctctacaataatcaaatcataattatttctattctattttttaaacttttaaatttcactaacagtacatagccattgcagtaatttttttaaaaaatagagaggagcttaaaaataacaaaaacctctataatcccatcacccagagatgagttttggccccattcatctcacaagttctgtgcaactattgcatttcatgttgcctattcatattaagagaatagcattacttttattatgatgatgatttgtaaacaatttcccagagttaattcccagacatttaaaaattttggccataattgaaagtcaggattttatcttctcagttggaaagtagaagagaaaagtataacagtgaaaaaaatttttcttaggtgtgtatttgtgttggattgttctaatttcaaaacagagaaagttttgaactcctgctttcatggttcattcttagaaataaatagaattgttttcccaagaaaaccttggaaaactttctagtaatagcaggaggaatatgggagtaggaaatggcaagttgaaggattttaatttggaaactgccaccttttggaatacagaagagctggttatgggattggcccctggctttacttgtccttaacatgggctttgataaggggaaaacaaagtgagggcttcgagccacaagtcaaggtcttgggaaagcttagcaaaatggtgcaagtctctcgtgatatctacctttatgcttactgctttctattggcaaaaatctctcatcttttgcagatgcactgagatcccatcagtagacagagaaagaacgtgggtgagtcagaagcaatcagccagaagcacacaaatgggtgtggacatgtcactgccaacaacccacacagagtggctggctactgcattcacccttaggatctcctaatgagcacagttaacagtagttggagctttgtctctgacatcctcttgcagtcatctgccttatttgctgattgatttctgttcttgaaactctgaacaggaagccttctgttgactcatccctgcttttcagactggaaagcacttgtaattttatctgccatgtatagtctctaaaaatttattttgaagatatgctgtatcaaaagcaatttaagaaagtaggaaggtaggaaatataacaaccaaaaccaaacagtgacactaaatatatacatatatatagctgtacactagacttaacctaaactgaccagctagatgattttgatgcagtaaagacaagttaagaaaatttgtctttactgtcaacaagacagtaaacttgtctctatgtcaacaagaaaaaaggcaattagaaattcttggaaaaacagaaatttgcaaatgaagtcccaatttaatatgaggtaaactgaaatgtgacagaattctgcataattgatggtatataagaaaaaagaaaaaagaatacattggaacttgacgcttacagctagtatggtgacaacggactatatctcctttaactgatttagtttcaccatctggaactgcactgaataaaaatatttacctaattgtaatactgaatatattttattagttttcatttttcataattaacctgtatgcaaagcatggaagataaattatatttgctgaacaaaatggaaatattctaaaacttgatgttgtaaattaatgcttattataggtgataaaatgtaagggggggattgaggtggaatggagtacaagagcatatgttttcttctgtttcatagtggatggttgaaatggtactctttagtcttgatacatagagaagtagagatttaggaatatgattacatgattaaggtaacaaatgaaagattatatatctgaagaggacagaggggaaaggagatgctgtgtctcaaaattgtgttctcctctagcagggaatcaatataccgttgacccttgaacaacacgggtttgaattcaggagtcctcttatatcccagtcttttttaaaccaaacatgaattgaaaatacagtattcccaggatgcaaagcctgtgtatagggagggctgactttgcgcatatgcagattctgcaggtggactgcaggacttgagtatgcctggattttggtatatgcaacaggtcctggaaccaatcccccaagtgagtatactgaggggcgactggattgtttcacttttgtagaggcatatgggagttaggcagccttgtgcttttcatactatgttcttgtttaatttctggggttttttgtttgtatttttgttatccatgtacatcttttgaaactgaaaaaatggtgatcagatgatttacaagaaactttgattaacaattatactagcacaactttgttaaatttccctaggagaagacaacagcctcaaatgcagtgggaaaaaaaagcaaaatctgcctgcttccacattgttttcaaggagagcacttgaacaaaatggtactatttggacaataaatagatgggtaccaattctagacaagcacaagcaaaaagaaaacagggctggcagtattcgcatgggggcaatttcaagacagaaagcattaagtggacaaaaggtgatattttgtaatggtaggggttagaatccaccaagaatttatacagccatggttctttacgtatggaaaattagcgccgaaattggtaaaggaaaaactgttaggagataaaagaattaaagaataaggcaaaaaatattagtacttagaaaattataatagccaatggtataatttaaggtatgaaaataaaacaaacaaaagtctgcacctgcaaaggaaacttgaaaggcagggctgttggggatggggtgtgtgtggcggtgaaaggggtacagatagtttatcctaatcataggttttaatcactttcttgtagaaggaaggaaaagttttatttctgtgacaccatctcattgtaaaatccagtaaaattgaaaactttgagataaatgtattatcaggagttacagccataacttttagtatgtgagctataaattctgttcttatcactaagtcactgagaactaaggctgctgattttcccaacatagtaaaacagagcgacctgaccaaaaaatgaaaaacatttttatggacttttattctccttcctgcaaccctaatctccttccttcctctatagattctagtctatctaagaaattctaggtggatggtttgctttctctgagggaagctaagattgaggccaaaaggagatctgctaggtacctgtgcaaacgtcaggtgggacagtgaatagaaagtaggcatgcaggggaccgagaaagataggctctgggcatcacaaacagcttttccaactctagagacttgaaaaatgtatttggagttacatctaagtcagaagagtacatcttgtttatccccccaaaaagcctcctggtatataccttttagtcaaatagcattgtgatcttgtcacaatatatggacaacagatattttcagttcatttgatacttaacatagaacatattaatgtgccattttatcagaaacctgtaaaggagtttaataatggataactagaatgaacataagtggtagcaggtccttactctcatcccccctcccacttttcataatgtactgatttgaaatgttcgtgaaatcaatacagacaaattaactcagtgagcagcttctccccagtctcttgctgcagtgatgagaagcctctttctggatctacttgtttccagatggtagacaaggcttattctgacacatggactgaaaacagggcagaccagcagtcggaatcttccctgcttagtgtcttaatctatagtaagacctcaaagaattagattccctagcatgaggaatttttcttactgaattttttaatgccactatatggcagtgattaaatagcaagttcaagtgattaaatctggtccatctctatacttttcctttacaattgctatcaggttttgtaagtaaggaagtggaggcatttttgtaagtgtgttaactctcaaagcccacaaaagtatgtttttaaacttagggatcaagttgtgtggatccgatttcagacccccagaggttcttccaatgtgtctaatgtccaggacagtgcacatgttcagagtttcattgtatttttctttctttctttctttctttctttctttctttctttctttctttctttctttctttctctctctctctctctctctctttctttccttctttctttctttccccctccctccctccctccctccctccctccctccctccctccctccctcccttccttccttccttccttccttccttccttccttccttccttccttcctttctttttttgatggagtctcgctctgtcaccaggctggagtgcagtggcatgatcttggctcactgcaacctccacctcccaggttcgagcgattctcctgcctcaacctcccgagtagctggggctacagctgcccaccaccacgcctggctaattttcgtatttttagtagagacggagtttcaccatattggccaggctggtctcgatctcttgaccttgtgatctgcccgcctctgcctcccgaagtgctgggattacaggcatgagccaccgcacccagccagcagcatgttttctttgaagtgttgttcaggggtctcttgcatcagaatgtcctgaactgcttgttgggaatgcagtatcctgatcctaccctccagattctgattcagtaagcctggactgagccttggaaatctgcattttatttagcataatgtcctgggggcttgggggctccccaaagtttgaaaaccaccgctaagggctattatgtttctgtaggcaaacctatttttctgttttcattttatgtcatacaaagtaggagtttaagaatttatttttggtgaaactagaacactgtcttcaaattaataagagccttgttgtgtaggagaaatattctcttcaaaatctctccacgaaattgatctcaaaaagactggctgagtcaaatgctaaacagatctgtcctgtatctggctgccacctgtcaaaattgctgaccttacacttatgtattcaaatgcttcctggaagtcaaaacatattttcaaaagtttctagtggaaaagaactaagcctgtcgcttggttttaaaaggtggaaattgagataagaccgaatggttgagattaatttcacatcacaagaataggggtgagaagagaatagcaatttccataacttctatcatttatcttttaggttgaggatactgtgaaataatccttccctttccaaccaacatgaagatgactgatacacccatcatactgaaggattcctactgtgtcagagattacattatattaagtccttacagaaatataaagagtataaccttcaaaaaactgggaattgttaaattatacattggattttgggggctattgtttgggaggttttgttttgttttgttttgtttttccttctttcataacagttcgctcaattaactataccagaggcatctttggctgcaaaggtggaggaatcactgtgctcgaagatgacagttctacaccttggcctgacagttttgagattcttgcttctaaaataagatggaacctgaaagatgggatgattctagcatactaagtatttgactttaattggaatcattgaacgtcccttgaattttttttctcattggtattggattctgttgtctttactgatggaaatttcttttccttccattcttggttcatgacaaaccaccaactgtccacgcatgatctcctttcattttacttgtatttgaaatgaaaacctgtgagtgcaatgcctaatctaagaatcagaacattattcttttatacccctatctctgtaattctcctttatcttactccttcacctccccatccctctgccaccagaggtaaccaccattctgaacattgtttatcattctcttgcttcacccctacatatctacatgtagccttaagcaatacattgtttcattttgcctggctttgaactttatgaagaggtatcatccctggcttatatgatctcttgagacttgctgtttcactcagccttatattcctaagattcatccatgctgtcattgctgtgtagtatttttatttgtgcttatactgcagtttttctataaatgttagtataggttatactatgatttatcaatactcatgtcattgggcattcagggtgtttcctgtttttgtatctatgagcagagctgttagtaagcatttgcgtctcctggcatgcatgtgccgaggtttcccttgtgtctatgcttagaggaagtacagcaaccactgctgtgttgtggtgtatgaaatcattcaactttacaaaagaatgggaaagcgctttcagggtcgctatatccatttacacttccaccagaggtgcagaaaagatcctatcagttcacctcttcaccaactctttgtattttcagacatcaattttttttttgccaattttgtgtttataaatctactgatatacttcttaagtattttatctatcccttaggaaaaaaggtaggaaatagaatgtggttgccttcacatagagaggctagaaaacaaagtatcatgcctgcttagtttgatggcacccaaatttttctcccagttatctcactactagtagttgacattcttttctcaccctcgctagaaatatgaaaaccttgcctctgcacagtggaatcccttggaacatttaaaaaatgctaatgtctggaccccacctccagagactctgatttctttggagcccagcattgaacatagggatttttttttttaaataaaagcttcccaggtgattctaacgtgcagtcaaggttgagaatcactgctttaaaatacagaaatcttgacaagcaagcataagctcagggtagcctgatattgttaattgttctttttctcatttctaaagtacaaagtttgcataattttggagaatcctcttgcctctaatttctagctcagcagcctttgagagttttttggtttttgttttggtgtttgttgttggtagaagtaaatagtagaaattcaataaaagttagtatgggctagaaattgtgcttgacatttatttttttcttataactgtggatctcaaagtttagtgtgcataagaaacacctgggaagcattttgttttgttttacaatgcggattttgattcagtaagtcttggcgtgagcccccgggaatctgtgttctaacaaagtgattatgatgtaggtggttctagaatcacctttggataaaaactgcctcataataatcctacagtataagcagtattctcatttacagatggggggatgtgaagcccagagaagttaagaagcctgcgccgtgtcacagagctccctaggggactagcctttgctctgtaagctctcagccctgctcatagtatgcctccaacaaggctctcagaatttaggaaagtctgctttggaacatgtgttatcttctctatacttacattctttcttaatctgccatgactttctctcctcatcaaaaaacagcctttaatctcctacccaaatccacctcgtacctgtgagtcttcaggtgtgttacactctgaacatggtcccgtgagagaatttcttattaaaaattgagcttgcaaaaaatcaaatgtgttatatttttgttcttatttcaccctaaaacaatgactttagttgacaatcacttttatgcaaccttagtaattatttctaaactcatgtacaagtggatggaagtatttctgtgcacatttagaaaatttatattcattgcttgtttccctcccctgccaccccacagagtgaggactttaccatgaaatctgggcctttggcctatgtatttttaatcatgttcatattgtactgtatctgcaaccatctgtaatacagctgtatatgtttacatgaaacacaataaacttttaagtttaattccatttgtgagcagatggtagcttgtcaaggaaacatttgatcatgtttatgtctgtatttggccacaaaaacctcataattactctcattaattacatatccttttcatgttacctgtaataaatgctaaggtatcatatgtgttggccttgtgggatatatttttgtatgtagagacagtcctcttaagaatgtttgcggcctggagcagtggctccgacttgtaatccaagcactttggaaggccgaggcaggcggatcacttgaggtcaggagttcgagaccagcctaggcaacatggtgaaaccccatctctactaaaaatacaaaaattagctgggtgtggtggcaggtgcctgtaatcccagcttcttgggaggctgagggaggtgaattgcttgaacctgggaggcagaggtttcagtgagctaagatcgtgccattgcactctagcctgagtgacagagtgagactctatctgaaaaaaaaaaaaaaaaaaaaaaaaaaagaatgtttgcttctgtaggcacatttatgtctacctattatgatgtcaagggtgtattccagtttgtatctgtagctgctacaagaagggtgtcatgggatctgtggttacactcttactcttcccatctgggtatttctgagtgtatttgctccaggagagccactggttctgctggcctacatgcaaagtgtatctatctctctgttaatgcgtttcccatgatgatactcgctgctgagatacttcctaggaagttttgctttcctatcacctcctttaagtgctttcctttaagtgttctcattttaactcattattaaactagcagacttgattgcagtgaatttttcttaaataacttaattgtagggccttttgcgcgtcattttgtgctcctacttactgctcagaggtggtacaaagtcagcagctcaagagacagacctgccacccatgatctctcctccaagttctcaggatgttcagaaagttaaaatttcactctgtcgagtttccatctggcttggcaatcaatgccggattagctccaaatactctttccaagtctcttgaaggatgtgctagcctctgttttgaattctacttcaggatcacaccatctctgcatgcaagaatgacatatctgagtgactgccactaaacccacatggtggaagtgtttgcttatcctgctatgtgatgctggctatcatattgtcagtttatgaggtgtttttttttttttttgcttgtcttcttccatgtaagtatttccagagcagaggcattggcttgcagaaggtgtgcctgcaatcagtccagcttccccagatgtgctgaggcttcaacaggggtttttaaaacttgtgctagaatactcatcttccaaaaaatctttaagttgatgcaatataatagctgccaattgagcatacattttgaggtagttttctttaatgggagtatatgctcatccacactctctttccagtgttaaatattttaagacagctggttagagttgagggtgccttttttttggtcataaaacgatgacagaactctaaaatcacatggttatttatcaacattaaaaacattcttttatatccattaattaatttattctttataacagcttctgtggaataggtatataaagggtttttttttttgtctactgttatttaagagtatcataaaacctgagaaagaaaaacataattagttgtcatctagtctaatgctctcattttgcagataaataaattgaagttcagagagatgaagtcactcacttatggacctatagctagtgaatggccctgaaattgtttcccagtcatggctggaggcacaactttgtctgagacctgactgatacttttgactatgtgatgttgtgtcaattatctaacacttctggacctcagtttctttacccatattatggattattgtgaatattatattagactacatccaagaatgctattaacccagggcctaccatcaaataagtagttaatttatatcagccacttcacagctgcacttatttttatttttattttttctgagacagagtctcgctctgttgcccatgatggagtacagtggtgtgatcttggctcactgcaacctctacctcctgggctcaactgattcttgtgcctcagcctcccaagtagccgggactacaggtgccaccatgcctggctaatttttgtatttttagtagagacggggttttgccatgttagctaggctggtcttgaactcctgatctcaagtgatccgcctgcctcagcctcccacagtgctgggattacaggcgtgagccaccgcgccttcctgctgtgcttattttcaatactcttttctcagggatcttggtaaccagagcagaatggcagtttttcagctcttacaatgcctttgtttagaagtcttgtatgtgtatatctgctccatcacttaaaagttctcctaatgcaatttggaagggtttaatatggaacaagagcagggactttgggatggagtctaatgataacttgtcacatgttcttttagaagctgaattaggtagtttttgccttactggtgcgctctcatttaactgtgaggtatcctggcacttcaaacaggtaccatatggtaactgttttgtgttttaagcctggtactgtttagaacacatgcttcagagagtggtcattgtttcgctgccacccagttaaggcatgtgttacctcttgttatggatggaatgcctgtgagccctaggttcctatgttgaagccctaacccccagtgtgatggtatttggagatgaggcatttgggaggtgggtaaggttagattagctcatgatggtgggaccctcttgatgggattcatggccttataataagaggccatgtgaacacagagaaaaggtcatgtaaggactcggcagaaaggtggccatctgcaagccaggaagggaggcctccctagaagccagacactgcctgatcttgatcttggactttccaggcttgagaactgtgttgtttaagcccctcagtctgtgatattttgttatggtagctgggcttgaacagactgagagacctctgctggagtgtgcgttgttcaatgatttacttccttgtttgcctacattatacactttcactatgtctccacgatggaagaggcatgactgttcagatgcatcggggttcgtctctacctaccaaggtcctgtgccatgaggagatgtcgggccagggactcaaacaggagcagtcatccaactcctttctattaggtctttggtgatttaaaatctcatatgaatcaagagctggtagagtgctaatgttcacaggtttttatagaacattaaagctctgtaatagttattttgtatgttatataaataatttccctgcaagtatttattcatttactcttcatttacataattgcttataatcttttttaatatattcttgtcccctgcgccacccctcccaccttttttttttttttgctgtggttcatatgcttttatgtaacctgagctataaaagactagaatactgcagatattctatctgccatgtctgtcattttcttatgatgggtacttagtctaccgtatacaaatttctgtatagttaccaatgtctttttagctatttattaatcttatcttgtttctttggcttctgaatcactttgctgaagttgaaatcatctgaggtcagagccagtttttatttaaatagactgaatgcagctaaacctggattatagccaagaaagatcttacaccaagtgcctacaaaattagaagcattgccaaggacgcatcagcagagtgttttgcttactgaagtcttattctgaaataaatttgaggccctggcgatgggagcttttggttgttattggtagacctcctaaaaaatgtaatgtagtttaattttacttttaatttttttagcatgaactttctccttcatttcttctttccagagatttttgggtctatccattggttgccatctatgtgttcaaacatgtgactaggtagaagagaggtaaacaggagtgtattcacctgttatcatggagaagttattattcaagacctgtaaggggaatgtggcagtcctaaaggctgcaaatattctggcagcattgtaggattgcactttccctcctcctctgaaggtagatgggagccatgtgtcttgctgtggctaatgaaatgtgagcaaagtgttgcaagctttaagagccagtgcatgattcatcatgttcccatcccattgccacagtgtttgtgaaagcgagtgttgagatggaccctttgttttctgggtccttaattgactgtggtaagataaattattgacaacctgtactagacatatatcttcagcagtatcctttggttgggattttgttgagataagggtccgtgatttggcatactcagtgtaacctaacctattctgattcttatagggaatcagagaagtgtccttacactcagggagcttgtgatttaatatagttgagaagatgtgtttgcataatgaagaaggaaccagctgcttaactgtactctttatttagccacattactgaacaagagacaagctgattatagcataatattgagattttgagtatattcctgagaccctggtttcaactggaaaagtaactttttttttttccttgacactttcagatcacaattgatcaaaacacctatgcaaggaattaaacttgctacaaataagccactagatgcatgatacctttaaaaaagaccaattatgagttatcttttattgttctttttatattaaaaatctgcatgggaaatggaatgagaatatttataacagtacagatttgctatgatggtgtctattaatcaaagttctttattttttagtatgtggggacgacacatactcatggctaatattggtgaaattgctaattcattcattctttatttggtgattcactccacaaacatttattgggcatttggtataaaccaggcatagctctcaatgctgctggtacagcaagaaacaagacagagcctctgactttgtgtcttacattttagtgagagaattgggtaataagcaaacaaagaaaggtacagtgtggtatcaatgatgagagttataaagacaaagcagagaaatgagacagacagtgcaaggtgtgtgatctcacatagagtggtcaggaaaggctgctttcagaaggtgacatttgaacaagaaattgaagaaagcagggagaaaagccatgtgactgccctgaggaagaatccttcaagtggcataaatagccatttcaaagaccctgaggcagggatgtagtaggatgtttgaagaacagcaaagagaccagtgtggctggaagaagggtgagcaagtgaggagaggtgggtaggagatgaagccagagacgtggtcaagagccacagaaccagggcctgccctgcctctgatgaaaaggcactgggattttgaatgtgagagaaccatgacctgctttatgttggaaactgatgtagtctgtggagggcaagaaaacaaacagaccagcaaggagacttttgcatgagtccaaattggagatgatggagtttggacacagttggcaagtgtggtggttgtgagatgtgttgggttcaagatatcttttgaaaatattgctattaggactttgtgatttgttgtggactttggcctgagcatctgattgactgatgatgctattttctcagatgaggagaatgttcaagatgttgttacctatttaagagaaggtggccattgcatattgcatatgtgagcctggacttcaggggaaagtttaggactggagataggcggttggtcattcaatggataggtggatttgaatccatgagattggatgagattcttttttgtttgtttgtttctgagacatagtcttgctctgtcatccgggctagagtacagtagcacgatctcaactcactgcaccctctgccacccaggttcaagcattcgtgcctcagcctctgagtagctgagatttacagatgtgcaccaccacgcccaggtaatttctgtatttttagcagagacagggttttggcatgttggccaggctgatcccgaacttctggcctcaagtgatctgcccgcctcggcctccaaagtgctgagattacaatcatgcgccaccacgcctggcctggatgaaattcttgaggaaaggagggtaccgagaggagaaaagatgttgaagaactgaatctggggtgctcccaacagttagaggttgaagagctgaagaggaaccagtaaaggggaccgaaaaggagcagccattgaggagagaggacagccagacaagtgaagtgatccacagctacatgaagacagtgccaaggaggaaggagaaatgagaaatgaaaatactactgagaggttgagggcctgggctgagactggaacacaggatatagcagcatggagatcatggtgacattgacaatatcatgtcattgattgggtgggggcacaagcttgattgaagctggttcaagtgagaataagagatgaggaaataaagataggatatacgtttcttgagagatttttgctgtggggtgagaggtaagggaggatagctatttaggatgtgaagtcagaaaaatttaattttttaaagatgggggttatattacacttgaaagctgatcattatttagtagagataaagaaattgacagaagcatctccttaagtaggcaagaggggatgggacctagtgtaagtggtgggttggctgctgcattagctggagttaaggcattgcatgttctagatttgtacggagacatataggtgaatgcacacacttatgggaagatactgttattatcttctgcttgcctttgttttctaagaaatagaatcaagatcatcagatgggtgtgagtaaggggtcatttctaggagtaggagtgtaagttggccaagaaagtgtaataagattgctgagcagaactgaaagcacattgagattactatcatatctttaaagcaaaatcagccagtgtagttctttgtttttctctagattgtgtcatttgctgtggtgtagggagagagtctaaggattctctcgtaggtaatcatggtcatagttttgcaatctgaataatgtggaagtggagatgggcagccgtgcagtagggcacttgcaagggagcaatttttgggagtgccaaaggccaggctggaagaggtgaaggaggagggagtgatttttgggtggtgccctagaccaggctgaaggaggtgaaggaggagggtgaagacataaagtggggaacggaccatggagaggaggtcaagtcaatggatccagagggcactgatgccaaattgttgacaggcatgagagggaatgagctggaaattcctttgaaataaaaagttggcagctttcctcaagcttaatctcaaaagagacatttaaaaattacttacttttgctgcatggttggggaaaaatgtatttttcaagcatgagttcaactcattttgtaccagggtattcacactgatattcttgggtaagtcattaaaattagtcaactatttctgtgtcttcacccacaaaaggagacgtgtgagaagtgaatacttagtgattgttagattccactgaatctcactgctttgttgcagtttaacgagcaggctaggattgcagcgctgtcatttcagttgggccaccaagccttgaatgaggagataaaactggaagataaagtcttagtaggtacaacaaaagaagcttttgagagatcgttggatagatgtcatctatttggttgctaaataataacacacaaagaaatctctctactgtttatcatgtgtacttatcttgagaagcatcagtgattaaaaaaacaactttgaaaacataaaaatggtgaagtgtggcaatggtatcatgtggcaacggtaaaatgtgtttacccatgtaaatataatgtcacaaatgaatcttgtcattatattttgtagtatcttggaggttactggccagaactattataatagtcagattcatttcatatttatttaaaatccgcggtgttttcacatacattgtgtttttaggggaaattttaccaatgattaacatatattgtctagaagcagagccatctgaattgaaactcaaatataattgccacttttattaaatatacaactggcagactttgaaaatgttatctcagcatctagcattggcttcattttggtttctcattttcctattttattttgttcagtttagcaggggacagtggggaacagggttacaaattgcattttttcctgcattattggtttttgtcaagtggtttacaggccaaagtttgtggatctgccagaggctttatcccaaaactataggcaacagctatttcttgaaataattttagatagatttctacattgatttatgttttggggtatatgatgcacaatcccttaagtcttaatatgactattggtttaatatggcagaattaggatcaggttcactcattgtttattataatttacccatgcttgactacccaataaaatgtcttccctttacaatgatctttttctattgccatattcttcttgtccttaaaacaacaataacagatcctcaaacgtcattggggttaataaaagatgtttctttattttcagatctttaacaaagcttctccttaacccagagggttttcagaggagtaaagagtggaagtcatttgtacatgaattggcttttgaaagtggccctcattattttattttattttattttatttttttattatactttaagttttagggtacatgtgcacaatgtgcaggttagttacatatgtatacatgtgccatgctggtgtgctgcacccactaactcatcatctagcattaggtatatctcccgatgctatccctccccccctccccccagcccacaacagtccccagagtgtgatgttccccttcatgtgcatcattttttatgaagtggccctcattattaagccatgtctctgcctgttgattgatgttaactatctgcttatggtctgagatcagtgtgtactgcaaatgtttgggaagatatcttctttctgtggaggtgaaacttaaatatcttctataaaatatgcctcgatttcagaagtagcaattgtagcaatgcctgatgtgaccactttattactgccttagaagtacttttgtggtttgactgtggggagggaacgggtcactggagattttgctatctctccaggtttcatgctttgggaatcaaaggtaggtaacagtttggaaaaactctgtaggggctaaagctttttctaaaggtttttacgtctatatatacctctgtatgttactgcttcaagcccagcaactagcaattttagtttcactgaaattgtgttttctttaaatacacaagataatagaattgtaactggaatttacatgttatatataaagatatattttatttaatcttgtcagaagggttttttttttttttttttggtgcttttaagctaatgtggcatctttctcttttcaaagagtggcatctccaaggaatagctctgcctggaaggtgtttgtggctgtccacttaaaagctgaaattaggtcagtgttattttgtcttgagataacaaaaataagaccccaagggagtagtgacttgggatttcatttaagtacttaatttacaggaaaaaaaatacagtttccgatactgaataattattacactactgaataattatatattttttcttctcccggtgttcttatactttagaggcaattttttttttttttttgtaaagatcacaaaaggtctgattagtcaaagaatgaaagaaatgcactgtggctccaaagtcccttatccaaaacctctgggacagatgtattttggaatttaagatttttgtgctgagaatgatggtttccagcttcatccatgtccctgcaaaggacatgaactcattcttttttatggctgcatagttttccatggtgtatatgtgccacattttctttatccagtctatcattcatgggcatttgggttggttccaagtctttgctattgtaaatagtgctgcaataaacatacgtgtgcatgtgtctttatagcagcatgatttataatccttggggtacatagccagtaatgcgtcattcccagcaaactaacacaggaacagaaaaccaaacactgcatgttctcattcataagtgggagtcgaacaatgagaacacgtggatgcagggaggggaacatcacacaccaaggcctgtcggggaggtggaggacaaggggagagagagcattaggaaatatacctaatgcatgcggggcttaaaacctagataataggttgatgggtgcagcaaaacgccctggcacatgtatacctatgtaacaaacctgcacgttctgcacatgtatcccagaacttaaagtaaaatttaaaaaaagattttttggagtttagaaaaataatacatttggatttagcagggtttagtgcggcactttttaatcacacacactaatatttctgtagtgaaactgaatattcacactgagataaagactatgaataacttcacatcagttcaggtaaggttttgcctcctattaagtcttgataacaaactttaaaaacttaaaaaaataaaataaaataaagtttattttcaaaacttttgaagtttgcgcgtacagctagcttgtaggtctggccttgcttttctttagattatatttcccttattagtcttctaaacacattaaatctgtgtttaccaacgctgtaatattttgccaccgtgaggatggtctagaggccagcaccatccacatcccttgggagctggctagacatgcagaatcacaggtgctaccacgaagctgctgaatcacaatctgcattttaatagaatccccaggtgattcatgtgtgcgttaaagatcaagaagcattgctgtagtattatattggctttaatttagattccaagtcttaaagggaaatgctgatggggggatactttagttgtttaaatcctgggaaagtgagcccagattacactaatatcatttatttaattatgtatgtatgtattttttttttttttgagacaagatctgacggtatcacccaggctggagtgcagtggtacaatcttgactcactgcaacctctgccttgtggggttcaagccatcctcccacctcagcctccagagtagctgggactacaggcatgcaccaccacacctagctaatttttgtattttttgcagagagggggttttgccatgttggccaggctggtcttgaacttgtgagctcaggccatctgtccacctcagccccccaaagtgctgagattacaggcgtgagccactgcatctggccgaatatcagttctttttaattttttattcaatatttcctccgtctctccctcccactcttcctatttttttttttttttttgagacagagtctcgctttgtcgcccaggctggagtgcagtggcgcaatcttggctagctgtaacctctgcgtcccaggttcaagcaattctctgcctcagcctcctgagtagctgggattacaggcgcctgccaccacacccggctaatttttgcatttttaccagagatgggatttcaccatcttggctaggctggtcttgaactccccacctgttgatatatgtgccttggcctcccaaagtgctgggattacaggtgtgagccactgcgcccggcccactcttcctttctctcctccttccttttctttttctttctttttaaaaataagtctcataatacttgactttaaatggatcatttagtctatttatttacatttattatattcttgatatatttggatttcttctcttttatactttctgtttattctacttttgtttctttctcttgttttatttatttttttgagatggagtcttggtctgtcactcaggctggagtgcagtggcgcaatcttggctcactgcaacctctggcctcctggcttcaagtgattctcccacctaagcctccgagtagctgggattacaggtgcatgccaccacgcctggctaatattttgtatttttagtagagatggggtttcaccacgttggccaggctggtcttgaactcctaatatcaaatgatccacctgcctcagcctcccaaagtgctaggattacaggcgtgagccactgcacctggctctttttcttttaggttgatattttttttctcatcctattccttcctctgctagtttgttatataccctatttctctcttttagcagtaatcctagaaattgtagcatgcatactttatttataaaagtctaaattcagtcagtatcttttcttcctcctaaacaatagctcagaatgttttaactcccgttttcctctcttgtgctgtatactattcttgttgtgtgtttattctatttttaaaaattattaatcatagatgattttttaaaacttatttttttcaagacagggtcacattccataagccaggctggagtgcagtggtgcagtcacaatgattgcagcctcgacctccctgggctcagatgatcctcctacctcagcctccagagtaactgggactacaggcacacaccaccatgcccagctaatttttgtatttttagtagagacggggtttcaccatgttggccaggctggtcttgaactcctgggctccagcaatctgcccgccttggcctcccaaagtgctgggattacaggtgtgggccactgcgcccagccaatcacatatgatttggttgtttaatagtggtgtttatctacatttattcacatatttgccacattagttgcttactacgtatttttgcattttagaccttctacttggaatcaccttcttcaacttggattctttagaccttccttaactgagagtctcttcatggcaaactgtcttggattttgtctaaaaatgtctttattttgcccttattctaaactgttactaaactatacattttgttttttgttagtgtatctgatttgctggctgtcattcattgtgctttatttctctctctctctctctgtctctctctgtgtgtgtgtgtaagggagagaatttgctaattagttgattaattttccactgtgagctgttcatttttcttacagctttgttatgaggattcttccaggtctgagttacagaaggattctcctagaaagtatttaaggttgcttctgctatgtgcctgggttattaccaactgtgactcttcacattaaatttttggcttcagggttttgggactctaagagctgtatgaactcgcactgcaaactcatatgagttttcacttattatagtaaattctcaggtttgatttttttcttcttccatccatggccaagatttgagacaggcaagtttccttgcactccaggaatgtagcttgacttactgttcctggtgttggtggtggtgctgctggagatgagatccttttagccatcctatctttggcaggccctgggctttgtttcaccctgaactctgaaccctgaatcctgtgggcagggcttctgctagcccatgtggctccactctaaattgatgcaggcactcagcttgttaaagggagcactggatggatttcagcaagcttcctgttccttatggttctgtctggtaggccttaaacctaggctcaagtactctggagttaaacaagtggcccaaggcaaaagccagcttcagtgcttaacttacttcgcagggattgtatgtatgtatgcatgtgtatgaatatatgttatgtatacatatgtatgttttgtgcgtgtgtatttcaccgttgagtgttaattactcccttgttacaactcattgatgcatttaaataaaacatttaaaatattttattcatctcctctcatggttttcagcaaaaatgtaggtcagggtaaattaccagatatattggaccagctggatgtagtcgcctttgatttttttttagttctaccacctatgtatgtatcaataaacaatgtattctttagtgcttccttatttttaaacattatgtgaattgaataacttatgtaatcttttgcaatttggtttcccgcaacatttctatatggagtatggttcgttcatatttactttataccaatatatgaatttctttagctattcaacacaatttaactattcagattccactgttgatggacttttggattctttccaatttttgctattggagttttccagttttgctgctaagaacactctcgtacatgtcttctggtgcattgtccaggattttctctagaatatattcctgggggtagaattgatgattcattgagtaagcatgtgttgtaccttactaggtaattacaaatggctttccaaagtagttgtaacaaattatgcttccattagcggtacacaagagtttctgtggctccatgtccttaccaattcttagtattgtcaggtttcttaattcttgcctattaggtgggtggacttaatacttcttagtttagttgttataacttgttttttaaaattaacatatctatgtgcatattcgtagtcatacatgtttgtctggtcatttaggtacttatgcaatactctagtagactcagaatagaaattagccatggcaacatatatattacattcttcatattgctacatttgaaaataatcataattatttgcagaaatatgaacagaacatatagaattaaatgttttcacgatgtcttgtattatctttcatgtttcatagcaatctctgtgttataggccacatcaactgcttttgcattgttctgacttacaggaattgcagatttattgttctcagtgccatatttaagttccttctctgtaacaatcaggtgtaatacttgtaaatttttttaaccttagtacaaatttaaaaagcagaaatttctcttgcagcttcctgtgtttcaggcccagtgctaagcacatggcaagcattgtcccatttagttctctccaccatgcttcgggcaggtgctgttgttaagcccctttcatggaggagtgaactaaagcatggagaggttaagggtcttgatcaaggtcccacaatcttattctcaatggaccttctccttctctaatctaaaaccctcattttattttgggaagtggatgtaggtctaggaagcttgtttgtgtgtgtgtagtttgtttgttttttttttttttgagatggagtctcgctctgtcgccaggctggagtgcggtggcgcaatctcggctcactgcaacctctgcctcttgggttcaagcaattctcctgcctcagccttctgagtgctgggactacaggtgtgtgccaccatgcccggctaattttttgtatttttagtacagacggggtatcaccgtgttagccaggatggtgtcgatctcctgacctcaggtgatccacctgccccggcctcccaaagtgctgggattacaggtgtgagccactgttcttggctgtttgtgttttatattaggaggcagagagcacttaggggaagcagaagctctggtctgaggaggcagtggtttacttattagttcacaggccttttaggtaatcactggtccttcacttaattaagcaacttaatatatgtcttacggattaagttaattttaaatcaatgctaatttttatgtcaaaatatattaagcagcatcacattaaagtcaaaggtagtcttgtaattattagagcaataggtatcgtgctgtcgttctccaatgtggctgcacattggacaacctgaggagctttaaaaaatactgctgcctggggatcactcccataagctctgatttatctcgtctggggcaccaggagttttaaaatttctccaggtgatctaatgtgtagccaagcttgaagattactcgatagtcattgattatgtgcgtgccacattcagattggtggggttcaaatcctccttctgccactcactagatgtgtggccttagttaagttttgttaacgtttctttatgtcttcatctgtaaaatggggatgaatgataaaaatactgtctgcatctcagagcattgttatgaggattaaaggggtacagtaagtccttatttaacgttgtctataggttattggaaactgcaacttttaagtgaaacgatgtataacaaaaccggtattaccatagattaattgacataaatgagagttaagttcctgcagcatatttttggtcctaaaagtattatcagacttctacataaagaccaaaacatttctaatattaaacactgagagaaatctaggttatacatacatttaagaaagattaattcaatcatttactcaattattcgactccagaatagtgggtggtccgagcctgtcctggcagctcagggtgcaaggtgggaccagccaaggacaggacaccatcccatcacagggcacactcacgctcatccacactcacactgggaccacttagacatgccagttcacctaatgggcacagctttgggaagtggagaatgtgaagaaaatccatgcagatgtggtgagaacatgcaacctccacacagacaatggccttggctggaataaatttttttttctcacaaattttataatgaaacaatgttactgtaggacctgctgtataatatatacatattaataaaatgcttggaatagtgactggcacaaaatagtcctttactgtgagctattttaagtagactaagaaaaaattattactattattggatattctctcaaaagtatcttgggggctaagattttaaattaaatcaaattttgcctagtactaagcccactttggtgttttcttggctttgtttaatttttttctccatggttttatttaaaagttatttctaatcaccctgtcaacttagcagatatctgttggaatcatttaaggtgtttgtttccaaaagactgcagaaattaaatcaagatatttgcagaggaatgactgacagcttgcaggtagactggagaaagtgcttcctaccataacagacagaaaaaatggtagtacaagagtcagcatttcttatttatttttctatgaggcagggtctcgctctgccgctcagactggaatgcagtggtgtgatcatagcgcactgcagcctcaaacttctagactcaagggatctcctgcctcagcttcctgagtagctgggactataggtgcttgccaccatacctagctgattttttgtaggggtgggtagagacagggtctagctctgttgctcaggctggtcttgaactcctggcctcaagcaattctcttgccttgacctcccaaaatgttgggattacagacatgagccaccatgcctggccaattgagcatttctttaaactggaaactagcacctttataataatttcacacataccattattgttgaaaatagtcagattttcagaggaaatctctattaacctaagttgtataaccttttgaggttgtaccagtgtagagcctgtttttccgagcatctacatgctcaatgctattttttcagttatccagcatccccccacttgtttctatcctatctcatatgcaagagggtgtaaatgtttttgtgcattgcttttacatttttatttatctctcaagtgggcaagtaagacagtcatcaacagaggttgcatttggagatcatattctgttttttctttaaactatttgatcatttcagagaaactttattctcagttctgttttgtcttcagctgtcaatatccctgactccaggccctttatttagcttccattcttactgatgtggaaacatacttttaaatgaactgcctttaaaaagaaatattttagtaaagtgaaggatctttttgtaatgcaaataatgttttgttcaggattttcttgagaaatctgccatgttctctaagcctttgcctccatactggatgtggctttgccttttttgttgtgttgaagggcatgcacagatatagtttctgattatttttctcagtctgatttctccaattaggcatattatcattagaaaactcgcccattttcccatggtgtttaaaagtaaaccaggacttgtgacactatgctactcggcatttatgaaatgtaatttaattactttgtttccattgtgaagactcggtttccttatttcctatattcatttatttattcattattggtatacccaacaagataagtaaatacgatacagccttgcatttgacaattttatggtgtgtatgtatttatcatgcctgaactgtgactagacttaagatgaagatggtacctaaatcaagctcttttatattttgtctttcccataatctagtctgtcttttctttcccacaaaatagaatgggatactttttattataaatatatgacatgttcactataaaagagaggcagtaaaggaccagagaaaatgacctgtgatgccaccacctagaagtaatcactcttgttaacatcttgttatttacttgtacagtttttttctgtgttcataggctgacatttttccttgcagatgttctctctctatattcatacaaagctgcagttgttcaagtcccaccccagcctctggaggtccaggatgaatgcctccctctttctgtcctggtaccttacgtgacctccggacggcagtgtcagtgttggaaatggcaggctgctgcaaatatgctaaaacctcatcagttgtctctattcgtctgaccaaagtccgtgggaagagcaagatgctggtgatatcctggagctcttctgacacaaggctctggctagccttgatacattcctcaaattcttccttccaattctgaaaccttttgttttccagacaataaaaccctcccaaactcctacctagacattctctctaagcagtcctgggagaccacatgtgacttgacttttaactatctttacagcgtttacattttgctccttctttttgtcatgccattactagagggaggatgggccatccagagcagcgtgcgccctccacaggcaccttagcctgttcttcactccgccatgattgaaagaggagaaaatattctatagctgttccttttctgttcttggctttttcactcttactgaccttacaagttttatttttccatttctgaatctcaattattttcatttctcctattcagtatagtttttaatagatagcattgcattacatggatgtcccttatttaatcaactgtttggtatttcttttctgtttttcaaaatctaatgaacactccagtgaatatccttttgttcgggatttatctctagaaggaagattactggctaaaaatatatgtacatttaacattcatatacatatctatacacacttttttttgagacagcgtttcactctgtcacccagactgaaatgcagtggcatgatcattgttcactgcagcctctacctcctgggctcaagcaatcctcccacctaaacctcctgagtagctgggactatagacacgtgccatcatgccagctgagtttaaaatctcgttttgtagagacatggtcttactatgttgcccaggctggtttcagactccttgggctcaagtaatcctcccacctcagcctcccaaagtattgggattataggtgtgaaccactgggcctggcctatgtatacataattaggctatactgtctataaaatttggctatctatagtcaaattattttatatgcatatatccaaatatacctataaatagccaaattatacatatacagccaaattttatatatatatatatataaatgttatatatatatagccaaattatataaagctgtatatatagtcacattatcctacaggaaatgatgtaaatgtaccaatttacattcctgtaacagggcattagaattccctttttccagagccttgccaacactggttatttataaccctttcaaactttgtatgaaagttgtatgtattttaagataaatgaaaacttatattgatttgtaattatttattggtataattgaacacctttccatatctttattgtactaatgtgtatgaattccatcttaatagttttgctaacttgtccattgaggggtttcctactgatttgtaatggctctctatataaaaaggatgttaatttttgcctattttacagtaatagtacaaatattctctcatgttttctattagtcttttaacctttgtttagttttttttcgttccttcataaatgctaaattttatgtcatcatatctttcagtccttttctatattatttctggctttgatggcatgcattgaaagcccttttccaccccagagttatcaactcgttggaaaatgatgttgaaatgtcacttttaatatttactaaacactcttgcctaatttgttctattttgaagccctttaattctgtttctttaatctgcctgtcttttttttgtgcctgttccttactgtcttgactactgcaggcaacatacttacatctaaagaacaagcacacctattctgcccttttgctaaacaaattttcagcctctttttcaatgattattttttcaaatcaatgttaaacatcacgtaaagtttcaagaaaacccctaggggtattagtatttagagtgcattaaatttttagctaattcatgggagaatttgaagtattatatcttctaatttaagttagagtacaggaattgtctgtctttatccctctaagtacattcagattctcaagaatagtaccaaaattctcagatccccctctaccagtatttttctcccactgatggctcttcaaccctaaaatgtcttagtggtatggtttggatctctgtccccaccaaatctcatgtccgatcgtggtccccactgctggcagtagggcctggtgggaggtgattagatcatggggaggcttcttatgaatggcttagcaccctccactttgtgctgttcttatgatagtgagttctcatgggatctggttgttaaaaagtgtgtggcacctccccaaaccccttgctcttgcaccggccatgtaaggtgaggatgcttcccctttgtcttttgccataattctaagtttcctgaggcctctccagaagcagaagccaccatacttcctgtacagcctgcagaaccatgagtcaattaaatcttcctttataaattacccagtctcaggtatttcttttcttttattcttttctttctttcttttttttttaagagatggagtcttgctctgtcgtccaggctagagtgcagtggcgccatctcagctcactgcaacctccgcctcccaggttcaagtgattctcccgcctcagcttcccaagtagctgggattacaggcgcccgtcaccacgcctagctaatttttgtatttttttagtagagacggggtttcactatacgttagccaggctggtctcgaattcctgacctcaggtgatccacctgccttggcctcccaaagtgctgggattacaggcgtgagccactgcgcccggccaggtatttctttatagcagtgtgagaatagcctaatacacctagcctgatgttacacttaggatcctcttcattattcttctgaatccaagcctccaactttatctacccatcacggttttagcttatattttgattttatttcttacatcttcccttatatttattattttaatattttgtttctcttttctccttctatacttgtactagatttatcagaatctgtaaatctcttttaaccctattaatttgttaactcagttaaatatatctattttgccaatgctcatcttcctatttttaacagtcatatatcaaactgtatttctcaactgatgtaccaaaattaaaggacacctagatgccctccctcagctaaagtgtttactactgcatccaaacccatgaattctccctaactgagagaggatatttagagggcctttgtgccttttttttttccccctatttcttccttgaaaattctggagctttttgaaataatttagaattttacttttaagatattattaaatttttttctacagcatgcctctgtttaaagaatcaaagctttttaaacatatcactagtcacatatattatctgtgtagacttagctatattatcatatatttatttttataaagatattgctcagcactattcttttacagttttatttatcttaactgacaaatgaaaattgtatatatttatgtatacaacatgatgctttgatatatgtaggcattgtgcactggctaaggtaagctaattaacacatgcctcacctcacagacttatcatttttttgtgagaacacctagtgagaacacctagaagtcacccacccagcaactttcaaatacattgttattaactgtagtcaccatggtgtataacggatcttttaactcattcttcatacctcactgaaattttttgtcctttacccaacatctcctcagtccccttacctcctctagactctggtaaccactgtttgaactctgttcctatgagttcaactttttttattctacatgagtgagatcatgtgatatttatctttctatgcctggttcctttttcacttaacattaatgtcctccaggttgaccatgttgtcataaatgacagatatccttcttttttaaggctgagtagtattctgttgtatacacataccacatttcctttacccatttgtttgtttttgaacacttaggtggatcccatactttgattattgtgactaatgctacaatgaacacgggagtgcaggcaactcttcagcacactgatttcaattcctttgggtatatactcagggattggattgctgtatcatatggtggttctgtttctcattttttgaaggaccttcagaccatttccataatagctgtactaatgtgcatttacatgagcagtgtacaaagattcccttttctctatatcctagccacacattatctttcgtctttttgataacagccattcgaacaggtgtgaagtgatatctcattgtggtcttaatttgcattttcctgattagtgttgttatttttttttcatatacctgttggccattcatatgtcttcttttgagaaatgtctattgaggtcctttgcccattttaaaaattgttatttactttcttgctattaagttgttcgcattccttatacattttgggtattaatccctatcagattatgatttgcaaatatattctcccattctatagattgtctactttgttgtttcctttgctgtgcagaagctttttagtttgatgtaatcccacttatctattttttgcttttgttgcctgtgcttttagaacctgatcaaaaaattattgcccagactagtgtcttggagcttttcccctgtgttttcttctagtaattttacagtttcgaatcttaggtttaagtctttaatccactttgagttagttcttgtatatggtatgagatgagggtccaattcatttttctgtatgtggatatccagttttcccaacaccatttatttaagagacagtcttttccccatgtgtgttcttggtacctttgtaaaaaaatctattgaccattgactatgtggatttatttctgggctttctaccttgttccattggcctaagtgtctgtttttatggcagtaccatgcattttgattactgtagctttgtagtagtttttgaaatcaggtagtgtgatgtctccacctttgttctttttgctcaagattgcttggctctttggggtcttttgtggttccatatgaattttaggattgctttttctatttctgtgaaaatatcattggaattttgataaagactttgaatctgtagattgctttaggtagtatggacattttaccaatgttaattattccagtccatgagtacaggatatctttccatacatgtgtgtcttcaagttcattcatcactgtcatatagttttcagtgtacagatttttcaattcctggttaaatttacccctaagtactttatttatttatttttttgctattgcgaatgggattgttttattaatttctttttcagatagtttgttgtatgtggaaatgctgcatcagcactaattcttacatattttatcttcttgagatcttttctgtttactttttatttgattgagatgctttcttagataccagtattggtatactttcttgagtttgtttctaaattatcttttcctcctcaaatatgtatttctgctgttctggtcttggattgcagttctctttattcagatgtgtgtgaacactgttctattgttatctgtggtcaagcattgcagacgagaagtctgatggtagactaattattttccctttttaacttacttctcttgtctgaatggaaggctgtagaatttttctctttgtctttgaagaaatttctctagaatatgtccagatgtcttttttatttagcctgactagaatgtctgagcctttttatgctaaaaatgcaagtctatcttcaactcagcaaaaacttcaaactgaaaaccgaagttttaaaaccagtgaagctttcttccacttttaaatattattaccacacctacttcttctcgtaattttttactttttttttcctaaaaaatgtagaaagtacagaaaataatgcggaaagttctcatttagcccaagcagagagttaaaaagataatcttttgtcatatttgttttagatctttttttaacagtatggttatattttaaaatgcctagaagactggagttaaagtcattcagttatttcttaatagtacttagagagttgctcatgaattggaggataatgaaatatgagacatgccagagcaggagaaggaaattctaggggctatttggggtcttttgtggttccatatgaattttaggatttaaaaaaaaatttctgtgaagcatgtcattggtattgtgataaagattaattgcatctttagatccctttgggtagtatggacattttgacaatattcttctaatttgtgaatatgggatatcttttcatttcttgtatcttcaattaatttcatccatgttttatagttttcattgtagagttcttttacctctttggttatattcattcttaggtattttttatttgtagctattgaaaaaagattgctttcttgatttctttttcaggtaattcattactggtgtatagaaacacctctgagttttgtatgttgattttgtatcctgcaactttactgaatttgtttattaaactattagatgatagtttaatgataaatgtttaaggtggcagatatactaattaccctaatttgataattacacaatttataaaagtattgaatcatcatgttgtaccccatacatatatatagttagttattatatgtcaattataaataaaaaattatatactacgttggttttcaaaattaaagtaataattaaaattcgcaaatgatgggaaaaaaaccggaagttcttgggggaaataagcatatttcacagtgtcatggaaattgagtcctgaatgtcaatattgtttcataaatacttgtaacatacaatgcaatagggatactacatcaggatgcttttggctccaagttacaaaaaaccccaactcaaattggcttaaagagggaagacatttgctcatctcacacaaaaggctactcagctttgcctcaatccaagccatcatgtaatcacatggtgggtatagaaatttgaggtgtacttacacctgtgtacatacctctagatgtaccagtgtcctcaagaataagaaatgccatttgccttttgtgtttcttatttagaagtgagaaagtcttttccagaatctccctagaaaacttgcctataaggtctcagccacaattcactcatacgctcattcttgtaccaactggtggaaagaaagaatagaattcacgggaattctattgaatctgacacagattgatctgacatagatcaacggttcccaaccaggtggagttttacctccagaagacatttagccaagtctggaaacatctttgtgctcgctggggtcccctactactggtatctagtgggtagaggccacagacactgctaagccttctacagtgcatgggatgcttcccacaatacagaatgatctgattcaaatgttaatagtgtcaaggttgagaagccttaacatagaccagttaggatctcacccttcagggccaaggaaagggctgtttttcactgaagcacagggctaaggaggggctatgtggatgttgtgtagcccactgggaatgcccactgccatgacgtccctcggatggagctggtcttctgagctgctcagaaagggaagctcggatttgtgggttttaggctactaaaaattaaccaaccacattgaatttcatgtttttctaattcattcctagtcttcttgcctgttaaactttctgctaaagataattctaatgaatttgagaaggtatttataaaagaatatctgtgaggctgtgtgttgcttgactggcagccaaaagaaatgttgcttggggaaaatggcacgaattaaacattgattgcccatcagtcttgtacttggggtctggggtagtctggaatacaggtagggagatcattcaagcttcacagagaggttcactagtacttataaatccaagcattgggagttgagaattgccagaaatagtcatgtaatgatattccatgttgtataggtgtttgcatttcttcctttctaaaaacacagtggttttggaaataataatatcctagaacagtggtcctcagctttttttggcactaaggacaagttttgtggaagacaatttttccctggatcttgaggggaggggaggatggtttcaggatgaaactgttcccctcggatcatcaggcattagattctcataaggagtgggcaacctagatcccttgcatgtgcagttcacaatatggtttgcgtttctatgagaatccaatgcccccactgatctgacaggaggtgaggctcaggtggtaatgctcactcacccaccgcccacctcctgctatgcagcccagttcctaacaggccacagactggtagcagtacatgacctggaggtttgggacacctgtcctagaacatcctggattaagcaattaaggatctctgcaaatcctagctccattgctcaactttgaaaagttgttggactgttttcagctttgggtacctcatttgtaaaataaagaaattgaattacaggcacttacaggtcctgcaattccccgtaactcagataaaaaatagatccctttctcccttcaggagaactcatgactttggtagcagctagagttagcatttgctcatgcttttattgtgtttagcaatcaatgggaagtgcatcaggtgaaatctctcaggcctgcatatgtctggtcaaagctcattcattgattttttttttttcctgctgaaacttgcacatatataaaaaacgaagacactaaatttaattttcaccagctcagtgtatagtattgtggctgctcatgttcctgaagagcgagttgttctcaaataataaactaagctgtataatctttaaaatatttgaccaggtgggaagcctttctgtgaggacaatgtgtttgtgcgtttggtgcttaagcttcaatcccctggccacagcttggatttatttgcaggggaaatctgctacgtaagaagacaaccactttgggcaacattatcttcatcatcagcatgcacgtgtggtaatgacctgttatgagcctgacttggaataactttcttcctcacagaatggtggatactccatatgtgtagaattactgagagtaattatctttgcaacagtaaggcgtgagggtaagaaatcaataaagcagaagggaaagatattaacatttatcgaccactttctgcatgacagcagaaggcggtcaataaatggcatactttattttaatcgtattaggtgattattgcagtattatcttaatttatgtgtgaagaaattgtggtccagcgaggttaagtcacttgctcagtgtccctcagtattaagtgataaagcagaggtatcaacctaggataccctacaaggtttggcttccatctggaagcactgagtacctgggcccagatatgagacagggtcccagcccagagatttgttggtttatcattccttcagcaaacacagcttacttccaagagtgtagaaattggggctgtgcttcatagcaagataataagcatcagaagggctgggtgtggtggcttatgcctgtaatcccagcactttgggaggccaaggcggttggatcatttgaggtcaggagttcaagaccagcctggccaacatggcgaaacctcatctctactaaaaatacaaaaattagctgggtgtggtggtgcacacttgtaatcccagctacttaggaggctgaggcaggagaatcgcttgaacccaggaggcggaggctgcagtgagcccagattgccccactgtactccagccagggagacagagtgagacaccatctcaaaaaaaaaaaaaaaaaaaaaaagccatcagaggagctacagtgatgctggtgaggcagacatttcctgactcatagcaggttacctttgtttcctcgttataatgagaaaaagttgccttccctggacttcctcctattcatcttttttttcctgtcctcttcttgcttaggatgccaaggctgtgacatttatttctgctctcttccctttgagatatgctgaagtcatttaaaaaaatgtcaggaataaaatgcactaaatgatgactgtcttagaaaagactccagttaagctgtgtgcatccagaaatgcaactgtgctgaccagtttctgcctcccttgccctactgataacatgatgggagatgaagtcgtttttcaaaagtgttctgggtccagagacgtttgctcgacacctgtgccctccattggtctaaaggcattagagtttttctcccacaatatttgtctttgttattttgaatttatgacaccctggttgttggtgtttttctttgcattcatacctgactcttgacctccaaaagaaccagtacatacattttactttaagctgggcatttttgtaatactatgcaaccttgaaaataatcgcagtgatattttgcttttttataaggccttctatccttctttgctcttgcatctctctttcccctttatgacagtatagcagaacatatttcattcttccctgagccctctgcagagcaattttgtaactgatttgagccatgtttttgatggagtatctgctctctggacctttccatctcctggttgcaactgtgaaccaccctgcctccaataatctacatccaaaatgctgagcaggagatttatggaatttgtttgaagatattccctgaactctctgaagctaactagttcctttgcaagtaagtggctggaaacctaaagatcttgtgaactgggttctagaagcatgggataacaaatgtaagatttcagactggaagttaaaagcgagttttcctcttgattcagtttctaaccagtcagctaaatggtctctgaatagttgtagctaatgagcaccatcccccaaacagtcaattgtcttgactattaaatacttaaatccatgtattttcgctggagtgtttattactatgtgttcttaggaccataattataaaatgttaagttaggacgacacagaatatttttctctgagtatttttgcctctttcatcagataagatgaaattcatttttattttattttacattattatgattattattttgagatggagtctcactctgttgctcaagctggagtgcagtgccacgatcttagctcactgcaacttctgcctcctgggttcaagtgattctcttgcctcagcctcccaagtagctaggattacaggtgcatgctaccatgcccggctaatttttgtatttttagtagagacagggttttgccatattggccaggctggttttgaactccttacctcaagtgatctgcccgccttggcctcccaaagtgctggaattacaggtatgagccaccgcacctggccgaaatgcatatatatatatacttttttaatggaatgcaatggaatattgtgaagtagtaaaacatgaataaactatagatacatacaacatgggtcagtcttactaatgactgtgagtgaaaaaggaagctccagagaaatacgcgtattatagcttggttataaaatttggaaacttgcaaacttcaacaatatactttttttttttttaaggaagaaaacagacaaaattcagaatagtggttatagttggggtgaggtgagcccatgagtaaatactggtaatgttgtaatttttggactaaatcatggattcgcaattcttcattatattattaaaactaagttttaaaagacccacaaatgggccagtgatgatagtttttccagaattgatagccatcaattctgatcatccaggatccttggaaataaattgcatggatgagctcattcatcacaaatctggggtctttaaagtttctgctgttcccagttctttggattcatagctatgatccttagagggcaacagatctctcccttctcatggcagaaataaaggtcagatgagaatgggagagccatcagatagagaccactgtggaggagtttgcgctttgggctgagcaaagagaagaccagaatcttttggtaccatctccttctgcatttgagatgaaacttagtcttttaaaatacatgcagccccagtcctctgtgttgccagtcacctgagctacctttgggggtagggttttgattaaatggcacgctttgctcatgagtaaccttcggggcacattttgttggtaagaaataaatgcatcactcatttgaatcagagctgcaagtgccatctgtgatgcactcctccttcccattatcacacaaatgtgtttctgtgtgactggttcctggattttgcaggctctcttgccttgcgccgattgctggctgagaggtctcagctcagcgttcaccacgtatcactatatttctattaatacttctgctcttcttggcaaaacagaagtggggcttcatttgaaatgatgggctggggagaggggaagggaaccatctcactcatagttattgacatcaagctaccatcatctcttgttcggataactatgagatttttctgctccctttatgcccccgccccaccccttcccagccactttctgtcctctgccagagtgatcttgtgaaggcttcaatcagaccagatcattctcctgcttaaaaatccccccgtcgtttcccgttgctcttagaacaacatccacactttttatcctgcagtagggggctctccatgctctagcccctgcctatgttcccctcctcatcatgcctttctgccctttgttcactatattctagtcaccctggccttctttctgctcctcagtcactccaagctcattccctctgcaagaccttggcatatgccatttcccctgtcaagaacgttcctgctctaggtcttcgcaaagcttacatgttctcattgttcaccgaacagtcttccctggccacccaatctaaagtagtccagccccacctcgaaggacactgtctcattgcaccttttattatcatcactgcatttaccattctctgaaattattctattcacttgtgtgtttatggctgtcctgattagaattaattttcataaagagaacaagaatcttgactggttcacccttcaattccttgtgcccacaacagtgactggcacatggaaagcattcagggaataaaagcacaatggaaaattaaaacatactcactgcatgcctgccacctatagaaccaaattaaatcactgccaatatgcatggggaaaaccttcccatttttctggaataatgttacaaaggatggaaaataagtgcacatcacctggatggcatttaataaacgctgtgacccagtagtgtacatttcagtgaatattgccaaaggaagtaggccaacatcaggtaatctgagttaactttcctgtacattgtgtattcgtttcctgatgatcaaaactggattaattagtctacaatgtatctttcctgttagatacgaagattatctgctctatccaatttgtgttttcttagctgagaaatcactgttgaattttaaaagcagcttgcctggtcctcatttcctggtcttctgatggaaatggtttatggaaaaaaaaatatttactagagtcagataattagaacattttatgtattttgcatatgctaatgcgtttgagttcctttgagggagagccgcatggcataaagcagaatgaaaaggatgattcaaatttcttcacccagcctcctcccctggccagatttagcacttcctatataccaccacctcacagcttagcttggctgggagctcctcaggtttccaaaggacggtccttccttctccctcccccaattgccatccctacaccagggtgccaactcccaagtgggctgacaggaagggagattggaaacagctttatagtagatttgatgctgttataagacacgttgtaagacatcaggtaaatatagcacatcagattttattaatcataagaattctttaaaagccttcagcagagccgagatcatgccactgcactccagcccgggtgacagagcaagactccatctcaaaaaaaaaaaaaaaaataaagccttcaacagtggctaaacacaaaaccagaatccctttagatttcttaaaatgcctttgtagttcttttgtaatatgggtccttgttggacaaagttagtaatttgttttttatatcctttacattaggggtttctaacccccaggccatggaccagtaccggtccctggcctgttagaagccgagtggcacagccggaggtgagcagcagttgagcgagcgttactgcctgagctccgtccacctcctgtcagatcagcagcagcattggagtctcacaggagcgtgaaccctattgtgaactgcacatgcgagggatctaggttacctgctccttatgagaatctaatgcctggtggtctgtccctgtctcccatcacccccagaaataaagtttctatgattacaataaatgtaacacacttgaattattcatcccaaaatggtctctcccgactccccactatccatggacaaatcgtattccataaaaccagtccctggtgccaaaaaggttggagactgcttcttttaatgatcatgttcacatacggacagtgaaaaggtgggtcttcttagaggttaaagggaaagtaggacagttgccacaaagctccctttttggagagtgcccagccagggagtgttactagggcccaccttggccttgctgatgtcttcagtggtgtccttgaagtcagcatgggattggcgcaggctcctgttggggcactcggtgaaggtcctccctcctccccagtagctctcatttccagggcccttattttcttttggccatctgggactgaagtcttgctcctggtgggctatctctgttgccctatcacctttagtgatttccactaaataaccctcttttaagcatttaggggaagagggagtagcatgaacgtttattgtgcagtggggtgagaaagtcagtaccagtttcaacacgccctccagctgccttcctccagggaggggacttcacactggctgtctccacagatctgcagtgcccttgccatagctccaactcctggccttctcccactccccgctgcctgctggcacatagagcccttgggccattctctgtgtggtattggcccctgcctttgcttatgctctctgctgtaagcagctaggcttagacttccctaagaggagtcccggacaccactgaggatgcattttcccttcctcacgtgaagagagcattaggtgcccttagctttggagggagtggagctttggagcctggagacaggggaccaggaccagattacccagcctccctagattctgctgaactcatctttcagtaaagaggccagatgagctgagctccacttctctctggctccatgttcctgtgacttttgactcatctgaggttgactttgagaaggcaatcccttttaaatatattggaatccatgtagtatgaccctatccactgtggaatcttactccattttactttaaagagaatgtaaatggtttggctgcacatcactatgaaaatggcctaagtaagcagaacggagaagctgccaggagagcagaggtggagagtggaaggggccaagccggttctaaatcgttttctgcaggctcctgtcctcagatgtactcacttcatgggaaccaaatcacatttaactgctctccagctcttaaaacaggataacttgagccatctgatatttgagaagaatacagcaacccagaagatgtattaatactctattctctaattttccagaataagtcagatcattgacaaatgacatacttgggctgtattaccttcctacagaaagactttcactaggtttagtaattagctatagcttcagccttttgttttgttttgttttgttttgttttgttttgtttttgagacagtctctctctctctgctgcccaggctggagtgtgaaggtgccatctcggctcactgtaacctccgcctcctgaattcaatcaattctcctgcctcagcctcccaggtagctgggattacaggtgcacgccaccacacccagctaagttttgtatttttagtaggtatggggtttcaccatgttggccagtctggtctcaactcctgacctcaagtgatccacccacttcggcctcccaaagtgagcttatgtctttttgaaggatggctatgggaaaagtccacttgaaggatgttttgtcatttatttacttactgattaattaagatgggaaagtcttgctatgttgcccaggctggtctctcgctctgtcatccaggctggagtgcaatggcacaatctcagctcactgcaacctccgcctcccgggttcaagtgatgctcatgcctcagcctcccaagtagctggaattacaggcacctgccaccacgcccagctaatttttgtatttttagtagaaatggggtttcaccaggttggccaggctggtctcgaactcctgacctcaggtgatccacctgcctcagccccccaaattgctgggattacaggcgtgaaccattgcgcctggcctcagctccctttagtttttaaagatagacttcctatcttataacagttttagatttacagagcagttgcaaagatagttcaaggagttcctgtattctctgcatccagtttcccctattattagcaccttaaaatagaatagtacattggttacaatgaacaaaccaatgttgataaagtatgtcaactgaagtccatacgtttttcatttttcctagtttttacctagtttcctttttctattccaagatcccataccatattacttatagttgttgggtctctggatcctccacagcaatttcttagacttgccttgtttccattatgaaacacttcagacataccaaaagtgtgtgtgtgtgtgtgtgtgtgtgtgtataaagaataccaatataaccagcattcagccctggaagcagaacatgaccaacatgattgaagcctcatgtatatccctcttgatctctttctccttccctcttcaaggacgaccaatatcttaaatttggtgcttttgtcccaggcatgttttgaaacgactatatgtagtgttgctttgcatattttattttatcgagacaggatctcactctgtcacccaggctggaatgcagtggtgtgatcatggctcactgcagcctctacctccccgggctcaagtgatcctcctacctcagcctcttgagtagctgggactaaaggtgcatgccaccacgcccacctaattttgaaaaaaattttctacatatgaggtttcacatgtcgaccagggtggtcttgaactcctgggttcaagtggtcctccctccttggcctcctaaagtgctggcactacagcagtgagccactgcccccagcctgctttgcacattttaaaacaatataagtattataagcattgctctacagtttgcttttttccccccacataacatgttttaatctgcattgctctaatgtatctagtttctaagtcagactctgttgtatgaatcccctctcttgttgatggatatctaggtgttttcctttctgttgctgtcatggtcattgcaaacagtgctgaacagacacctttacaagtcaccttatgcacgtgagcaagcattctacttggggagaggaattttggggtttcaaattttatccttaacaaagcagtttattcattcattcagtaaatattgattgactatgtaaaaactgagccaggttctagaggtaaacagaacagaaataatccttcatttatcatgagtttacaatctaattgggaaaatgaacattaaagaagtaattaaagatatgtatgtactatacagctgtatcataaaaataaagaacaatgtattgtgtgccatgaaaaaaatataaggcttattaagggatgtttcttaatgtttcttgtatcataaattacctaaagaatttctggacaggaaaatgctactctcctactgaatttatgtgctttctttatcgaacaatggaagcaatgtaaagcaaagtgtttcttttttgccttagctactaggagtagctctcatgtagatgctgtgcccagctgcagtgcctggaacagcccagctacatttagtatgtttatattttggctttttaaataaatggttttcatattgttctatgtcttgttttgcatgctgaatcattttgaatgtaaatgaggtatagctcttggagagaggacaagatatcattgataagtggttggtgacccccacttttcttttcagagacaaatgaccttgcttttacttggtcttgctgtatttatatagggatcttactgtatttgcatgcttgcttaatttcaatataaatttatgaaatttattatccatcaagagtcaatttgtcctctaaatatttcacttagatgatgattttttttaatcaccaccaacacatacacaaacagaactccttagcaattccatttggctgtactgctatctttaggaacatttatcttgctttaactcctctcttttttacagacatttagttttctgtgacattgtttactttcgttataccttaattatgggattctgataaccatggaggagtaggagagacaataaatggggttttgtgggtgattaaatgctaaagcaaagctgagatctttgataagcacaacagttgtttctgccagtatattccaaaggcaagactattcttgcaattacacaacaagcaaggggggagaaacacctcccacaaatcactctgatatgtttcttaaccactgtgcttttgaaagcctaatgctctttcttctgatgtttttttgactgtcagcctgagtagttggctcttccttggtacgaggctatttaaatgacaggtcctttctcagtgtgaatgtgtcagctatctaaatgagtggttgaaaatgtacctccgcatcagccatgtggaccacggcatggtctgaagaaaattatgtttgagcagctatgattgagctcaattttgcaaaagcttactgagttttaacaaataatttagccctatcaagcagaagtgcatttggctgcaggtaatagaaaactgaatcattggtggttttagcaagtaggttttctttttctcacatgacacagattggcaatactgtcagagacccagtttcttttgtgctttctgctctattttttgtagtctttcagcctttatcgttgggcttattgtctcagggttgcaaaatgactggtctgactgcagattttctaggagggaagtgcaaagtggtggtgctggccacagctttccttctttgtcaggacagcaaaagtttcatcggaactccccagtggacttgctctcttaattcaaaatggctgtaacagtgtcacgttggctgcacctgtttcaaagaaagttcagaaaattgggtatttcacagacacattaagatttcaaacaaagacgagagcattcacaaggaacagagagggaacgtatgtggatggggcaagtaactgccagtcatcagcctgttatgtactgtacacatagagttttgctgtgcagcagcaaatataaaaatgaatgtcatcaccatgaaagtggaaaaccgtatttcaatgtcatgcaaatgccataattgaaatgaaaagataggaaatgctggtgcattgtctacattaatgtatttggttgttgactttattgcataaaaagtatcagtggggacgagatagttttgctttgtttcagaagattttgcttttgtttttcccagctaagaagggaaccttaaaaataatgaggagggccgggtgcagtggctcacgcctgtaatcccagcacttttggaggccgaggcaggtggatcacttgagattaggagttcaagaccagcctggccaacatggtgaaaccccatctctactaaaaaatacaaaaaaaattagctgagtgcggtggcacgcacctgtaatcctagctacttgggaggctgagggagggagaattgcttgaacctgggaggtggaggttgcagtgagctgagattgcaccactgcactctgcactccagcctgggttacagagtgagactctgtcttaaaaaaaaaaaaagaaaagaaaaacacacagatgtatgaaatagagcttattaattctgtatatattcacagaaaacgcatacttttatgccttgattatctttaggtgatcatggggaacaggagcccaaagataattaacaactgtgctaaaacaacaaaacctcaattgggctacaaatgtcaatatcatgtacacaggtggaaaagactcttctttgatttcatatttttcttttatttccttggcatccctgttctggttatgtcttgctgtgtactctagacataggttttgtgggttgactgagctcagccgggtggttctcactggggtctcttatgccctggctcttaaatggcagctggggctcctacacatggcatctccatatggcttaggcttgtcacagtctggtggctgggttctgaggctgaagtttccaagagaccaggggggctgctgcaaagcttttaacctgagcttgcaagtcatgaagcatccactttccgttggttgtgctggacagcccagatgaaggggcaagttcccaaggacgtggatacctagaggcatggttcattagggaccaactttggagacaaacaaccacagtctccttccttctcttcccttggggattgaaagggttatcaaaagctggccagaaagagaagcaaagggtgaggataccgctgctgcagcacgtctgtagtagggaatgaacccagaatgtgaagagttgccattctagtaccctcgagtgtccttttcatgccattggaaacttgacaatagtaattgggagtgagttgaaatcttcagctttctacctttgtattgtcctttcagagcaaaaagaagtaaacattaacttaaaaaatgcttttgatattaatagttacaaacaaaaaacaaaacatgcaacaattccaagctcaaatcaaaaccaacactgagctttgaggtgcaatttctattctatgtgtgtggccatctcctcttgtgttagtggctgagcagagaatgctccattccaaaataaatagaattaattttcttaacagcatctttctttgtgccaagaacacagggttacaggaagcacatctgaatgtaccattggcaggttaaatcattctctttactttggtctttggtgggtttttatgtttgttgcttttcatctgaatgaatggcaatagagcaagttttaaaaatccttagggatctccagagattcctgtcttgctaagaaacaggaaggccgcaattagcagagaccaagaatgaagaggaggagaagggggcgggtgtctttgttgctgtaaactactagttttcaccattctgcaccttgggctgtgttgctgctgctacctggaacacccttcctccccctcctctgccgggaagactcccacttagcccagatgcagcccagctgctggcttctgcatgcagcccacctcttcttgctggacagggtggcgtcttgtcccccacacccacaattcctgtgcctatcactttgtctctgtattccttcctcagattgtagctccttagtggcagggaccagctcttagcctgatatcatcagccaagcaacgtgtaggatgcagaggtttggcaaaactttgaaagcgggaatgtatagtcaactatgtcgatgtctgggtcatttttccaatgtctggtagcaattgtgttaggtggcttatacctctcctggacccacacatagcaaattctaaaaataacaaactggaccatataagcttttccaaaagcctggggtgggggagatgttataatatcctgacatagctgtgctgttgttcatttcacctctgtcacctagagcaaccccctccatgttttccaaaaccgcccccatcctcggggtctggtttgggacccctgtcctcctggaggtcctctttgaaccctctggacccttctctcagagccctctggtaccttgatgtcacagcatttcctgtaatttcatttccctggcctcttggctaagataataggctcctgtccttgctttttctctgtcccctgaaaggggtgaagtcgtgtggacatgtggcaggtgccactattgtttatctgctgaacactagcactccccgtgccttcatgccatcaggcagggggcatttgttcttttgacggtgtggacaggggcagagtttagtggcattgttcttttttagcttaatgagcacgaactgtcagagcttggaccaaatttttcttgcagatatattttgattgacaggcacaggatttttggagataattgaaagagttgccaacatttatcaggagactgtacataaaaatacagagttccagtttccctcaaaaatttggaagttttggcaaaattgagtcccaattaccaaaaattgcttctaaccaagcagtaactattcccttcacacagaatgagcctcccttccctcatttcctgtaaaatggtactgcatgttctcctctttcatttgtgtcacctgcctcattggtgggtaagttgttctagaaaatgtctatcatatgtgctgctgtactgctaagtgcgtagagccctagtacccacagggcacacacaaacaaacctggtatacaaagaacttctgtgcggatttctttcttattgtgcacattttaaggggcatcagtctctgtccatgcatccttagaattgtatggctttttcatgatttgatttattcaacaaggatcgaacagtctgtttgtattgagtatttactatatattagttactgttctaagtataaactcattgatctcacaactctgagatgggtgcttttactatctccatcttacagatgagcagcagtttttttgttgttttttgaaatggagtctctctgtcacccaggctggagtgcagtggtgcgatctcggctccctgcaagctctgcctcctgggttcatgccattctcctgcctcagcctcccgagtagctgggactacaggtaccagcctccatgcccggctaattttttatatttttagtagagacggggtttcaccgtgttagccaggatggtctcgacctcctgacctggtgatctgcctgcctcggcctcccaaagtactgagatgacaggcatgagccaccgcaccctgcctagaagcagctttaataccaggtcacacagccaggaagtagactagctaatgtttcaccttaggcacaggtggagggagtcacacatctgtaagatttgttcccaggacaatatcattttctttaaatgtctgttttgggaggacttcaatgagctctcagatagaaacacccatttccagggagcattcttaccctagaaaaagcttgggacagttgtattcagacagctctgctgttgaccatgtaaggaactctctgccactcttcctcatagctttggcggggattatttgtctttagacttgttcctttttgtgaaagtgacagtagtgatagtcattagtagttagtagtcatggttacttttgttgagcacttacagtgccaaatgtagtaagcactttcaaactgtattactctccccgtttctacttgggaaactgagtattactgtgtgagtgatggggacttcttgaaagatcctaaacatgggaatgtcgtaatcaggttgctgtttcatggatttggttccgaaagccaagcagagagcgggtcaccagcacagtagtaagagtcaggaaaattggttgagactgttgtgtacaggggagagttgcttggggcttgaactaaagggacggtgaagagaggggtaggtttgagagagacttagaagatagtaatggcaaggcctggtaaaagacgggagtgatttccagttttacagtttggacggcagcatggataagaaagaatataaggggctgggtgtggtggctcaggcctgtaatcccagcacattgggaggcttaggtggccagatcacttgaggttaggagttcaagaccagcctggccaacatggtgaaacctcctctctcctaaattagctaggcgtggtggtgcacacctgtaatcccagctactcgggaggctgaggcaggagaatcgcttgaacctgggaggcagaggttacagtgagccaagattgcacgactgcactccagcctgggcaatagagcaagactctcaaaaacaaaaccaaaaaaaggtagaaagaaagactgtaagaaggctaagaaggcatcgtgcggacaggggagtgaagtgtcacaaactgtcagtttgatgtactctgtgactttcagttgaagatgtcacaagattacgacaaggagctcccagtgtcttcacgtagttttcccagcttactcagtaaatatttgttccctaaatgaattcatgatttccatagttactcagtaaatatttgttttctaaatgaatctatctgtaagcaactcaagtaatatcccctcctaccatttatcttaatgtttgaatttcatctccaaccacttaaatcatagtctctgggagatgggagctaggcattgacatttaaaaatgtatgttcggccaggcacagtgactcatgcctgtaatcccaatactttgggatgccaaggcaggtggattgtttgagttcaggagttcaagaccagcctgggcaacatgacaaaaccctgtctctaccaaaaatacaaacattagctgggcttagtggcatgcatctgtaatcccagctacttgggaggctgaggtgggaggatcacctgagcctgggaggatcatctgagcccaggaggttgaggctgcagtgagccgtgattatgctactgcactctaacttgggcagcagagtgagaccctgtctcaaaaacaaacaaacaaaaacctttgtgtccacagatattctaatttgtggccaggtctgacagccactgcttcagttttaatgaaacaacagatgaaacaggtctactgagatgttcttttactcatccatcaatttcatttttgagtgtctaccactgttttgagctccatgaaactcaaaagtaagcattgatgtgttcacctctgtgttcctagtaccagaactgtgcctggcacagaataggtgctcaatagatagttgtagaataaatgaatgttttatgattctgagcacttagagaatactgcgctctagtaacatacaaccatcagtgtctgtagctgtggcaggaggctttctgcttctgaggtctctctgtctggactgttgtgctattatcctctcatgtttcttcaaggcagaggggttgctgcctgggaaaggtgtacactttggagagtgaagtcagactttgctaagtgaacgcttggatacgtgttgtgcatctctgttcccaagtaccttctctgctatggactgaattgtgtatctccaaaacttgcatgttgaatctctacccccagtgtgatgttatttggaaatggggcctttggaagataatcaggcttagatgggtccacaaggctaaggccctcataggggaattactgcttttaaaagactaggacattctctgatcctttggaagtatatttcctttccatcctcttctctattacctgccttccacctgcatcattggagttggcttcttggtgttgacaaaccttacaatactcaggttgaagacaagagcagccgagaaggagcttttgtagggagtggttgtcagtgtctggtgctttaatatttccttccgttgggatttggaaaaggcagtcccacatagaaaattgttccagccgaggaacagcaagtctgtctgtcaatctctgggtatattgaagacatctctctgagtatattccaaatgtactcatcagtgacgtactgcttctccagaaggtccccttaggaagttgaaaaagattctaattcctaacacagtagctcctgctattttcctatgtatgtttttttctcgcttttatcttctgctttaccaaaatacatttacataaacaatattagtatgtgtacagaaaatatgaataaagaaataaagattaaaaaccttagaagaaatgaaaataaaaacttaagaattggaaaagaattctaaaatctcaaggttgaccaagctggagggtttttttgtgcatatttattgcagttctaccttgtgccaggttttagatactttcttttaatcacagaactttacaagatacgtattatctctattttatggattagaacatttaggctctgaaactcaagggcatgtagctgctacatggtagagtcaagattttaatttagcatgcctaactgtaaagcacctttccttggtctaaaggccagtgacagttcctaatgaaagttttcacacgtacacaatgaaacaagaaaatgaagacagtgtagaagatttttgataaagcaaaatacaattaactttaagaaacctgttcattattttaaaatacctatattggctaaagtttggcaatctaacgtcagacccctaatcattatatatatatttttttcttaaaagtctactcgttcgtgaaatcacaagttcacactcagggttcgtgatttaatggtggaacaaaacagaatatttaaagttgggaatgttccagaaaagctagatttacaagattgtcttaaggccccaaagaggaaacaaagatttggcttgctgatcagagttaaacattgtgtacaaaataccttaggaggaatttgagacctccgttatttcagacttaggaaatagccctttcttatctctcatataatggtacctgtctctcaggaagctaggcctcccttgcagtggtaatagctggcctgtggagccccttcacattgcattacggcaattccagtgcctccctttcccgttaggaatctaagcttgtactaccttttaaaatatcttcaagagtcaatatgtggatatctgagtgtcaaatctggcatgcactgtatttaagtatcacttaggaagaaaagcaaaaccctcagccccttgaaatgatttttaaattaactttttggtggaaaagtcccattttatctgtgcaacttaataccctttgtgcaattttagccaacttcttgaaaacacaggaggaaaacaacaactttcattatctcttttgctctgaatagcagcaatcatcaaaccaacatccaccaccttcttgttctcctgaacttacgtatttttgtatatgcaacaacttagggaaaaacataatggcaggaaagaaaaccttttcccctaagtaagaaaaatcacagaaaatcattagtgtgctaattaaggaacaaaaatcaaattgtgaaaggtttcttacccagattgaaatgaataggcctgggcttgttcccacagtggagacagggctcccggaagtatgctggaagcatgcaaggccacttgccgcctagactcagaaatgacacatcgtcacttccaccatgttccattgattaaagaaagccattcaggccagcccagattcaaagggtggaggaaacagaggttgcctataaaagaaggattttgaccatttttacaatttaccaaaggagtgacttggtcgaggatattaactaatttaaaggagttaatgtaggtgaagctcttagaatgcctagtgcatgacaattgttgttttgctattttttattattattactgtattctctctaggcgtttcccccaggagcttattgaacgtcctttaatcttttgttttgtttttaaaaatgatgttggaggaacaacggtgacttttcaggccctggaaatgctacatatgggatggtatcgtagaggtgtttctttgcctcccatgggcgcccccggttttgctctctccccctctaggtggcgctgtcggggatccccagctgtcccacgttgtcttgcttttcctttcctctctgtcaaaacgaattctcattcttgattcttaccactgcagtgtttaccaactttgagtgatatatttcccttttaaagaaaagcagtcttgtgaatttagttgttgttttatatttttattatgttacttaaatatgtacaaacataaagctatgtataaactaattatgcttgctcataacttttatgcatttataaaataaaggaaatgaaacttgaacagaacagatttaaaaattaaaacttcagaatttcaaaatagcagcattaacctaacatgacagatgatattatttttactaaaactacatccagacgcaaagccaccgtggcctttgatgcctcagttaccccacaccttctctgtttggactcctgcaagctcttcgaatacagtgtgctgtgaaattattatcaagttgattataaacacaaatatgagaactgaagttacctgacagtgcttggttataagatggctgtttaacttagtgctctcaaattttactgtgcaggtaactcaccagggatcttgttaaattgctcactttggtacagaggggcaggggtagggtacagaattctgtgttttaaataagctctcaggttatgcctgttggctgatctgggaatgacactttgagtacaaggatctgactatggttccatcatttgtttagattattaaacacacaaatatttaagaatcagtcgaaaacatgtttctggataggtccttggtctctagtctagtcactgcactaaaacatacaagcagttaggttgttagagcattatactagccctatgggaatcagatccagacaccaagcatgaagttgcatgtattgagtatcaggcatcagccagtaatatagggagggaatgatgattgtacaaagacctccctggacattccagatgcaactcacagatgatgactccttgaccagtgggacaggcctgatgtggttttgcctctaataaatcaaatctttccatttttacccaagtaaaattttatttgtactttccttatgatcaccactcacattttgcctggtcttacagtttaaaatgtggtacagctttctttttctatgttaatattctgagggcaaggatcatgttctattcctttttgtacttttcatacagcaggcatacagacatttgtggaattgaatgtattagctagataaatcttgagggtgccctctgctatttgcataaccaagtttttttctgaaaattccaggaattttgctctttctgttatatttcagactcgttattttatttactactgctgcttttttttcttcctaggaaagattcctaagatttaaatgactaaagcttagtctctgatatttgaacataaaccacatttttattgctcttggctctcaggtgcgctttgcttttaatttttatctgagaataaatgttgagaagattagaaacgcttatttagttgataatctgtgtgaccagaatttatcctttctaaatagttccatagcagtcttcgagagagaagttctggtagaagaggaggtagagtgagttgttctttaaaaaggaaatgcaagtttgtagagagatacccaggtgtgggctttatgcatgaaatatttttcctatgagaaaaaggaaaacagtgcctgaccttatcaataaaccattgtaagacgtcttcagcgtaggtcccaaggacattccaactgttcttttggactgagaaactctcaggtagtggttgggagaaaaagatccagaggtcgcagtgggatatttaacaaacatatgaatcagctgtatagcacatcagagaacagagagaccagacataaatgcataataaggcaatattctcatgatattgataagaactttttttctaagttctgttgatctgtctttctacccattcaatcattaatttaacattgtattgagaaattaaacacagactcaaactacacaaaataagcatagtttaatgcaaagattcccaaaatatggtctccagatcagcattgccttggaagttgtgaaaaaagcaaatgtttgcactccagtggagatttactaaatcagaaactatggaggtggggtgtttattttaacaggctcttccgaagcttcccatgcatgcttgagtttgagaaccagtggcttagcatgaactagtatgaggtggacactttgaaaccagcacctagctaaagaaatagacctgccagtcacttcagaagcccctccatgtgtcccttcccagccataattcctttctccttccaaattacccactctcttgagttttccagtaattactcccttgcctttttatagttgtgtcactgaattgcatatccctagccgcaatcatttagtcttttccatggatattaacttatctttcagtctatgcattcccccattgtcccctccttttccatacagtgtatctgatgaagaacttggactgttagacctgttggaggttctcagagtggattttgctggttgtgtactcatggtgcagtgtaacatgttcctctgaacttcctgagtatcagcagctggatataggggtttcatcaaatcttagtcctgtccttttgctaagactataggtgggactgcgttttttgtttttttcttttctttttttcatcaggaggcgcaggaagtctagttctcactgtattttgatgttaacagccatagatactcaatacttagatcgattgagagaagcataatggtgacagtctgtcatttcattttcatttattagctggaaagtcttagatggaataaatttagatcactatatggctaccttgtggtagatttcacacttgaaaagccggttgaatgctcagttttccttttatttacctaattttcaagatactgaattgcttccctgtcatgttcagaaggggaccaattaaagaaaaaaacaaaaaaaaaacatgaactactaggtttaaacgtagtggaagagtaatcaaaccgtagcaaatcatccctattgaagctcaaattgtcccatttttggccagtgggagcctcttcaacttggctcttgattccttttggtataactctagcactatttgattccttccttttttattacaggctcatcttgtgtatttcctgccccagaccaagagtcagccatttctctgagaatgcaccctgctcccccagttctttttgataggaaaaaaatgtcaaaaccacaaaccagattctcataactactgacttgattcttttttactgagtcttttcaatgggcaaaactgggaaatatccacttctatatctatatagctttttctatacctatacatagatgttatatgtatttaaatatatttaaagttaaaatacctcatgagtttatactgatatttccaattcaggactacagggttttaacgtcttctgtatggcatctatatcttctttttcctgcccaaacaatcttgattctcaaggacatagagtatgctagattagaatatgtcataattactcatttgcatgcttccacattacacacacaatattaatactaccaccaccaattatgattactaaaaagaattaaaacatttttgtgcatatgctattctcattttcctctattattttatagttatacctaatctgtttttatcaggtaatagttattaatgctatactctcttccatttaacccccatttaatgttcttagtttcatatatttgatggtcatcaccattttcacgtcaatgacatgacacttggttgtccaaagctcattctgtagtagtcgccttaggaagaagttatgggaacagaataccttgtgttcttacatgttgaaagaatgttttctctacttaatgttcatttttgcttggatataaaatccttggcttatattttctttcattgagtaccctagatacattagatcatatccttctggcataaaaccctgtcaaattctagtgataatccagtttttattttttcttacaagtcacattctctttttgcaagaagcccatagagattttttttctttaaagtcttgtcattttactagcatatgtcttgatgctgatagttatgggttgttattctcacataagtagtttctttttttgtatcttaggacagtttttcttgatttatagtttttaaaatttgttatgttttcttgttttactgtttctgccttctttagagactcctgttgtccttatgttgcatcttacttgtctgtcttcaaaatttatcaattcttgaaggcttcttatctttcttaagttcttttgatttttttaaaaaaatttaatttcccccttctacttttgaagttatttggttttattattcactcttaagtttcttctagttaagcctttttaagaacatttctaattcttttctaagctctgtcaccttatttctgaactttttctagttccaatttatattgttccttcatgtctagcgtgttttcttagtgtcttttggcaaatctggaaattgtatgttagaattgtgatctgattttggagccagttttcttggtgtgctttcattatctgtggaaatgttgttttattcgttttcctcttttatccttaagcaataatgtgtggaattttctctccatgcttttctgttgctcattttcctcacgttttagaaagagactttgttcagatggatttttctaacttcatagagctctgtcttctattgtttttatgtaattttttttaaaaaacttgctttgtaaatttttatgttgttttttccttttccactgttacctgaatcttctctttttttttctttctgttttgctcaattttatttttttcccagcagcttctctccagtgtggtaccttgttttgagagcaggtgctggctaattgtgtaacaatttgtgatttatccttacctatttgtatcttgatgtttgtgaggataccttgtctcccagttttgttgtaaatgtccattaatttttgaacattctgtttgatttcattgctctgtctttcgacatgtagggattctaggagttccaaaaactgtgtcactgctaccactgccatctcctcaggaattcctcagtttttcaaatgatgatttttgaaattttagagtctataacttgagagatatagcatttttggagctgggacaaaaaagtttttaacttaattatgggaagtaatgaaaagaattggcttctaaaatgcaatgcagagatgcataaatgtattctctttatcttgcccaattacagagcaaaatagatgacaatacagaaataaacatggtctggagtagaagtaggttaatccgcatgctttagattgacttacagtatatacactttatttcttcattcagtgaataaatttatatagtgccttacaatggacagatactgtacaacataaaaaatatgttgacccttgcctgtctggcctaccttgaaatgctgtgtataacaaaattacacacagaagacctcagatgtggcaaagtgaagtgagagggaagtgactttcccaataccacacagtactttgagaattagaccacaagcctggatatctgtaactcccaatccaagacttcttccaccccaatattcaatctcattactaagtgtcaagaaagtggatttgttaccaccaaaaaaagaaaactttctgacattgagtgtgtgctgttttttgaagaatgttgtgaattctctgttcttaaaaagtcagtagtgcagctttcaatgtagagttcttttgttcaggcttacacaactatcaccattcaccagataacttgctgtattccagacatcattggctgctttgtatacatattcttatttaaccctcaccacctggcaaagcattgtcctcatctctagtttacagaggaagagacttattttaactcagagtatgttgtccaaaattaccctgctaatagactggtgattctgtggaaacagacactttcttcttttatatgtaaagtgttctgggtaacaaataatacactctcttctcatcactgtgggcaccatggtctgggtgcctcattggcctctctatcccctcccaacacatacacagaagagaggagaggagagaagcatcctaaatgcttgactctctcggcagaaagtctactgtgtctaatggtcttgtaggagggaggcagcgacatctctctccctgccttcttcctttccattcccctctctactaaattagctccctgagcatcagagtgtaaatccagtttctcttacttgtgcaaacatggacattcttatgccactttgtgtgtaaaatttttacatgaagtctataacctgttgctttggtatgtaaggctgtagaatgagcaataacgaaaaccagaaatgtttgggggaaagaagtttttgtctgatcttctatattcattgacccagacaagtgtcacaaggaccatgagagtctggggagcctgggacattgcccacactctgctaatgaagaaactgaaccacacctacatctttgtctagtcacacctagcagcctctgaccttgctctccttgcctcactctgatccctctagaatccattgcacataccaaccaactcaggccctaaaactcttcttttgtgaggttactttccagtctttaacctattggctttttctcattgttcctcaaatcaaatctgaactccactgtctgcaagactctcccgttcttttcctgaccaccttggctgacagctcttggagaagagggcttagattgataataatctgtgatcctttccttccaccttgcctagctctgccagttcatggagtaacattttcttttccacagttactgtaaaaagaaatcgattctttttagctaaagtaaatgacatccaactctccttacatggaaaaaaggcactaaagtgctgacagataccatctcaggaatggatggatattcttgctgtttctcttccaggacaatcagaaacaaatttaactggtgaatggccattccatgtggaagggaagtggtaacatagggcactagattaacctagtgcacttctcagtaggattcatggtatttctatgtaatttccacttacaaattacacatctaatagaatcttaaatgggaagacaaggatgagtcatatgcccaatccacatttatgtcttcaaaatacgctttgaacaacaaagccacatatacatgttaaaaggcctagtaaacttctagaacactagaaaatcctgattgccaggatctgttagtcactccactccagacagggttttgacaaaatgccttttcccaacagaggttaccatcttcacaagaagaccacatttgtatatatgtggccagcagcattcgccagggtacgtacctcaaggaagcttcaaatggccattcagtgcgcactcaaaagggatcctcagaggagcattcagaccatttgcttaaatgattgtgtgctcattaaggtgggcagatctgcagtctcaactagagatctggtagttaatctgggtccaggatgtttcttaactaaacatgttaaaggagccggataggttgctctctactgccaatttatcggttttacttttctccttggctacagtgcaatttggctctttggtttaatccccttgagaagccagaatccattggcatgcggagctctgggtcttagagcaatatggctctaaaatgtacgaggtttattctgatggtccctgtcacattagcagatggtggcatttaccatgttgatgggagaggagtccttgtgctctcagccacagatggcccgggaggctgtcccagcagcagcacctcaccctctccaacacatgccatgtagttagttgttccctctctttgttcctataccacttacgtttgcatttctttcatgcagttcgttggtggtggttatagtcatctgttttgatgcgtgctccccatattaggctgctaaggttttaggggcaggtacctggcttctcctccagggattaagagatgcaacgctatgctcaaggtcacaaaggtgctgagtggcagcagggtaggattctaagcctcattcatcagtctccaaagttcaggcttttaattagaaggcctgtcatatcatagaaatcacaatggtcctcttagggcaaaataatgggtgtgaaatcgtggatggtccaacgataattacaataagaatcgtttatttgtttcttagaaactgaactaatcattttacaggcatcatttcagttagtcctcctaatagtcctatgcatgaggaatgtcatcaccattttcagatgagaaaattgagtgtcatagaggctaaatgacttgccaaccaggtcacacagctagtaagtagctccaagtctaacccagattgatgtgattccaaaaccctggtcttgggcatctgactgagaccccccaatgtatgggtgccttgctttatctaggctcagatcctggaggtcatttgttgttaccttgaatataagaaacacacagggggacaggcagactctgaaaatataaagttcattcccctgaatcaaatgcagaaaacagttctcttatgggttgtcccacttttcatttgaacttagtggggaccacgggaggggctgttgaaaatgaccagctctttcctctgccaggcttcctacacttacacacacacacacgcatgcacgcatgcatgcacacacatgcacacacacaccccacttcatgcttagacagtgataaagtgagtagctggggcaagccccccgacatgtggatgactatggtggtggtgatggtaggaatggtgccttatattagtgtaccttgtacgtttacacatatttatttgatctacctcaaggtaggtgaccaagtattatcagtccctttttcctcatgtaggaagaaactgagtgtcagagtaattgagatggagcagattcagactcaggactcctgtttcctgatggagtgcactttctgctaaagtaatagctttcaaactgtggtgggttgaggagccccagaagccatcataataagtgagggccaggggactcaaagacctacatcctgcttcaactggagcatctctgcttttatttgacgggtatagagggttctgcatgtggttttattttatagaagggtctgatgttctaacagtttgctactgctatgtaacaaaccactaccaaaagttagttaattattattgcccatgcctgtgtggcttggcagggctctgccagactgctctgctgcaggtggtggctgtggggcagctgggatggctctgttcctcaggcctgtcactctccttggacgggggatagatggtgcatgtcctgcacatctttcaggcttagacttggaactggtatactgtcacttccaaagcaagtcgcatggctgtgcccaaagtcaaggggtagggaagaacattgctcataatgaggctatggcaagggaatggacgcagagaggggtgaagaactggggacaataatgcaatctgcaagtccatgaaaaaattgtattatcactgctctgtttaaattaggctattaaagtccttcaagacttatttatccataaaatcaagaggaaatggctgttgtattgtaaaagacaaaggacttctacccagagataatcaggtctgaggactgttgcttctgaatggctgccagtttggattgtggtcagtgttctcatcttttcacagctttactcaggtagggtggatgtataagtgtgtgtgtcagacagagagagaggtgcaaaatagaagcacgcctctgtctatcagccttgtcagcttcgatccttgtttagtctgtgctttatcttctcccgtctgtcaatgatgtcccccaccatttactgcaggcgggtctatagatccagtctctcccctgccagtctctctttgtttgttgccctggtgtcactgcacctctgagctctaagtctttaccttctgaaagccattcctaggacaatcattaaaacctatggtagttgataatttctgaccctaggctggctaatttgccttcataaactgtcagattctgctaaggtcattgaatgctgtcatcttcataatgtggttcaagcaaaatggataagagaccaaacaaggagaaatctccctagaacacagtatgccagcattgctgtatctcaacaattaaaaaatggtgcgggagttacccagtagaatatttagtgaggtgtactctatgtggagttcataaatacaaatgcaaaatatttaatgcacagaatcagagttgcaaaataagatttaattctagaggattagggagacagaactgacttaaggctgtttttcccagtaagcttaattacttggatgacaatcattaaacattgcaagtcacctatcccaagtgatcgaagggcttttcaccaaatgtctgagtgagaaagtgattatcttatagaacaaacaagtatgataaagggaaacaatcagacaagtaattatgataaagaaaaacaagaaaaacggcacatccagcctgttttgtgggaagaatcacagaggcactatgtaagtacggctcctttatctaacagatcatttactaactatctggagtcaaagtcaagtttatctacatgctgaaatctatttccttctaataagattccatccacttggatctcagttatgtggcaatcttgacatggaacgtgtctcggaatatggaagggcatgagaaggcaccaaatcttcaaccctagcgctcgctcagggtttgattagagaagcagaatcacaggattattttacaggatttcttctctggatttgacttacgcagctgtgggctctaattaagcagacaatggaaagttgctgtgtctctctctgatgctgggacctgaggccagcagggtaggcagttgggaagggaaaatggacacgaagctggggaagcaaagacaaattagaacccatggggataagctggaatccatcaagatggactgaaacccacattggtctcttgctgcctttcaaggaacttccatgatggaggcgacttccaggagaagccgactgcccttctccatggaactcagcctgcatctgcccaggagtcagaggaggtgagggaggagatctgggaagggctggacaggcccatctgcttcctgccccctcagcctgctggtgagccagcagataacccacaaaagcctcaacagcccctggccccccatcaactttcaaaggcaccaatgcaaaagactatagctactgcttcagttccttcttccaaatgtcatatgaaatgcctcttaggggtctatactaacccagaactgtgcaggagagagaaatctgggaaacacagttccagcttagctaggttgacttgctataagtcaaccacacctagtctcactaagcccatttgtcatgtgtggcccactcagactgaaagaatctttgttggttcactgttttataagggccagcctttaccagtttgtccagctagggcactaagttcttagatgcagacatcagttctgtattccctgttaaggatctgcttccttaataggaatctttaaactcctgaatttgtaatgacacattcaaaagcattatttgagactaagcagtaatagtgtatggcaagctggacttacagtcctgtgtgatgtagagatacctaaacataaatgggcatggatattgtacacacatatgtgatgcaaataatatacaaatattgacataggatgatctagagttgataccagacagtcctcatcagtgcactgatgaaaccccagaagaaaagaggtttagccagcaagttaacccatgctgatgagcatctaccatgtggcaggtagcttctagaggtgcaggggatacaacagttaatggtacagtgtcagccgtgaggctcttacattgttttccaggttttctcaaccatgacatcattggcattttctgttgggtaattctctgttgtatgcatctgtcctgggcattttaggatgtttaacagtgttcctggcctttgcctactagatgctggtattcctccctctcttcatccccatccccgctgcagttgagatcataaaaaatgtcattaatcattgccaagtgtcacatggggcaaaatcatcctcagttgagaacctgtgtttcagaagagacagaaaaataccactgagatactttcagatgctaataggtgctcttaagaatataaagtaggctgggtgcagtggctcatgcctgtaaccctagcactttgggaggccgaggcaggcagatcacttgaggttaggagttcgaaaccagcctggccatcatggtgaaaccctgtctctactaaaaatacaaaaattaaccaggcttcatggtgggcacctgtcatcccagctacttgggaggctgaggcaggagaatcacttgaacctgggaggcggaggttgcagtgagctgagatcatgccactacactccagcctgggtgataaagcgagactccatctcaaaaaaaaaaaaaaaaaaaaaaaagagagtttaaagtagagtgatatggttacatgactaccaaggtggttgaggaagcccttgccgaggaagggcctttgatttgacatgcaggcagcccctcagagatctggggacaaaatgcatcaagcaaaatgaagagccagtgcccaggtcctggaggggaacaaatgtggcatgttgaaatagcaaaaaggctgggagacttgcagcatgggtgatatggtttgggtgtttgtcccctccaaatctcatattgaaatgtgattcccaacgttggaggtgggggctggtgggaggtgtttggatcatgagaggagatccctcatgaatgtcttggtgtcctccctgaggtcatgagttcacacagcatctggttgtttaaaagacctgggatctcccgttctctctcttgctccagctctccccatgtgatgcattggctcccccccacccttcacctttcaccatgattgtagcttcctgaggcctcaacagaagcagatattggcaccgtgctttgtgtacagcctgcagaactgtgagccaattaaacctcttttctttatagatgacccggtctcaggaattcctttataacaatgcaaaaggactaacacagcaggtgaggaagggaagagaggagggcatggggtagggaaggacagccacaacatgggggaccttgtgcatgggtcatggtgcacgatctacatttaactctggctactcagggcagtcatgggagagatgtgatcggggagtgatgcaatctgatttatgccttaaaaggaccacgctggctactatgtggtggatgcacaaacagctcttccccttctgcctcctttgccttgtgacccacaaggacccatgatacccacctgcagctggctgttgccatctattcggagttgtcaactaataacagacaatctcctctgccctgtgacccacagggacccatgatactcacctgcagctagctctttccatctatccaaagttatcaactaatagtagtctctgtgcctacaaatgattaaaattgggcttgaaaatatggcaccattatcatcagcatttcttgagcgctggccacttgtttctggtgctcgtgtgtgtacatgaacatccttgctgtgagtgctgggccccaccctcactgccatttaaaaaaaaaaacaacaaaaaacaggtgtctgcagcctctggtgaacatcagcttctccgtaaggctataatgggagacaccttcatagattttgagttcggctaaaataccctcctgtccagttactacctataatgctcttttcccttggatcagaaagccttttctctgtggattatttccctccatctataccccacattactaccccatgccttcataaggttttactctttactggcgttatgtccatttatatttgaattacacaagcatgaccattcatgctctttactcatagaagggcaccctgcccttcctggaaaaatgatttactttcatattggataccatttgaatatacccagctgtctgcgtggaaatagagaagtagacagaaagaagcctcctgctacagcctaggagcagaacagtaaacccaggtttccaaaatatctttctgaggtcattacagggtcatagccctggacagcactattcctaagtcatcctgaggcattctttgtgtgacaggcccaatggcatggcaatggatttcataatgaaaataatgaaacattgagataaaaagttaatttcttcctggaagagtctatttaataatgcaggaaaatgttacactttttagttatacttaattataaaatgctagaaaaataggagtggttttggtgttgaaagagttatttatctgagagaactatgaattatccagaatgcttctctaaagtttcctttttcccaaaattttattatttggcataatttcagtggaatcttccaaaagacattagtccattcttttgcttcagtgcatgtttttttggatagatattatctatttttgtgtagtgttgtaaggtttccaggatacgtaaaagttggaggatatatggttggtgcaaaataattccgtagagtaatgagattgaattgggggaggtggtttaaggaatacaaattcagtttgcctaaatagatgtaaaaaggaagggaaggaataacatctgaagctaaggaaggaaacttttgggctggagcatgactagataggagtcgggtagagctttttaacacagttgaagatagctgtggacgtagatcatgggcaaaactggtaatgtgaggatttaggaagcacgtttttaagctactgttgagtttcataggaaaccataccccactggtcataagagacattcaccaatagttttccatgggccttttgtgctagtggtagttttgttgggggcaggatttacaaaaatgaccatgcatttgaaaggtcaatgatgaaggtaagtttgagaatgaattttccatgaatgtcctgcaagttttattctttctgtgaacagcttgaattttcatttggtttgaagattaggaaaataacagtcatatatactcacagatcaaattcaagtactgattttagccatctatgagcaaaggccattcttggtgttagacatgaaacaaacgagagagaaagaaggaaagagagagagaaagatgtgatggactgccttggttctcataatttagaagtgagactataggtatatgcacaaggagctctgatgtgaaacatggatatcatatatgtcctaatggaaatgcacaaatatcctaatgggcttaggaagatttctagaaggatagggattccaatctggtttaaaagaaaagcctgaaaccttggcaaatgaagtcagcaaggatattccggtagcagaatgagcctgggcaaaggtgaggagtggagtgttgcctattttgttttgtgaggatgatagattcctgtaactggagctgcggaggaagtagatgtattggagattgtccttgaaagtatccagactgactcagacagcaattgtgaagttcttgctgatagatttgtactgtattttccatgcaatgcaagatccattagagggatttgagtaggagattgtcatggaatatttagaggatataattcagatttaaaccatggaatattttccttgatactattaaggaatgatagattctttgagctaaaaggagcactagagattatctattgaggtagtttccaaatattgttttagcacagtggaaaccttctttcaaatgacatcttacacaaatgccccagctacaaaacagatagaagagcagttcttgtggaatcatgatgggaagagtcttgatttgctgctttctgtttcttcattcctgtagcaatccctgaggtacctctgtagaaagcacaaaatcatggaacaacctgccgttttaaagatgagtaactcaaaagaaatgaaaacatattatgaaaccacacataccataacatcaccagcagccttattcataataactgaaaagcaggataccacccaaatgtttaacaggagaacggataaactgcgttgtgttcatacagtggaatagttctcagatgtgcaaagaacaacttactgattcatgcaatggcatacatgaatctcagaaatattaagtaaaagaagcatgacccttggatttcatttatatgatacacaagaacatgtaaaacgaatctagggggaaagaaattaggaagtgatggcctgggtggcagggaggagaactgattcaaaaggagcacaagagaactttctgggatgttggaaatcttctctatcttattttgcgggatggttacatttgtgtattccgttgtcaaaactcatcacgtggaacacctaaggtgtgtattttattgtatgttaattgtatcttaatgaataaaagttgagtttgaagattcttggagggagatttgctcagttcccatagctaggcatgagaaagactagcagctagaacttaggtttacaggattcctggtccagctcttttaaccgcatctctctccctcagagtcatcctcctcttcaccaacacagcatcaaggctggcttctccctccctggacatcctcttccctgctcaaaccccaccgtggctgtgaagtattaacttgacgacactgtgctctttgactcagcttttaaactttcctccagtgaaaccagaactggcaaacacagctacacttttcttgtaccatgctttacctgtattgccaacctgctgataaatggctccattccatagccttgagggtcttgaatagcttaaacattttatagttccatgggaatgagacaggggagaagacaccagtggcttccattgtaggcctgtctacactgaaggaatgccaactgcccacacacacttgttgttagatggcctggaggctcatctgcacagacgtgcagtttaactccattagggatcacagagtgatcacacactgtgctgtgctctttggtatatatatgaaaagcatcgctaagagaatgggagaggtggtgagagtttattgctgccttctttctcatggaagcattggacagcagggcagccctagtgaattgttgactgctccataagaatatcttgctcatttaacctcttctgtactaggtcttctgcctggagagtcctgggctacactgcccatccccagtatcccatgtattcatgtcagattcttgcagtctcctgaggatctttcaaggactggaactgcatcttcaccatctttgtgttcccagtgtctgcaacggtgccttattctagaaaagaacatcttaactgggagctgttttgccaggaccatcatcaaaaatgtctgaagatgtttttggttgtcaaaactggggacagggtgctactggcatctggtggataggggccagggatattgcttatcttcctacagtgtacaagacagttccccataacaaaaaattaccccacccaaaatgtcagtagtgccaagatcgagaagcccttctctagattatactttattgtatagaagataatagatcaaccacatcctcaaggctgggaccaatgctttgcattatgatgggtgtcttggtttcttttatttccactcttgattctctaagcatcatattcaagctctgagatgaggtgtatctgactgggtcaggtagccactgagcaaactggaataggcctttctgcagagtttgaacccaagtcaatgttgcctcgactcaagctcagatacctcatctaatcatcagtagccatagtaatagtagcccttagcacagaccactgatatctactgcttagaaggggtttgtgggggtagaaaatgaggttatattaagtttacttgcccaaagtcacacagccagtatgttttggagccagattcaaacccaggttgtctgaaggctccaaaagtcatcatttatcactgtatattttcttcttagctttcttgcatttcctttaatgttcccatctctccctagtgaaactgatttccctcaccaggaggttctctaggaattttggtccagggcttagattcttaaataagagcagggacatcaccatgtttgttatacgctgtcatttcacctcctctgttctgaatcagaatgaggccagcactctgggttctaagttatcgttttttttttttttttccattctatatactccctaagaatcttttttatgcttaaggtacaagtttaaatatggaaaaaaaaatctagattgaaatgaaaagccagacatttcctagttatatcactaattaactgtgttactagtgataagctgcttataaatctttcatcattaagataagattaccttctagatcttaacatttatgatcacagggataagttttttgttttgttttgtttgagacagagtctcactctaccacccaggctggagtgcagtgtcacaatctcagctcacttcaacctctgcctcctgggtttgagcgattctcatgcctcagcctcccaggtagctgggattataggtatgcaccaccacacctggctaattttgtattttttagtagagacacggttttgccatgctggccaggctggtctcgaattcctcctgcatcacctcccaaagtgctgggattacaggtgtgagtcacagtgtccagccaggatagttcctttttattgtaacatatccattttttcttcatttatacctccagtatccaacaagttaggatgcaggaattaagaaagaatcgtcctaaagtaggaaaggcaagatttgatgaagttggtagaaatcaagaagcacagttttgtaagctttgcttgggtgtggattgggaagctatttcttatttctccaagagtgtttagcttctcagacaatttctgcctcagtttccccatattttaatggggggaccaaacacagcatggtcatgcatgacatgtgaccgtaatgaaagtgtgactagcacattggaaacctggtgtggcagaaatcacacttagaatcaggtcaattaggagtcaccttagttttcttattgaaaattatgtgtaatgctgaaaaattaataagagagttccttaaaataacagactgaatttcgaagtttaggtgataattattttccgaagtctgacctgcccaagaccttatataagcacgttatggaaagcaagagtggtatatctttactaataaataagtatttctccaaactttgaaaaacattctgaagcttcaggttaaaaatatgtaaatggaaatgccctccacttgactgtatcacagctgttccctgtccctcatttgctgaaggactgagtacaccccaaactggtcagagcatgatgactttcagtaatgacctaaatgaccttaaaatatcagtaagtgacagagtattcgaagtcacagtctataacattcgcttagaatttccccttaagctgctggctgaagcactaattaagatctgaaatggaaggtaggtgacagatgctttgtgtcctgcagcagaggcacagaatgctgttctttcacttactgtttaataataataataacagccatttaatctgtttgctgatacagtctcctttgctttattatgttgtttattttgtgtgagctttcgatattagttataaaaatgtcactgtgtctgcagctgcatttttcattttagaaactcccagagatctcatcaatttaacctgccttgtacagttcgcaggaaaccactacaggcaaagataggcttaatcaaggttttttcttaataacgaacacaatacacaggaaagcagggcaacgaatgagcctttgattctaggtaaagacttattatgtgaaaatctatatttaaattaggggctttttgctaggattcttaactgcacaagacaaattactgtaggatgtctctaaacagcaagtgtgtcttaggcatttgaaatataatttaatctattaacagtttaccctagattttaagccattcattgttggcgaacacaatctagattctttaaaataaaaatagaaaagcatttgcagtaactggccattattatagctatagaaatcaaaggtatttcttgtataaattttgaattatatattgtttatctctccttaataactttcactatagaaagagctctctttcttgctcaatttacataaaagtatctggaacagttcagtgacaacagtgttggaaattaaggactgacttgagactgaagctccctccataactcccatgcccttctccagtactaagtagtataaaggccaaaagtcagataaacaacataagagaaggtggcagtgctagagatggggatgaggctgtttcatataatggaaggacaccagttgacattttccaaagattttccattataatcttttgcaaaggttctctttcactagttaacaaatataaaagatgccaactcccaccagactccagatgcttgtaatagaattagaaggccctccaacctttctttccaggggtcctgagggggacgtctttgttggcaccccaagcctgagtcactcctagcacctcaggaaagcatgtgttgtgtggcttcaaggataggcatcctaggagattttaccacctatccaggtgccctggctgggtgaaaactgtgcatcttatgcttcctcaatagtgctgtgagaatgctccactgccagtttgaggtatcaggtttgggttttcaggattgcaagactgctgtgctgtgcgtgtactggtgagttggctccctgcctttcccagcacccccatgcctccttcttcacatcccctttcaagtagaatagggaactgataacccaaccaggccccttattcccatcagatagcaagctaatcactgagacaacaagctttgcagtagagaaaagattttattcaccaggcagccaagcaaggagacaggagaatagatctcaaatctgcctcctcaaagatgaggtttaggaatatttatggaataaagaagcagtgtggtctattgtggggggaaaggtgattggaggtgggggaaaggtgattggaggtaagaaaaagggaggtaattggtgatctgcacagacatagtcaaaattcatggctcttcataggatgtatgttcatgaaatggcattgttagcatgatctgagggtggagtttttgtcctctgatgtcaaaagtcaaccaacagacattcatacaggcctagttgatgggttggtggtctcagccagtttgaactgggtaagaactgacctcaagttcctataaaacaatgtaagcaactgttaccatgatgacctatacattagagatgttacctatgaggaagctagtgagagtttagatacttttaggtatataggttttaagatcaactagaagtaagcaactaaaagcaagtgaggcaggttaagtttgtcaggcctaatcaggttagccctcgctttcagagtcatctgcccaagtacagtaaacagatccagctactacttagatactttgagaagtttagggttgggctctttcttcttagctttccccttcatagaggaaagtccacatttacttcacatgctaacttgtttgctgttagtagaaatctgcgggaagtttgccagagaagggtagcctttggggattggccaaccagctagcagggacctctgctgtgagtggcccatgctgtctgggcagctctgttaggtaaaggagaaagccatttggcttgtgtagactgcagctctgcaggaacctctccccaccatctctagccaccacctccagagtacagtaaattgtagacttagatttgctgtttccagcatagatgtcttacactttctagagggttccctctgctcacatagagccgttggttaagtggtggtgctcattttccatgccctgctggctagtccttggacattgtgagcatttttgtctccaatgccactgaattccttaaggccttttgggtgggtgctaaatatttaggcaactcttactaagaaaatagaaaacacttgagttctctgttttgcatgtggctatctttacatcagagccttggaagtggtcaactgtatgtagccaatttcatgaggctgttttaactgggaggacattgtcacctggctgggcttatacagctgagtcaataaggaaaacgcagcttttgttggcttgcttaccttttaaatcagtaagtaatgcacaaaatgggtccctcaccaccactacttcctttaaacctcatccccaactccacatcccatcatcatctctcatctcatctcgcagctttagctgatcccatggtggggaactggggaggcatgaggttgggggtatatgtgtgtatcatatattacttgggagaaaaaaaattgttttaggttttattacaaagcacccaagttaaaagagcagtgttaaaattgtcttatcaaaatatcccgtaccattgcattttcctgtttaaagagactgccataaactctaggggctacccaagtgaggagacgagattatgattaacaatcaaagtgatggggaaagttataaaaataggaaaaaaatatttagatataaagtcactgacctatgaaaccaccttgcaaatggtaggcaaaagaagtagtattactgaaaaagtatgaattgttacctttactctgaaattagtatgtaaaggagcactttgtttactgcactaaatctttgtctccagtttttaaattatgagatttatattgcctaagtatagactgaatacattttaatatttaattgttttttctcaaactatggtttgaaaaacaagataattcttaagctgggtttcattactttgaaaactaacagtgttttctaagagaacacgttactgatttaaaaatgtaaagtaataaaaatagtattcacataaagtttcagtagagttttagcacagaacacaattaaccagggcttaaaaaaaaccatttaattttgaggcaattgtagttatttcttgcagttgcaagaaataacacagagttctagcgttagcatttaccctgttccctcaatggtactatcttgtaaagctatagtacaatatcccaaccagaatattgacattttatagttaagatacaggacagttccattaacacaaagatcctctgttacccctttataactacaacccctcattcccatccctgacccctggcaactcctaatttgttctctgtttctataacttatcacttaaagaatgccacataaatgggatcatataatatgtaacctttgagatttttttttccctcagcataattgcccaagattcatccaagttgttgcacgtatcaagggcttgttcctttttattactgagtagcgttctgtggtatggatagaccacagtttaaacatttgaatgacatctgtgctgtttccaaatttttgcttattataaaaaagcaagcaggacttttaaaaaacacacttatagaaatgcttatggctgtgtcttattacagaatatttataaggagagtaagattaaagagttagagtcacttaggattaaaacaaatgttataaactatgacagtccagctcaaagtagcttgatttcataaatatattctctttatggtatttcataaatgccataaatcaaagtagcttgatttcataaatgtattctcttttgattaaataatcaaacttaagtaaattattggccagtgtccacaatagaatttgtaaatagttacattgtgttcatgtttgcatttctgttctcaacctgaatgactgctcaatatagtacactatattcacttttattaagcactgctctcacatctcattgtgtttgttgaacctggaaatgtgatagcatttgattgtgttgattttttttttttagctgccaagacgaattgttagatgtttttaaaacattatatacccttatgcccttggtgtctctgatgaagcagattcattaaataaacactcacttatgaatagcagagccagcacagtcatagtggatgaagtttataggttattgacggacggtaggaaatcagttgaaagatgcccggaaacatgtggttatgttggtaggaagtagaaaacgcctgcctggagtccttcagatcccacaacgtatgcgtgtgcatcttctcaggctccgtattagccctggtacgcacagagacacacagcgaccagcctattagttgcctggcagatgccgtcagtactggtcattttgtgaatgcttttaatatgattcacagaatgtctgtagtcagtcacgttttagcactgacagtaaaatgtcacctcttcagcagttttcttttaaaaaaggtgtaaagcctcttaaaaatttttgctttaaactcctatcgatcgtttagaaatcttattagcttgctttgggctttcttttagagttggagaaattaaaatttagagaccaggttgggctgagaaaactgcgtggagaaggggaacttgagttgaatcttacttacaccagacagtagggacactaaagaaggcaatactgctggaagataaaagttgacagctttatgaaagaaggaaacaagtgaatgagataattcggctgagagctcccggaaagcaagaattctttttcatctgtgccctcagtccctagttggagtacagcccaaagtaaggttcaataaatatttgtttaatgaataaacaaatggatgaacaaactgaaataagtgttgatatttgttatgaaatatgcctttctcagactgttccacacacctcaccctggctgtgccaagtttctatggctgcacaacaaactactccaacacttagtggcttataacagcagatggaggttcacaggcttccactggacagttctccttgacatctgttctgcagtcagaaggcaactggaactgaggtttccggtggctccgcttgactacagggatgttgggctgtctccttctcagggcctctgctctttgtgtggcttttccagcagagccgctgaacttctaacatagtgtggctcagggcttccaaaaagcacaaagggagaagcttccaggcctcccaaaggctaagacctggaactgtcactgtgttgctccctcttttagttaagcagacaagggggccagaccagattcaaagggagggaaaagaaaccccacctcatgatgaggcaccactgttttcccatcgataactggtatcaacccagcatcctacagctcaattcagttctgacactcaccatcccgacttagtacagaccctacaggttaagggctcagtccccttagactgcccccacttcagatgccagctgaaagtggaatatgcccaagttacccacacttcttcctggctgactacaaatgtgggggttgggagaacccccaggtttggcaattcactagaatgactcacagaactaaggaaagtgctatacttacaattacagtttattataaatgatacaattgaacaaccagctgagaatttatgtagggtgagggccagaagggtcttgagtgcaggaacttctgtccccatgaatgggacatatcactgtcctggtacatcatattttcaccaaccagaaagttcctgaaccccattgttcaagagtgaacaatgcaggcttcattgcacaggcatgattgaggaaataattggccattgatggttaactcaatctccagtccctgtcatttccccagaggtcagggacaaggttgaaagttcctctaattatgtatccatgtggctggcaccttcctggaaactatctaagggcacaccttgagtcaccttgatagcataaagatacagctcaaaggggttcattatgaacaacaaaagatgttcctgtcactcaggaatttcaaatggtttttgaagctctgtgcctcgggaactagggacaaagacaaaatagattttgctgttctatcacagggttgatgacaaagaatgtgtggccatctttaatctgtgacactggtcctctgcagactcaagcaaaatagatgaaattttacaaaggactgttttcctatcatttgcttagaaaattaccctacatgtttatcccactttcccctagagcaggtttctggaaagctaatgctatgtcttacgtatacataaacggatgaatgagacaaagtttgttgcattggtatgtgtgttggggggataggagggtgatgggagagcctcctggaatagtcttagagttggacactgtttccccttgtgactccttttgcagctactgccttgatcccctcttgtgcctgctaggctctgccttggggaaagctcaactcttctgtttccctacacttgaccgactgtctccatcgttgccttgcccatcttgtgttgtgtccacccaaacctgactcagatctactagttttcatctttcgctcacggactattctcttgagccagattcctagtcccctaactcaatcatcttattctggcttctccagtgttctttcaacccaatcttgctaaaaagctattttaatgcccgactgtggatttttggcatcgttatctcagcaggcctagcttggaggttcctctgggatttcctgctggagtcttctttttaggatttcccagtctacttgggatacttaaggaaaattatcaccttgtcttaggaagaatcttattatctcaaatcaaatatttaaaattgcaatgctcccttatctggaattttattttgtaagggacattttctgataagctgccaatgacagcctatgatatgaaattctgtatgtccctttgggttcaacagtaaccttaatgggatagttttgtctccctgtctcacctcaggtaacagaaattgtcaagtgcaaagaaacttttgtatccttcccacatccagagctagcttggagtttgaccttaggcaacaaccaactaactgtgccttgaagataactctctggggagttaattaggatagactgaataattcaaggggcagttttggtgaattaaattgggaaaagattttcgagtgttaaaggttgaagcattcccttcctattatttcagctcttacctctactttctcaatatacattaaagaaaagcaaatctgttcaatagatttgagataatctattaatttagaatgcttactagaagcccaccatggggctaggctccacaaagtttgaattgtggttatactgtcggttgttttttaaaaatgtacagcaaaatcctaggcgatcttcatgaactactccagaggccaccatcctagaaatctaaactcagctctcctttaagattagtcattttcttatccaaacaccacagagctttttacatagctttattacagtgcttcagatattgtcttgtaattatttgtttctcaacctgtcttacctattggacctgattaatttagaggtgggaggctgctggcttcatttccttatccaatcatttaaattaagcatctgacaggtaccaggcactatatttggttctagtgttccaaaggaagtagacaatcctcattttgtatgtattcttcttcttcttcttttttttttttttttaggtggagtctcactctgttgcccaggctggagcgcagtgacatgatctcggctcactgaaacctccacctcctgggttcaggtgattctccttgaactcggcctcccacgtagctgggactacaggcatacgccaccatgcccggctagcttttctatttttagtagagacagggtttcaccatgttggccaggccagtctcaaactcctgacctcaagtgatccacccaccttggcctcccaaagtgctgggattacacacatgagccaccacgcctggccccattttatatacatgctgtatgtttgttgcatgtgtcaatcattttgaagttgcatttccacttcacacactctttttttttaaacggataattaggaaattcagccattttgaagttacttgactctggttatggttgttttctaagctctgttaacacacctggtcaaaagtttggaagtcagacatgttttgtttgtcgtttttttttttttttctctgtcagacatggcctgcaccataagcttctgaaaaactctttgaggccagagacttggcttcattgatcttagtatctttggcaatgttttgttcgtagggaagattcagtaaaaggacatttggcatcagactaaaggaaatgtgttccattagatgtttaaatcacggtggtttattttcaaagccatagttttgtagtgtttctttacaacgtgattgaatttaaatgcactgggatgacttcctccaagaagaaggaaactggggggccgagaagatgtggcaaaagcagaaacatgtccatctctcattgggtagggacatcattcatttatttgttcccgtatcattttgcagattccttttcaacctgtacactggctgtctttctctcatccccaagtttcaagatctctggtggtatttcttttccatatcctttacctaccttgccttgctcctccacattcccaattccttcaatttttttttcctctctaatctgctgttttatggatgtcaagatatactctagttactcagctcttaccttagaattgagacttcagagtttcccactaagttccctttgcgatacacaggaaagggaacattaagaggagcacactgagactttaagcaggaaaatcggtaaacgctgaccatactgaacaattaagtctactattacttactggttttcttcttcagagcataaaccgggcttccctttccccagacttggctactgtcccctggcttgcaataacccctggctcctcaaaactctatgccttatacatatgcctttccaagtactcttgccatttggaggatgggaagatactatgtcagagaatcccaggatctgattggatggatataattgtgactgcctcttcctccactgtcaggtaagtctctgaatgtgcctggctgctctgctttctctgagtgccttctgccatgagccaagcttttctgtcaccataagcaatccactcatctcttcaagcagggacacgcatctacgtgattggtggccagatcaaatttctgccttctagaaggcatctttcatatccagtctttcacccttaccagtaatgttatggtctagacttcattgacatggttcctccatggaagatcataatactgtttcccaacccagacatagcatctttctcaacacagaactctaggcaactgctttcattgattggagttgtcattcaaattcaaaatgaagcctacttggcatccctagcagctagtcttctcttgcctagatcattcctcttcatttatttctagccacttgcctcaaccccctcgagtttaaccattgccagttttgattggaaaacctatttattgaacatctctggtgatttttctgctgtacccagttacctctgaatgtgttgcccatctctggaagaagaggtattcctatatacacaccccacattcactgagggcttctctgtggttagttcataactctctttcatatgtggtagccaatgctccattaattaggaatgatgttgaccattctttcttctaaagtctgcacatattccttctggagttgtctgtcatgatagtgtcacacttcaacaatgttgaggctcctggtaaattctacagaaacatttccattttcctttgttttatgtacagaaatatagttattaattaggtccttgggcacaaaaatggaggcaggcatgtgccatttaacatgtgtgttagggttctccagagaaacagagctaataggagagagaaagagagatagacagataagaggagacttattatgggaattggctcatgtgatgatgaaagctgagaaactccataatctgcagtctgcaagctggagaaccagaagagctggtggtttaactcagtctgaaggcctgagaaccaggggagttgatggtgtaactaactcccaagaaccaggagctccaatatcccaggggaggaggaggtggatgtccttgctcaagaagagagagagtgaattccccctttccccatctttttgtcatattcaccttttcattgtattcaggcaggccctcaacagattgggtggtgtccgcccacattggtgagggcagatgtacttgactcagtctaccaattcaaatgccagtttcttctgaatacaccctgaaagactcatccagaaataaagttttaatagacatttgggtatcccttaacccagttcaactgacacataaaattaaccatcacaatatgcttcacatatgtttttaaaatagcttaattttttgtctataagtcttgtacatgggtagtggttgagttagtatcttatcccttgagtttgccaaccccttggatagggtcagtgtcttgggttctctgaatggcatttaacacatggtcacaaaaaccttggtctgaagaactttataatgataaagttcaaggtactttggtgtcttgaggaactccctggactgtgaggcagagactcgcttggctctagtcctggtgctggatctaactggctgccattgtggggctcccctaaagataaaggaactcagtttcctcatctgtgaaatgtgaggatggaattcatcaccatgtcccctcccagctctaaacttctctgagtcttgtttttccctgctctgtatcctccactttctggcatgttttttatatttactattataaatgtgtccctattttataagttgttacagcacgagagagaggtaaggaatagttaacaaaattgtattctgagtagcctaatattcttttttttttcctgctaaacttctttttcctcaccttctcctaacatttttgtgggggtgggtggactggtgggtgactgtagtgatattgatattcagagaggagtgaaaaatgcaaaattgcaaggttaacaacagatggttatatggtgccattttaggagtgttattaaaagaacaaatctattttcctgaatagtaggatgtcttaagtgtttaggcttaaatctactgttgaaatagaaaaagaggaggaagaggaggaggagaggaggaggggaaggaggaggagggggaggaaaagtcaaggaaacacttagaacatttttgcatgatctcaattttcttcttgttccaaggtttttaatttggacagtggtatgtgcttcagattgaatgcaaggaaatttgttgcaccatttgcctgacagttatcattttccttgacgaaaagtttttctgaatcttgctttgctggagctacctcttcccttgccctgaataacctcacttgcttaagtcatcgatgcagtggactgacaccacctttctcttaaggaattaccctgttctctgggtaggtctaatttacactcccactatcacccaaagaagagacactctctatattgataactagaaagaaggaactgagactgttgtccaaggacatcttatctttagcatagagcgaatatgtggtttatggtaggtgttcaacaaacttaaaaaaaaaaacttgtattagtctgctctcatgctgctgaataaagacatatcgaagactgggtaatttaaaaggaaagaggtttaatggattcacagttccacatggctggggaggcctcacagtcatgacagaaggcaaaagtcacgtcttatatggcagcaggcaagagagaatgagagccaagtaaaaggagaaaccccttataaaaccgtaagatttcacgagacttactcatttccatgagaacagtattggggaaatcactccccatgactcagttacctcccactgggtccctcccacaagacgtgggaattatgagagctacaattcaagatgagatttgggtagggacacagccaaaccatatcaaaacttaatcaaaaataattgaaatgtcaggaaatagagaaacttattgagcttttttagggaagtggtctttgaacctgttttgctctgcccactggagtatgctgtccatcaaattgttagttcagtgaattatggtacaaacactcagttacattaatatgactattttcttgtatgctaatttgagaacctactccctggagatatgttatcccatgtaatttccaagtgaaatggagagaggatgccttagactgttacttctcatgtttttcattccaatcttcctcagtgcccctctctataatcccaatcctatacatttttaaacaaaggaaagccactcagatcacagtagctcatggacattggtgagaaacgtgaggaaatgtagaggatccccaaattctcacacataaactaaggtgcagccactgggtatcaagcaaggtttcctcactggtttaatgactccagttttccacattgacatttgtgctgggagccttacatatatgattttgtaaaaccctttctgcagcccttcatggtaggtagcagaatatttaaccctattgtaagagacaggagaaaccaaactgctttttctattctcacccgccattctacacagttctccagcagaatcccactggatgtcctatagtttggcccggttctaacactgtctacctggagatagcctcagatctcacaggtaaagggctcagccccacaagactgcccttcacttaaaatgccaatcgcaagtcccagattgtggtctgtacttctgagcaactggccataaattgggggttcccccaggccctttgtcatgtttgattaatttgctagagtggctcacagaactcagggaaatgctttacttgctactgcccatttatcacaaaggattttttaaagatacaagtggacagccagatgaagagatagatgcatagaacatggtttggaagcatcctgagtgcaggagcttctgtccccatggaattggggaacactaccctttgggcacatggatgacatgcatgtgtttttgttcacaaactgagaagctctctgaacccagtccttttgggtttttatggaggcttcatcacataggcacaattgtttaaatcatttacataaatatgattgatcaactcttccctctcagatgttgaaggtgggactgagagtcccagccctctaatcatatggttggttcccctggcaaccaacccccatcctgaggctatccaggagcccccagccacaagtcaccctaatactatacaaaaggacgcttattttggagattccaagggttttaggagttgtgtgccagggatgaagaccaaatatatcttattataaatcacaatatcacacctattataaagcactacatataaagtttacactccaagaataaaagatacaaatatggaatcttcaaatgccaagggcctactggatactgtgaatgacaatataagctacatcacctgttattgaaaaccagaatgcaagtgtaaacttgaccagggaacctgcggagatggagaagtttgacacctctccagcagcatcatagaaatgaacatcatgagcgcattgagggggagggttaatgtcttcatcgttcttcctctggtagaattatatttgcatccttcctggtggaaacttgatacttcactgtagtgcacctgtacctgtttttttttttttttttttttttttactttcttggagggagagttcttctatctcagaagatagaagaaatagctggaaactctatattcctgtgccctagcacaggagaccaggggtctccaactggtctgtggccttttaggaactggaccacacagcaggaggtgagcagtgggcgagtaagcaaagcttcatctgtatttacagtgactccccatcactcatatttccacctgagttctgcgtcctatcagatcagcagcagcattagattctcattggagcacaagccctgttgtgaactgcatatgtgaggaatctaggatgtgtgctccttatgagaatctaatgcctgatgatctgtcactgtctcccatcacccccagatgggactgtctacagatgggactgtctagttgcagaaaaacaagctcagggctaccaccgatttgatactatggtgagtatgtaatgataataaagcgtacaataaatgtaatgtatttgaatcagcccaaagtcacccccaccgacccacccagtccatggaaaaattgtcttccatgaaaccagtccctgctgccaaaaaagttggggactgttgccctagcaggtagagcaagggtatttcacttaggcttgaccaatcgaatgccttcattctggattttggatctgggagaagtcttgcagagacgaagcaacatttgagaagggttttaaggctagtttgagtttagtgtgctggtcctggctgccatgcattgagcagatagttcctgtggtaagacctgctgcccaagccacccttggtttctgcctagttttctaacacttctgtcaattctccattcttgaatagtcttctaatataggccttttctgctttaggtagccagacagaactgttccttgcaaccagtgactgtctaattcagtcacttaatgttttgtagctttgttcagttactgggcacaacccactttctgctcaggcggcttggagacagccatgggccatatgaatcgctattattttaactttcatagtaagaacttgctccatgtgggaaagcataattattttggtttctgagtttaataagcagaaagcaaagaagaaaaaaaatactgtttgcactgagcattaaaatataaggaagtaaagttgtttatagatagagtttcagctaagcaccaaaggtttatttatattttttgccatttatattttctgcctagttctgcctaggaaccagggaaatccatggcaaggagaaaataaagcatcaaagaggatgaaaatgttgaataaagtattagaacccagaacacttaaatctttaacatccatagtaagagtccttcacattactcaggcagactttttttttttccacctcttggtattctgtgcctacacttgcatgtttaaataacgatttaaaaatcacatgagaaatgatcaggctttctttttcccacttgactctcagttatttcaattctttgagacttgttaaagaaaccgtttagtgttgtaaatgccaccaagtctctacctagtagagattagaaatcctctcaccaattccaagttaaaaaggtcctgacatattttgatggaattggcccatgttctcatttaccagtgaccagctcatctccatgctatgatgctccccaggaaatgtgcatggtttttgtagaaggtggcgagaagcttcatgggcaccagcatccacaacccacttcttgaaaaacaaaatcagatttatatttagctgaccacctggcaagatctcctgtaggaagagaaggaactatacccctattactatttcagcttttattcacaaagtctttatatttgaaaaatgctttataatcattttaattagtggtttctcaccaaagccctggatgtggtattattggcaccattttctgagaagaccgtgtgccattgagatggaattgacacaagatgttaatgggttagaagctggtactagaatcagaatgataggccataggactcagcaagccatgctatttactgtcatcttagagggctaggtagggtggagggaaggagttgatgactgattgttataagtgaaaagggcagcagtgacccaaaacaccattgcaaatgttaacagaggcctgttacagagttaaagctgggttttccaaaacaacacatctgagtaaaagcgcccttggtacattagccagtatggagccagcacctgagatcacactgtgtttgcccctttctgcaatggctattggtgctggttgcttgtcttggcctaagagttttcagctgggcttttgagcaagctgcatcttgaatctgaggatgcgggcaagccaggcacagaactgtgagggtccttgcaatgggctgctggtgttcctgtcattcataagcttggacttggtccccactgtgtttgatttgggagaggttctttgaccatacaactcttaccgtgtaaatgtgctacaatccttgtcaagacatagcaaactatatttgaacattgttttaccatttactgttgtgtgcatgtgggccatattttcctagtcagatggtgagttctgtgagggcaaaggctgagtcattctctatttacattttaagtaggcatccagagacttggttatattctgagtctgtattattgatcaaagccctcacctggagtttctggggccattcactgacccagaatctggtgacattgacacagggagggaataacatccagctacagatggttaacacaggtctttagtgccccaatccccattttgctgactcatctatgcctcaagaactccaatcttcatgcagattctgttgcccttgagtactcagttctgtctcttctgcatacctctgtggagccttggatcctgtcagactcttcgtgttgctgaagttctcagtcctctctctcagccgagtgtaatagtgccccagtgggcactgtagggacagaactgagtttcttcttttcttttaggagttgattctctccgggtaatatctggagctctctaaagtttcagagagaaatacgttccttataaaccttgtggttgtcatgctggtgactccttgagcctgtcctgtgctggaccgtgaggaaggacacaaggccatccagactcctggactcacagtgatttcttgtcctccccaaagatgcctttgcctggtgcactctttaatagcccatcacttcttgctggctgtgtccccagctgagttcctccaggatatggcatcaactctgaacacatctctgtatattccctcttaggaccataagattcatgttaaacttagtgccagaaataaccttgggtagccatgttccttatggttccttagattacattcctagattacacattttacattaaaaaaaaaaaaacaaaacccaaagcacctagaaccgtgctggattcttgataaatgcttgtatccattaaatacatattgaagtaacttctactccagtgacccctctcttgaggcttactgtttacctcctcactttggggagctacccagccaggaccttctgagagagaaaagtggtatatttagtagtcaccagatagttactgttaacggtgctgagttcttaaaaaaacctgttaattgtactagcttaagactaaagtatatgttcctctcctcgtagagtgatgatgatggttttataaatactggttggatagcactgtaattaatgggcacaccagcttttattttggtaacaatgtattcttataccacatttaagaggtttctctttcctgtggtcataaagtgattaaaaaaaaaaaagagaggagagagatgacatcctttttaataaggcatcccaagcagtctaagtacctatgaattataaatgaaaacttttcagtgattaaaataaatataccaatgcagtccccttctctgcgtcattgcttcgccaggcctgcatgaaaatcactcagaggaagtcccaaggggccctgagatcatttgcatctgttccatgtgtttctctgatttatatcagagtgcatcaagggcagtggccttccagctggtttgggaagagggattcttttatccagaggaggcatcagctgatggtcagttagggctctggagtgcagctccatgtaaacaactagcctttgtagtaatggccatataatataacctagtccatgttttgttccctcaagaaccaatttacaacatttaatgttcaaggatggttccattcctttctttgtttacacaggtgaggctttatttagtagtgggaagtgaagggcagatggtttaaggggttcttaatgctgcaggagaggcccataaactgaagtatccaagaaaatccattctaaataagaggcaaacagagtctcagatggatataaattagtattattcttaggaatccttccttcccatttctcagacttatagcaaagctcttactgatatcagtggccattgtgcaagtgggtagcagggaaatcaccctcaatgaccaaatggaagtacatgaggaaaaagatggagaatcctggataaagaagacaactggctgggctccatggctcacatctataatcccagcgctttgggaggctgatgcgggtggatcacttgatgttaggtgtttgagaccagcctgaccaacatgacaaaaccccatctctactaaaaataaaatacgtaaattagtcaggcgtggtggtgggcgtctgtaatcccagctgctcgggaggctgatgcaggagaatcgcttgaacccaagaggcagaggttgcagtgagccaagattgcaccactgcactccagcctgggcaacagagtgagactccatctcaaaaaaaaacacaaaaaactgtctttttctagccctatttatttcaccctacactccatttaccttttatttgttgttaattaaataacattaatttttgttgtaggattatacgtaagaaactattggccttttgctgattgtgctggaatttaaaagttgtagggattgtgggccattgttctaaaatggctcattttgccaaacatgattaatggcttttggggtgcagtttatgtcaaggcaaaattagtggacacttcagcaaactggaatgtggttctgagctaaggggatattcacttagccattcctagacctttcttctatcagaacacgtctttaaggttgaatatccaacattttcaaacattttagtcttaaattctacctttagagtattattgatggtctgattagataatgaaataaattttctctcagcaatgtctgtaataaaacataatgcaggaaagatagcatttaataaaatatttgtttaatgttaataatatttattaccatcagattagaatcaagttaacatcaaattagtaagagatatgtcagtcacaggacttgtagggatgcgagaaaaagaccaccagagaaactgaagaaacaactggaatcatctttgaagaatttcaaactcatcattgagacattggcgagactgggaaaattatttctgaatcttgaaagaatgatgccccaagaccagatcatttaaccattatgtgtctggagagccatcatgcttcctggtatatttactgtggaaaaccctgactctcaaaaattaaaggaaaattacaactgtaataaattggcctgaattgcatggattcataagaccactctctttccatttcttcctacttaatgttgttttcacatagtgatcacttagcagagtttgggaataataactggcaaaaaagctaaaattcttagtccctaaaggaaaagtttgcaaacttattatttaatgttttaaaacccctttcccccgatgaatgttaccctgtccctaggagaagcttctctttcatgagttcatagatcaacagtggaaagatgattgtatttttgagccttgaggttcaactttttctcttctaagtcttttattctgcaagagcccttttgaatgatttaaaatggcattctccatttattcgtatttatcgaaaatctatttggagcaaggtattacatttaaagacagagaagaaatggttcatccactcagctaatatttattgtgtgtacactatgtagctacaagctgggaacagagtggagagcaaaagaagacaccattcctgctcttctacagttgagtctggtagaggagacattcatgattcattttttttttttttttgaagcggtataaccacccagtgggttcacattgcctgctgccttcacagagccaatgtatcgagacaggggaattgcagtgaagaaagagtaattcacacagagccagctgtgcaggaatgagagttttattattactgaaatcagtctcctgaagcattcagggatcagagtttttaaagataatttggcaggtaggggctcaggaagcgaggagtgatgattggtcaggttggagatggaatcatagaggggtcgaagtgagtttttcttgctgtctatgttcctgggtggaatggcagaattggttgagccacattactggtctgggtggtgtcagctgatccatggagtgcagagtctgcaaaatatctcaagaactgatgttaggttttacaatagtgatgttatccccaggagcaatttggggaggttcagactcttggagccagaggctgcatgacccctaaactgtaatttctaatcttgtagctaatttgttagtactgcaaaggcagactggtccctaggcaagaagggggtctacgtgggaaagggctgctagcaattttgcttcagagtcaaaccatggacagaattccttcccaaagttagttcagcctacgcccaagaatgaacaaggacagcttaaaggatagaaacaagatggagtaggttaggtctgatttctttcaccatcataatttcctcagttaaaattttgtaaaggtggtttcaatggagcctcactctgttgcccaggttggagcgtactggttccatctcagcttactgcaacctctacctcctgggttcaagcgattcttgtgtctcagcctcccaagtaggtaggattacaggcatctgccaccacactgggctaatttttttgtggatttttagtagagatggggtttcaccatgttggccaggctgatctcaaacttctgacctcaagtgatccacctgccttggcctcccaaaatgctgggattacaggtgtgaaccaccacgcccagccatgaatctttagattactcaagtaaatgtaaaattataagtgtggtaaatgacaggagatgtatagtagaggaatctcatctgtctagggataaagggctcccctgtggaagtgatatttaagggaagattaaaggattaagaacaattaatttgggaagggatggtgtcttagtctgttctctgttacctgagactgagtaatttattttaaaaactcagaaatttattttttacggttccagaggctaagaagtccaaagttaatgggctgtcatttggcaagaaccttcttgctctatcatctcatggtggagggcaggaaagcaagagagcacacatgccacagagagcaacagagggccaaactcacttttataacaagcccagtcttatgatacaaacctactctcacaataatgacatcaatccattcatgagggctctgccctcatgacctaaccacctctaagttctacctctcaacactcttgcattgggggttaagtttccaactcatgaacttcagaggacacattcaaatcatagcattctgcctctggtattcaaaattcacattcttctcacatgtaaaatatatttatttcataccaattgctctaaaaatcttaactcattccaacatcagcttaaaagtccaaagtccatagtctcatctaaatcagatatgtgtgagactcaaggcatgattcaccctgaggcaaattcccctccagctgtgagcctgtgaaattaaacaatttatctatttttgatacaatggtgagacaggcataggatagccattcttattccaaaatggagaaataggcaagaaaaaaagagtaactagtcccaagtgagttcaaaacccaacaggaaaaacaacataaagtcgtaaatctggagaataatctccacacccttaatattgtctcccaaacatgcttttttcattctttacatggccaggctgaaaattttcaaaacttttactttcttcttcccttttagttacaaatttgtctttaaatcatttccttcttattttactgtaagtggctgaaagaagccatgcagcaccttcaactttgctacttaggcatttgctacttagcctagttcatcactcttaagttctgccttccataaagtcctaggacatagacacaattccaccaagtttgtaactgtatcacaaggatggcctttactccagtttccaatacactgttcctcagatccatctgagacttcatcaggatggccattactgtccatgtttctaccaacatactgatcatgacgtcttaagtaacctctaggaaatcccagtttctctgcagttcttttcttcctctgagttctcaccagaatcacccttaatgccccattcatgacaatctatgcttcttaaaatcttgctcctccaaattcttccagcctctacctattactaaattccaaagcttcttccgtgttttcaggtatttgttactgtaataaaccctcttctcgataccaattttttgtcttagtttattttgtgctgtttataacagaataccagagactgggtaatttataaagaaaagaaagccagcgtctggcaagaaccttcttgctgcatgatcctgtggcagaaggcagaagggcaagagaacatgtgcacaagagagaacaaaagagggccgaactcacttttataacaaaccactcttgcaataatgacattaatctattcatgagccctcatgacctaattgcctgttaaaggtcccacttcccaacactgttgcatggggattaggtttccagcacataaactttggagaacacattcaaatcgtagcacatggggtacagaattatattgcagatacagacagcagctcatgccaatgctgtgtggtaagagaaagcacagggctattgaaagaatgaacaagggtaagggcactggcacccagagggcaaggaagagtacaggtgggatgaatccagagtgggaggtggagactaccaccaggctatgcaggaccttataaccactttaaaaatttgagaagtctgggtgcagtggctcatgcctgtaatcccagcactttgggaggccaaggcgggcagatcacgaagtcaggagattgagaccatcctggctaacatggtgaaaccccatctctactaaaaatacaaaaaattagctgggcatggtggcaggcgtctgtagtcccagctattcaggagactaaggcaggagaatggcatgaacctgggaggcagagcttgcagtgagccgagattgcaccactgcactccagcctgggtgacagagcaagactccatctaaaaaaaaaaaaaaaaaaaaaaaaaattgagagataggagggtcacttgaggccaggagttcaagaccagcctgggcaacatagcaagaacccatctctacaaaaaaatagaaaaaaattatttgggtatggtgatgcaaacctgtagtctcagctactcaggaggctgagggtgggaagatcacttgtgtccatgagttcgaggctgcagtaagctggtattgtgccactgcactccagcctgggcaacagagtgagaccctgtcttttaaaaaaatgagggttttattcaaagaacaatggaaaatcattgatgggttttaagcagtaaacatgaagggaacacatttgtggtttgcaaagattgctttagtgcctttggagaggagtggtagtaagatcatccagggtgctattgttcccaggtgaaagatgcaataattcaggtggaccccttaaagaaagagatatggatgagttctagagatgtggaagaggcagaatcaatagaacttggtattgattgaatatggtgtgggggcagggttattagcatggcccctagatttctagcctgctgagtaggatgaatggtcacaccattcactgagatagaaagctgagataaaacaagatttaggaggaaagttgacttttactttggacaggttgaattcaaagtatagtatggtgtcataaagtaagctgttgttacatagcctaaaaatgagtggatttttaaaaggtcaagatgggcagaagtagagcattccagttatctaacattgcatgataaagtcccaacagttatggcttaaaacaacatttactgtgctcattaatctgaattttggcaaggcttggtggatagcttatctccgcaccacttggtgtcagctgggggagcctgaggctggggttggaatcataagacagcttgctcactcaaatgtatggcagttgatgctggctgttggccgaacttgagcaggggttgtggctggagcacctactcgtgtcctttacatgtggctgcttagcttcttcagagcttggtctgctgggtttcaaggtgagtgtcacaagaataaagtgagagccagacagagactatcacctttcatgacctcgcctcagaagtcatctagcatcacttccatggcattctgttcattagacatggcccagccatattcagggtaaggggaattagagttcactcttcaatggggggagtgttgaagaatttgacaacatgttttaaaaccaccacatggcggggcagagaagaaatcagttatcattccagctggaaggaacaggttgaaacgggaaggtagaaattatattcaatagaagtggagtggttgctgttggctggcctggagcatgtatgaagggttatgaacagtgtgaaatataggttaaaggaacgtttgggaccaaattatggtggagcccaaatttcctgaaacccattattttgaatctggaaacaaattgtcagagaggaatacaaatcagatttattaaataaagataaaaagtagaagcaaacagtgactggcatgggataggaataattctacttgctgataaaataattcatgccaattttggggtgtctagtctacagatttggggtcatatatctccaaatttaaattgtagacatattcaaatgtctttagttgggctttgtaccttatgccagtcaaaaacatgagtcaaaaaaatcatgcctgtatggttcccttcggaggtatctctcctttatcctttagcagattaagataagaatcttggtctttttgatcctggctgtggcttcaaatttttcccatcttactattgggctacccaaaaggactgcatcagacaagactggtgagttgaatagtgttcctcccaaattcacgtctacctggaacctcagaatgttactttatatggaaataggaactttgtagatgtaattagttaaggttcttgagatgaaatcatcctggatttagggtgggccctgaatccaattattgttgtcattaagaaattgagaaggcacagagacaaagcaaagaagcccatggggagatgcagaagctgaccttggagttatgcatctagaaccaaggaatgccaggagcaccagaagctggaagaggcaagaaaggattcttccctagagccttcagagggagcgtgaccctgtcaacaccttgattccagacttcgggcctctaaaactcagagagaataaatttctgttttaagccacgtagtttgtggcaacttcttatggcagtcctaggaaattatacacgaagttagagccaggcatgatgtattagtccattctcacactgctataaaaaattacctgagactgggtaatttgtaaagaaaagaggatccccaggctctatggaaagcatgcctggggagacttcaggaaacttacaatcatggcagaaggttaaggggaagcaggcacgtcttacatagcccaagcagaaggaagagaaattgctgcgaggtgctacatacttctaaacaaccagatctcgtaagaactcactcactgccaagagaacagcaagggggaaatccacccctaccacccagtcacctcccaccaggccctcctccacattgatccaatcacctcctaccaggcccctctttcaaccttggggattacaatttgacatgagatttgggtagggacgcaaatccaatccatgtcacgtggaaaatatgggtgttggtttgccagatgccaaacagaaacaacatttgatctgttgataattgtgtatcctctttatcaggtctatcttaaggaaatcagagagtagagcatattttcttcatggaatggtgagacacatattagcctgagacaggagctaaggagagtgagtggtgggctccaccaaagtgccttcatacaactacactggtaggtgatcagaacaaagggacacgtagaacgaagacccgggtgtgtaacccaaatgcctaacaaagtccattcaatgtatgaggtgttgctgctgtgtgctgaaggaggaaacctgggtcttagtctctgttatggtaaatagagaagaaatcaagccttcctacgacaataggggatttttaatgaagtaaaggagacagaagaaatgtcccaaaggagaatgaagtatgtcaaaaacagattgcgcatgtaattactttctcaggccttcctgacattatcagcaggacttgtgttttgatgaaaaaacttaattaaaacttaatttttttaagtggaaaatattcagcatggttacaggaagactgaaatcagggcactgtgtaattttaattgccttcgagagatgcacttcacgtgaagactagcatgggggaaaaaagctagaggcacaaagtctgaggggagtggccacgctgaatctctagctgtgtgcttgggcgccattttccccactcttacagttgacgggatggcatctcaggtttcacgtgtaggggaggagagtgggtctgttctggagtgtgccggtcaggccatacttggcatacacattgtagaaagtgtcttgatttttattctcctaaaaagggtaaaaagagattgaggagattacatatcccatgaggcagcagtttttaaatgccactctctggatcagttctatcagaaccatctggttctgattcatttaatctgttttaggacctgtgcacagtgtttctattttaaaaataaacctgtcctactcattcttggagtcaggtgtgggaactacaggtttttaatggaagaaacatgaacttgaaaatgagtaaatatgggctacgtcctttacttcccaaggagatttgggttgactgcttagtttcctccatcaaatggggataatatgcttatttgatggggttttgtgaaaataaaagataacacaggtaaagtgactgacacatacagttaagtggtctaaaaatgataaaactgtagaagaagagttggatcaggctgcttgctaaattgggaagggataaggtagtgttcttcagatatttcaagggcagctgcatgagagagagagagagagagagagagtgtgtgtgtgtgtgtgtgtgtgtgtgcgcatgcagcctttagaggtcagactcaagtccagcaggtagaagttatagggagataaatttcaacgcaacagaaagtggaactgtctagtgaatggtccagggatgtcatcagtttgctccagagggtagtacgttccaaatcactggagcaattaaagcagctgccatattttgaggatgtacagggctgtggggcagcaattgaatgagaccacttggttcagctctgtaatagggtttctggcttcctgtggggctgtggctgacatacagttgttttgtaaactaacaacacttgaagaaggttttagcagaaaacgtttaccagtaagatatgtcaggtcaagtacactgttttaggtattctttactggggacattcttgtgaccttcatcccaggcctttcagaaaagggatggggcatatttagaagttattaatgactgagaagctcctctggcacttcaggggagggaactagagctataaaatgtcctgtgattgttctaggactttctccttagtttagctaacatctgggtccttgtcacacggctatgaaatattaggcttacagacactttgaagggtgagaaaaatggaatttattgggtaaaaaggaaaaaaagggaaacagggatgctctgcagagccagattcctgctagtgtgcttcctgcctcacagactgaatcccaggtaccacccaggaagaggaggggccaggctcctccccactgcaaatggcatgaacttcccaagacccctcccccagtgtgcaggccacttggaggttctctggtgacccctttatatttggctgtctcattatgaatgggacaggagtgcgaaattatcccacttcaaatgtcacttgctctctgttgggaaaccctatacctcactgaagcccagatgatctccctgaaccagcctttgagggtcctttttggagccctttggaaacctggtattggatgggttgggttacagggctgctcagcctgacagcctcgcattatctggtgaccacagagtttaaagcagaacattgggaagaaggtagactgggccagttgcacaaagcagagtgtgaagagtgatgggagatgaaggctgtttgcctgcttttcactggggaccagatttggatggatgctggtccaatatgagtgacacagttaacttatcagtgagatccctcattcttctcatcagtgagatagctgggtattgggggaacctgcccccagtatttcaatgtaggttctttctattttccataatatcagctggctgagaaataaagagaaagagtacaaagagaggaattttacacctgggccgccgggggtgacatcacatatcggtaggaccttgatgcctgcccaagccttgaaaccagcaagtttttattaaggatttcaaaaggggagggggtgtacgaccagggagtaggtacaaagatcacatgcttcaaagggcaaaaggtagaacaaagatcatatgcttctggggaaacagaacaaagggcaaaaggcagaactcctgataagggtctatgttcagtggtgcacgtattatcttgataaacatcttaaacaacagaaaacagagttcgagagcagagaactggtctgaccaaaaatttaccagggtggagtttcccaatcctagtaagcctgaagttactgcaggagaccagggcgtatctcagtccttatctcaaccgcataggacagacattcccagagcggccgtttatagacctcgccccaggaatgcattcgtttcctagcgtattaatattaatattccttgctaggaaaataatttagtgatatctctcctacttgcacaaccgtttataggctctcggcaagaagaaaaatatgtctctttttgcctgaccccgcaggcagtcagaccttatggttgtcttcccttgttccctaaaagtcgctgttattctgttctttttcaaggtacactgatttcatattgttcaaacacacgttttacaatcaatttgtgcagttaacacaattatcacagtgatcctgaggtgatgtacctcctcagcttatgaagataacggtattaagagattaaagtaaagacaggtatgaattataaaagtattaatttgggaactgatacatgtccatattaaaatgaaatcttcacaatttatgttcctctgctgtggctccagccagtccctctgtttggggggggtccctgacttccaacagctggggaccacttaatcagggtaagggcagtagtttgtgttcacagtttgatctccctgcatggtgctaaccaggctgcatggggatctaatgtctgactttggccacggcatcaggctccagccaactgacgtgaaagcaagtttccaaatcgtctctttctaaatagataaatgatactcagtgttcctttagccttccttattttttgcaaatgcctgtccccagtggttctgttgtttgctctgattgccgttttccccagtaagtgggaaaaccccacatcttttccccatcagtattccctaatgaggcttgttccctcaaggggaccttgatgagttacaacagcatgaccatgttcccaagcagcatgctaagaaaaacaatccccagtgatgccctgcaggcaccatttaggagcgggcggtaatgaatccctgagagaattcagtcctccgtatgaaggtgatccagagtgaagtaaacaatttcaccgttaggtggttcaccctgcatgcctcattgctggctttctggaaagccagtaaataaggcagaaaaaatgtatcattccctccagagtgcagggtcccctgtcacccacacaggactcctgcctgtcactttgagtcacagctgggctttctggaacccggattcttgtctctggttagctcaggtcttgcagccatgccaaatccaaactgtgacattgtctgaacagtagggcatcctgttccctggtttggctgagctctgcggagcagaacagtggccgaggttaacatcagataatttcctccaccattcctgagtaccctgagggcttgttacctggaatcaaagacttgtcagaactcaagatgaccttaaaggccagcttattcaacctcccacccaggatatgacttccagaactaaccacccacaatgcagattagtaatatcatacgtggttactcaatgcaattgtgtcatttcaggagaaatgacctgttaccaaagtgtcatgaaacccacattaatgagctgggctgtagtggaggtttactttgatttctgaccttaattattagtggtttggattctttacgtttatgatggattttctgattaccaattatgattcactgtaagccatttttaaaaatatgacatgaagctctgacccacttttaacaacacagtggcaaatgccaaacaattggcaatttccccttctaatatcagctgtttgaatcatcacatctactgtggtggctggggaccactttatcttcattctctggcttcagtattcttttctggtattgtcattactgacctaggtgcatatctgtactaggctgggacctcagctctatgccagtgagaaaatgaggttcaactgggaaaacggcctggagcagttgctctcaggcttgtctgcagattagaatcacctgtagacttttaaaaaatactgacacttgggttccgctcttggaaattctaatggatctggggtgcagcctgggcatctggaattttacagtctacctgagtaattccaatgagcaggtgggtggccttgcaaaccggggtctgaaggggctggtcagcaaggagtatgggcaaaatagtgctggctggctgggcgcagtggcttacgcctgtgatcccagcatttgggaggctgaggcaggaggatcatgaggtcaagagttcgagaacagcctggccaacatggtgaaaccttgtctctactaaagatacaaaaaattagctgggcgtggtggcacgggcctgtaatcccagctacttgggaagctgaggcaggagaatcacttgaacccaggaggcagaggttgcagtgagccaagatcccacttggctgccactgcactccagcctgggtgacagggtgagactccatctcaaaaaaaaaaaaaaaaaaaaaaaaatagtggtggccaaggggtgtttataaaacagagttgtgatacatgttcatacattcacctttgaggtctgatttggtggtagcaggagtttcaggggaaatgtttactgatcaggttgatgagtgtccagggacaagatgtgtctgctaagagttagattgatggcaaagattgggcagattgatagttctctagcaaataagatgagatctgctatttcagcaggaaacaagtaaggaagttgaacaaaaagctagtggtatgggccatgtccacaagctgtggttaaaggcaaaggctgaagcctgattggcgtgcccacactgggctgggcactgtcagggacagccaggctgactccagagcctgccttctggttggcttctcccggcttaagtctggccctgcaggaaaaccgacaggagttttcatgccaaccaagactgagacaatcagagactggcaggtttggaaccaggaggtctggatggggaggttggctctgaatctgttgtcattatcaggtgagtcattaggaccacctggaaaagtgaagctgttcttcaccttctcttcttgtgaaagtgattcaatctcccaaacccaggttgatcataccctttaggtctaatataggaagtgttgaattaggtgatgtctctaaagaactctctctgggttccttagagaaaaatagcatttgaacattgtgcctcagcaggaaagaagatgcaatttaagtcctgcaccaaggcattcagggctcacctcaaagtggactcctaggaacaagaagcaaatgattccgtggagagggttagatgtctggccaatggaaacggggatgtagttcaggttttctagccccagaagttcagaacctttgggttcctcggtggacatgtctgttactcgcttgaaactagggaaagtctcttgtgtagaaaacctgttgcatgtcccttgactaccagtagcagcagaggtgctatgtgtggctgaagaattttcctcctttttctgagagatgatttcccaggtttccttctccacaattctgtgggcgtgtactgctgtgataagatgtttgttctctggcttataaattacaagatattttcaggaccacttggaagaaattggaacattttcctggaggcagtgggggagctgctggaggttttcggacaggcgggccacatgctgagagaggtattttgggaaaatgcacttggcagtcatgtgtgggtgaggataataatattaatacttaaccactggcttgttgggaagagtaaggggaacaatgtaagtgagtgtaaagatgcaggaccaccattcctttgttcattctttttttttctttttctttttttatactttacattctgggatacatgtgcagaacgtgcaggtttgttacataggtatacatgtgccatggtggtttgctgcacccatcaacctgccatctacattaggtatttctcctaatgctatccctcccttagccccgcactttgtccattcttttagtttctctgagacctggtgccccaaggataccatcttctcctgaccagtgtatcagtttgcgagagttgccataaaaaaatagcacagactgggtggcttcaacaacagaaatatattttctcatagttctgtaggtgggaagcctgagaatgaaaggcatcggtagggctggtccctcctcagggccgcgagggcagggtctattccaggccttcctccttggcttgtagatggtcaccctcttccctgtctcttcatgtcatcatctctctttgtgtccgaatttcttcttctcgtgaggacaccagtcatattggattagggcccaccctaatgactgcattttaacttaattacctctgaaaagatcctgtctccaaagatggtcatatgtgagatactggggttaggacttccacatataattttttgaggggatacaattcagtccataacagccagtctttttgaagactttctcttttgggggctttacacttaggtaattacaggatattttaaggggtatttcaagacccagcaacccccttctccacccaccatctcccccaaattatgttcgtcacctcctggtacctgttatatcatcactagaattgcttggttgaatcaagtaatgtttcaagataatttccgtaaacatgcactctttttatgtaagaggggtaataatagagccagtgaaatactggatgaattcatttaccaaactacgtaaaagtactgatatatgacaactacttagggaacctaagatttgggacatagagcagcctatttagaatatccggtataacattgcagggaatagcaagggctctagagctttccgcctgggttgaaatctcagctccacccttttctttctgtgtggcattcagcaagttacttaacccacctgtgattcttccttcatctgaacaagcagcataacaatagcatttacctcatgattctttagaaggtgaatgagctaatacctaatatagtgcttagagtagtgtcttgtctgtggttggctttcaataaatgttagctgctattgttgttgttaaactatttaacaaactacgaagcacattcctatctgctttcttctttgcccttgtaacagccctgtggagtagaaggagttagttacattttacagatgaagagactgaggctctaagacattatgcgaaccatctcagggcatatggcagtgttattcagaacatctatcggtaaagaacaagaattccaaaaatataggattttccccaggaaggagggccagagtgtgggctactgtgggatggcctccgggcagagtgtgagggtaggcgctccaaagagtaaggcatctggagaagagaaacaatgaaagaggcaaacgctggatgagaaggacctcaaagcagaactttgcctctcggcctctcagtcaattgtgatctgactgacatccagattgtgatcttgttcaggtggctgaactttgaacccttcttggccatttgatgctaaaggcagtctttgaatgtgatgttttcctagatcgtactggtggaatttagttgcctcagatttcccagtcatgtgccagcactgccaagtgatctccatgtgtgggttttatgatgtgtttccagtgctccacatatggcctgtgatttttttttcctatggctcctaatgaaacactcagaacactgcactgaatagaagtttctccctattctccagagtggggatccttattgcatcgtcaagcatggacaccaaaaataaatggggagaaatctctattctcttagtgatgaggcactcttggaggaagatattattaacatgactacgtcttgccaatttgaaactttgcaaatatctgtaaggttgaccagtttttataatttcaagattttaagttcaacttaaggtactttacaaaattatttttatcataataaattacagttctttacacctgtgtcttttaccgattagattgtgagctactttatgggtgagcaccagtatctacttaactttgtactaaatggctcaatattgcctggaaaatagtaggtgcccaataaatagtaaatgttgttcgatcaaatcataaatgtagatataagctaaacctcttccctgggcaactggaaatgcccatgttatgtcttaaaacacattgaattcaggtgggagaataaaaatgattttaacaaatccagtgtgctttttgaaggcagaactacaattacttcttttttccctcataatcaaatcaacctgtgaaattggaagccaataaatatgtaaaaaagtcatcaaatgtcataggagaggactactatttgattcacacgtgatctttgtcgtttaattgcgtgtggcaagaatgaatggaagtgatattaagtggagaaaaactcagtcccattggtgagttatttaccttgaccactgtgatgggctgaattgtgttcccctaaaattcctatgttgaagtcctaacccccagtatctcagaatgtgactgtatttggagatacagtctttcaaaaggtgattaagttaaagtgaaaatgaggcctttgggatgggtcctaatccaatatggttgttgtctttacaagaagaaaacatttggccacatggagagatacaagggatgcacatgcatggaggaaagaacatgtgaagacatttacaagccataaaaagagccctttcagagactaaccgtgctgacaccttgactttgaacttccagccctccaggactgtgagaaaataaatttctgttgcttaagtcacacagtctgtggtattttattatgatagccctaccaaactaatacaaccacctactttttagaatttgtagaatccaagcacttaagattacaaaaatgcatgtttattgtggcactattcacaatagtgaagacttggaaccaatccaaatgcacatcaatgatagactggataaagaaaatgtggcacatatacaccatggaatgctatgcagccataaaagaggatgagttcgtgtcctttgcagagacttggatgaagctggaaaccatcattctcagcaaactaacacgagaacagaaaaccaaacaccgcatgttctcactcataagttgaacaatgagaacacatgagcacaaggaggggaacatcacataccagggcctgttgggggctggggagctacaggagggatagcattagaagaaatacctaatgtagatgacgggttgatgggtgcaccaaaccaccatggcacgtgtatacctatgtaagaaacctgcatgttctgcacatgtatcccagaactttaaagtataataataaaaaaaagcaataaagaggaggtgatggtaataggcacagacttttgcttgcgttgaggaaatattctaagtttcacaatggggtgtggaagaatctgtgcgaatctccttctgacctctcgtggtaccatttcctcattactcagtgatgaccccagagccagtcttggatgaggcggggtggaattttccacacaggtgccatgagctagggggctcaaaacagacactgtggtgaggttattactgaaatattctgtttctatgaagtttctaacgtaattctgggccctctttctacaaccttagcaagttgctgaactacaggagtgcggagtaacaatgcctttcatgtcaattctgtttacagccaggcttgcttgcattaaactggacacatccatcaactagagtgctggataacagatgagaaaaagctaagtttgagttgtcttttatattgtataatggtgcttctattttctttgttttcttcttgttcttaagttctgtgggaaacccacgggaagaggagtctatccagggtatttgacttcaaatcatttcatctcttctgttcttcctctcatctagtcctctgtgttcttgtaatatacgcaagggcaagattaatagtagaacagaattctgctatgaaatttaagtgatgtgaattctttctcaaaattccaagaatgaaaactttgactatgatatagccaataatttgcacttgtttgcatttgacattgctcatttacattaactagcgtaaaatacctaattagtacagcagaaaaaaaaaaactatatgaggaaaaaaagaaatgattgctcttttactcactggagggaaaggttggatttatttcagctctgtgtttagaaaaatacctttgctgggcttcttggagtgtgaaaagagtggaccctgacccacctctattccctgctgggccatctggaaggattttcacaacaaagataaggctaaaccactctgcaaaatgaaaccagaggaatttcatgagttctggggagtagaaagaagtagggtgagctctgacaaggatgatggggttgggcatgtgatgtctggagttggggctaaggaggccagtccaggagatggtccctgaggtaggatgggagtggggccaggcaactgtaagacagcgatgtctcatgttattgagctttgctatttcgtaacctctatctgccacactttctaaaacctttgcataactactgggtatctaccgagaggaaaagaagtcattatacgaaaaagatacttgtatatgcatatttatggcagcacaattcgcaattgcaaaaatatgtaaccagtccaaatgcccatcaatcaatgagtggataaagacactgtgagatacacatatatatatacacacacacacatatatatacatatacatatgtgtgtatatatatatgatggaacaccacacagccataaaaaggaatgaataatggcatttgcagcaacctggatggaactggagaccattattctaagtgaagtaactcaggaatggaaacccaaacatcatatgttctcactcataagtgggagctaagctatgaggatgcaaaggcataagaataatacaatgaacttcggggacttgggagaaagaatgggaggtgggtgaggaataaaagactacaaattgggttcagtgtatactgctcaggtgatggatgcaccacggtctcacaaatcaccactaaaatacttactcatgtaaccaaataccacctgtttcccaaaaaccaatggaaataaaaaattaaaaaataataaaaataaaataaaatctttataagactactgtacctgttagagcctcctttctgggaaattaaaactctaattgtttccacattagcttatgaggtggttggtaaaagagaatgactacaggaaatgaaatgccaatgaggttgataattcagtgggaccaacaagtcacagtcaaccagtgatggagatggtaaacctactaggaatccacagaaattttgaggcaggtaccggactctcaagagtgtgtgagattggtgaggctttggcctgagccattgaaaataaatgcataaatagcaacacttagcagaccggaaaacatgggggaaaacccagacaagagacacttgggatttgtcagtaaaaaatggagttgtgaggctgggtgcagtggctcacgcctgtaatcccagtactttgggaggctgaggtgggcggatcacgaggtcaggcgttcgagaccagcctggccaacgtggtgaaaccccatctccactaaaaatacaaaaattagccaggtgtggtggcactcacctgtaatcgcaactactcaggaggctgaggtaggagaatcacttgaatctgggaggcaatggttgcagtgagccaagattgcaccactgcactccagcctgggcaacagagtgagactccatctcaaaaaaaaaaaaaaaaatgcagttgtggaagctttgaaatccctgctgtgaggttatggaaggagaatgtttctgttcaagtatgaatcttttttgggaggggtggcaagaggaaggtatgcaaagggaatggtgaataaaatgaaaaggttcgactttttggtggttagtcacctaagaaggttttgtgggggaaataatgtgttttagccagcaaggggattgtttaacctgccctctaccagtctgccgtgcctcacccacttgtctacagctgtcctgttagttgtagcattttgttttcttttatgcaaagggattttcttatgacactcaaggagaacccaggagagggaaggcatctctgccttccagggacaaagtttcagaactgtactgctctacagtggtaaaaagacaacaaagtctttgatttgcaggttgcttgtttcacttaccctgtgaagtggagctcagttggaatatttcatctggccactctttagatgttcacggcagccctgcctggccagccatgaggtcgggcggagaaaggaagcaaggatgagtgaggagggagagaaatggccctggagtttgttgttggagatcttctctgtgtcaaacatcttaagggaatcacctcatggaatcttcgccacaacccattgatatggggattattttccattttataatgaggaaatgaaaccttagaataacagcaagaagctcagacaactatgaagtggcagggtgcagttatgtgactcaaaaccagtgttattttcagaagtgggaaatgtcatgactttgccctcccctccccttctctctcttccttcctttttgttggctatcttgagctgaatggtgataacgcttaactagtggaggtacattttgaataaacagcgactgacttaaatttataatcataattttattctagagttttaacaaatggtaaaacatttagagttatttttccgcagacttgacaaaggtgatgcctgactgtgcctgccgtcatttttttctatttataaaatcagggtaaatttgcaaacttctaaagaagcagacatggcttcagcaaccagtcagggtggaggtgagaccaggaaggttggagctcatgaaaggtcctcctcttctgtctaaggggcacttacttcattggtagctcagctgatactttgggaattccaagaaagagccaggaaccctgctaggaatagagaagcaaagaatccagggctctcactttgaattgctcaccacgtctagaacatgagtcaggcacagacacagaaaagtcagcataatgcgtatgtgcagtgattatgagatgcccatgcagcgtctttacaccagccagggatgcaaggaagaatctccggagaacatctacccaacaggtggatttgcttgtggggaacagaatctgtcaaggagaaacaaagcagtgcagtagttgcatcatcatgaggaaggatgatgtgcagagttagtttcctaagtggcatcgcctataatgagcagcgtgttctcctaccaccttagctgcaagcagttatgctgtatagccaacatctttctcctagctcacaattcaaaagcacattgctgggattccttgggggctttgcgtttatttgttgtggtctagtggtttattctggcaaaatacactgcatggatttttacagtttgctttgtgcttggacatctttccacccaagcaaaatgtttacaaatgccagcacgtcgttttctgaaaatattgctgaaaagaacaaatgtgttgtgatgtgccatgtgtttgaagagaccaggcaaccaaacactaagattgcctcttcctgtcagtgtttttgctcggaatcattctttattgtgcctgtttctccagaactctgtaatccaaaatggtcctgttctctgtggacatgtgtttattctgcaagttaaaaccctttcaagcaattcttgctgtgttaaatataacaatgcactgataaaattctgtcatacattctagaaaatacctttgtataaagtactcatattactgaatttaccaaaacagcataggtaacagattctaagatatcttagagttaattgataatatgtatctgaatgttgtaaaatttatctttcctatgcaaatcccttcaaaccatcccttctagtcccatttttgagacacacacacacacacacacacacacacacacacacacacacacagactgactttgttattccttactggtttttactgatggtcatagacgtctttcttctctgctacttccattatcttcctgccttcaaaatctccactttagttgcagttttgttttactatatttcttatttttaaaaatatataggtaaatagaaattgaaaagctcccattttttgttagattcatgaattcctttatgtaattatttttccaaaattaatcctgaatacagactagtaaatttatatgacaaagaaaatttctatgacaaagcaaaattaatgctgaatacagactagaacatttatatgacaaagaaaatagggaactgtgttgtttcacatactcaggagcttctgaattcaggaattttctagatggagaagatctcattatatggtgacaccagctagccaggtgtactactgaggtctgtctgtgttagactttagaaatagaccaaggatggagggaggtttgagaaatctaagtaaggaagcataggagaccttcttgtttgaggtcaaagaataattggaaggagtggttccatctcacaatttgaaaatgttctaaggaacaaaacgtacttttttatagacctattgatctcagaagatataacacagctggtggagggtaatgatcaatcgccagactaccaccattctattttcttctctgtcaaacgtactcactatattgtgagtgttttcactgcctaatttttcatggcaatttttgaggactggtagctgaactaatttaattctcattctctcacttgttcaccaaatcatttcatgtgtgtttttgccaggtattgttttaaatattgggcactattttcggttcagtaattcaacctattttaatcccttactagcccagttgtaaatttcaaataagtcattttttttcataccagttccctgctttcgagtctctgatgaggctacgctcaagtattacccaggattaggtcctatctgaaagctcaactggggaaggatccacatttgagcttgtttatgcagttgttggtagaattcagttcccttaggacggttggactggggggcctcagctcctagctgactgtgggccagagatcacccttggttccttgacagatgggcctgcccattagggcaaattgaagcatctaagtcagtgagggagagactctactggcaagacagaagtcacaattatatataatggaatcactgaagtgacatctcattatctttgtcatattccattggttagaagcaagttacagcacccacccacatacattcaggagggtgtgtattacacaagcacgtaaacaccaagagatgggatctttggagaccatcatagactctttcctccataccatctgaacatttaatattaatgtagtctgtatttctacataacagttctctgaaaggaaactttgctgtgtgccagataatactttttgatcttcttattttacctttccttaccccacccatgattattactatcaaagctttagggcataacatagtgctaaaatagaacacttactccaaaaatttaattaacaagcaacatgaaataaaaggccatttgcatattgtaggcaaataaaaacattatcaccaggagaagtgagtcagaatatatcaaatataatagctaatattaaatagctgggggtgagagttggaataatgagcagcctctgtacagagggcatgtcaatcaattactctggccctattggagcacctgcctagaagtccttgctgtgcctggttaacccatcagttgctgaatagtggggaggtctctggtggggattctgggaagaggggctgagcagtaattgcggagaaccctaggggatcccagcagtcactatttactaagacatttttattacctaatactctatggctaaatagttaaaagaattaaaaattctcaaatgctttcaaggttggagccagttcatggggtcaggagagctatctccaggcctgcattctactccccttctttttccatccctgccccatccctttcaggcagcacctggtgcacactcaggtgacccagcctacatgtcgaggatccacgtaaacacccctcaaacagatggtcccccgcaggcctcggaatgtggcaaggtctaccattaggaatgtaggctcaggaaaggctccttcaggccctgagagtggacgtggaatcctgatggcggggaatcccagggtcctgtgacccagagcatggtctagaactgtgctgggcagcacagcagccgcacattggctccagagcactggtcgagatgttccttaaatgtaaagtacacaaccaatttcgaagacttaatacaaaaaataaagggcgtaagatatctcatcaataatttttatgttgattatgtgctgacacggtagtgttttggatatactattgggttaaataaaatatataattaaattagttctaactgtttttttctaatatagctactaacaagtttaaagttctatgtgtagcttccatttgtggctcccataacatttctgtggaacagcactgctctagaagggagaagtacggctctgctaggacacatctcctgctaccttggaccccttgccctgtgaggaggaggagctagagcagagccctctaaagcgtggagtcccaggcaggagcctttcttgccccagggtggttttgctttaaggtgatatttatagtctatttggtctcactctgtcatggctaaatgactccaaatctctctcctttgcctacttctgggttttgcccaaggcaagaaaatagtcttcctcaccttccacctgcccacccccactgccactgccaccaccaccgcttttgaatcaatataaccaggcacagaaagtaaaattgttctgtattgacatgtatctttcaagaagctgttattctttgggtgaaacagaatctaatcactaagcaatttttctacagagagagggagacttttcactccccttccccttggtttgtagagtacattcatctttgataattgattcttcgggtggagtaatgatgtaggctcaggaatacgttttttgattcaaagggtataaaaagtgctatgtgtgttaggggttaatgtaagctctgtggaattacaatacggatgtcttctaaagaaaattcactaatctaatctctagagaaggaaacttttagagagtcccttatgactcccttaagaaattattgtggatagtatgttgctgtatgatggctttaagaatttatggtgaatgcttcagaccatggctttagtgtttcaacagaaacagtggcttacttagggtggtggtgcatcttgctcttgaataaatctgatctgagcttacaagtaggaaggagtaatgatttagatgtctgaaatctctttagtttattgtttcttttcttatcgtggcagagagtgactgttaaaactttttcctcctgggcacgtagctggcctacatttcccagcatcccttacagatggctgtggccatgtgactgagactggccaatgggatgctagtggaggtgatatattcttgtccaatcatctactctttctccttttcttctgcctatgagatgcagagtataggggcacatgggcaccacctgagaactctttaggaatgcagaatctttaaccttctcctaggtgtagggaatcagaatctgcattttaccaagattcccaggtaatacctatgctcattaacatttgagaaatattgccctttgagatgacagagccagtagatggaaagatcttgggtccctgccttgtggcttagaggagagccacccaggagtgtggcttcttgaagcagcctgtttagattggtacataaacaggaagtccaattttatcatgatgaggtcactgagattttggagttgtttgttatagcagttagtcttccctggataatatactcacaaagtatttaaacaatgccatgtacctacaatgtatccccttcttaccaataaattctgccaaccaaaatgatcatattgtacctacaatgtccaaaatgtttaatacagactgaggtagaccttataaatggtattggtgaagcctagtggacaattttaagaaatcaccaacattacaaaacgttgactggcaaacttgcgttcaccctatatatgctctgtaaatgttcctagctccctcacttttttgtctttttcttcttcaacggcctccttcacttttcagtagcagcaagattaagaggtgaaaactgccattactccagtgaatgggtgaggtcactgatttgcacaattcctatgagagcccaattaaaagaagatacagagataagcatgtacgttttcatctctcttaactccattatcttattgtcatttggctatgatttatttaggtcaacattgatttctgtagcttatttagatagctagaatgataaaaatatctttttgttatcacaaggagtacaattatttacatatttacctattcatccattcattcttagtatacagaacagtccaatcaggaacaatctgtagtacctatgacaggtacagaaaagcccttaaagattagcctctaaggtgttaatgggagagatttactgatttatatttttccctatggatctggagatacagggtattaacaagatggatgagttattgggggtgcatttgtatgtctcagggtgcatgctgtctctgataattgctgtctgtgtttgattgggcagagccagtatcttaaaaccttcactagaatttcctatattgagacatctaaagttaagaaatctaggtaatttttgcttatcggtttaaattgtgcatagaactaaattattaaataaccagcatgtctaagccttacccttttctttaattacacacatatccatgcatgcacacacatacatgcacacacatacatgcacacgtgctgaggaggaaaaaaaagctgaagggattttgtctgtgcatacatgcgtacatatgcacagacacacacaagaggcacatgtacacatgtatggacctgtgcatgaacacacaaatcccatcaacttctttttttcagccagtcattatagagaggaatgacagcttttatttgctgcaaaaattcaagtggaagaacgtcatatacaagaactaccagcctagtggtagagaaaagaggattctttgaagctctttttagtcagtctgtactagcaatagtccagtgtttcccaacttgagggtgccctcaaggcgttgaaaacataaggtaccactgtgatcgaggttttaccaaattttaactttccttcacttctcacctaaaatatcttgagggtgatctgtgctcagatttgttttaagggttggggggagtattcaccttctgaagtaaaagaaggaacaatttgtcctctgtctggcttctatcatgaaacttcataacccaagagcacatcttgacttcagctttgttatttttagtggtagaggagaggaaacagtaatctgcaaagtgtgagttcaattaccctgacctttcatattgaaatctgaattcttaataagtgttttatgtgcattttatcatttaacccttacaacaaccctatgagataggtagtgttattataccactttgctgaggaggcaactgagacacagaaattaagtaacttgcccagcatttcttgggattctaacctaggccatctggctccagaagctgaactcttaaccacactgctctcctgcagggtcgatgagcttgccatgcctcttggtcattccctaaggtgtggcattttgtgattcgggatctggctaactcatttaaatatggaagtttcacaaagattcaggctgctcagggatacaaaatggctcattggcagggtggggcttccaaggaaatcgatttcattcctttcctaatgggctgcgctagtttgcaaaaatcaagaactgtgacgatttaagatgcatctgaactcttttagatttccatagaacctcactcagcagtcctttcgagatgatgtcatagttcttttgtgtaatctagtaatgccttttaggggaggaagccggtgtattttacaaatgttatcttatccttacaacacccttgaagcttagtaagtgatattagttactgtttgggggattacaaaaattaggttgtggtttttaatgtttatttttatagcaatgagaagtggtacacacacacccatacttatatgcatatttgtaaacatgtgttatgtatattattatatacacgtatgcatcctccccccagcattgatgtgtgtaattcaggtggtatttggttgactccctcctaatattttgcaactgccactaattgtgatggttgttgcactttaaaatgttaaacttttagaatatgtgagaagtgagcaatttggcattggatctagcactgtgtcctcaagtccctttcatgtgctcagtggatttttattgagtgccaattgtgtgccaggcagtggcattacaacagtgaccgaaacaaagtcactccacttgaggacctgaatgtctagtcaaggagctagagagaaaacaaatatatcctctgtcaggtgggggtaaagcgcttctgatgacaaataatgttggctgagctatggtgacatttcagcagaggactgcacgagctctcccaggcttttcttgctctaaagcagtagttctgaaccaggggtgagtttgcagtaactggagatatttttctgccctacctggggcagggctgctgccaggatttcccattcagagtgatttgagaggatctcagtccacctgtaaagaggaaaataccctcttagatttgtagggccacagcctcttttgctgtgcctggaacatactggcagacacctttcctgctggggattttgcaaaatctggggacgtttttggtggttatgcttcggggaagggtgctgctagcatctagtgtgtgaggctggaagtgctgctaacatcctgcagtgtacagggcagctgcccacaacagaatgatctggctcagaatgtcagtagtgccaaagtggataaacctctagaaccacactccccaggggttcagtagactttcccgagtgggcatggaaaggtaaactcaactccctttctgcacgacccctttttctggcccatgagagcctatgctgtggccagtcgctgtgacagaatggttttctgcagggcatccatgctcacagcaggatcagatgccatcttcatgctttgacttgccaaggacattcaccaataaaatgcgcgttcagggagacagctgtcatgacacaacacgtttttcccatgacacacatttcttccgtccctctccaataacctcgactcttgaatgggtgagggacatttcctcaagagctgtttatctgggctttggggctgtcttgtgaattctatttaaaaatactcaaagtccctgagatctttggatctaaataacatactggaaccttcccgtcccctcctctccttggggctatggtaccaacagaagatgaaagctttatttcattttcaaaagtattttatatttctttattttgtaccctcttgataattgatcctcagctgccaggatttcccattcagagtgattcgagaggatgcccaggccacctgtaaagaggataatacactcttagatgtgtagggacacagcctcttatgctgtgcctggaacacactggcagacccctttcctgctccgagtatgcggtaagggggcaagaagctgtatggtggcttctccctggagaagcagcttcagccccttgtgctcctgcactcctgtgctttaagggcgagaacacattggattctttttttttgaggtggggtttcactcttgttgcccaggctcaagtgcaaggcacgatctcagctcactgcgacctctgcctcccaggttcaagcaattctcctgcctcagcctcctgagtagctgggattacaggcataggccaccatgcccagctaattttgtagagatggggtttctccatgttggtcaggctggtctcgaactcctgacctcaggtgatctgcccgccttggccacccaaagtgctgggattacagttatgagccactgcgcccggtgaccacatctgatgctgaaccaaaggcagctcttgggaggtggctctgagcctcccagccgcaaggtaggggagctcaaagatgttttaggagtaagcttgacaagagggtatcaggaaaaattgtttttctttgaatctccccggaatatatcatgtaattcacctcttgaggggtcctagaaagaccacttgccatcccaatatctagccagtcctggagtggacccagtcagagtgcatgaactgtgatacaaggcctatgtcttggtttttttcacctcctgcaagctaggagcctcccaactacccacagattggaagggacttggtgcagggatatggcttcgggtgacaacccacctatcagagctattcaaccattgaacagcatggctgtcagtctgaggtcgcagtgatgtcaggaggtggcagttttggcagctgacagccctcacagatgcccttgtgcagaatgaacctatcaagcattttctctactggctatgaaatggaaagtgaggcaagacattcagttgctgcacaggaaggaaagcagtcagggtggttgcctgagcgtccaggtcccagacaggtctgttctccatggaatacattaagggattgatttacctgtcttggagctgcttcacattgcagtagagggactgtgccgagtgtcatgcaatggccagttatcttgcagaacttgtttgtttctgcaattattaaaagttttcctggcagtttttttgttttgaccgagagtctttcctccaaaaatcattctctccatcctctcagaaccctggataattctctcctgtttgtcgtttgcataccatgtacctggaactcttatgttctggttaagtattctagcataagagagaggaagcaaaataagtcagcagaggatactttcagcatactgtgacttttagaatgttcagttagtgatactaacgtttcatagcctgtaccaataatcaacttttctttcccctgaagacaaagtagcatggttgtgacctatctatactgacttgttttcttcatgcatgcattcaacaaatcttaattgagtgcatgttatgttctaggcgtggggctgggctgaccctctgggaaatgacaagatgaaatgagacacattcctcctttcaagaaagtttgtgtggaatgtagaagatcattcattggttgaggagattgtaaactatcctggaacacagtggtttaggatgaaacaaagcagtgcacaaatgaacgctctagtcagtgaggctccattagaggttcctcaagggtggggactgcgttgagtgtcacgagactcctagggtcagcacagtgcccagcggctggtacgtgctttctaagtatcagctgaaatgctacagcagcacggcctagtggggagggagagagaaagggaggaagagaggggaagggattgaggaaactgacctagattatgggcagtgctggtcccccactctcagcccatgtggcttgggagaatgagcctgtctcttgatgctgtgaactatcaccaagagatcccctaccttgctccccaagttcaccaccaggcttctctccatctcagagcttattgaaaggacatggaatcctctggagggagttctccattgaaaacaaagacaataaattccaagtggcaaatctcataggtggccctgagtccctgtgatttttccagtccaccccttagttgaagtaaggcaaaatttgttttggggtttcataacagtgatgtaagtgcattgctttgaagcagtttttgagggagaggggaaaagcctgagttttggagaactacatttgtggaacccaagaaagtgatacatcttccctcctcccacccctcattgggggagatgacatggggcatacttccctatgtgctttagggggtctctacagaaagggggaaatgggattttgctccttgagtttgctgagggtaggacctgcagacttgctgtggtgccttcagagcaagagggaaagaacacagaaatagataccaccaaaagggatgaggatttcagatggcacacagagcctgctgagcgcatagccatgcaccgctgtgctgtgccttttcctctgacatccctttgcccacatataggagacaatccccttacaaagagccaagagcaagcctgaaggcttctgggagtccagtcggcttggaagtgagggaggaagctgggaaagagtgagcttaggtccgtgaacagtgatgagttcatgaaaatatttgaatctacctgaatagaaagattattttaaactagggaaaatttattttaaactggaagaggctgaaaatataaagtccactaatcttgtctgtctccatgagcttttacacatacgcacatgtgcacacacacgctcgcccatgtaatgttcacttaggtcaagatacagaccaacccaccaccccagaaggagctcttgtgcccctttccaatctctccccaagataaccattattctgacttccatcaattaatcaattttgcctattctttaacttaacataaatgaaatgatatgtgtacttttttgtgtctgactttcttctcctcaatataacgtttatgaaatttatccaagattttgcatgtatcatttttttaatgctgtgtataattccacagcatgaataaaccacaatttgtttatccattcacctgttgatggaaatttgagttatttctaatttttgtttttttcaaatgaaactgccgtgaacatcttgtgcatatcttttggtggacataggcacccatgtctctcagatggataagattcgaattataggttccataggccacatataggtaggcctatttgtatctttatatttgatttgttctattcttctgcccatgacaaaggtagtaaacagggtgtctttgagcagggaggctgaaaatgctctcttgtgagcagggtaagtagatggcttgtgctggtgcagaaaggcaggatgctggagaaatcccaggggaagcatggcaccagtccaaccagagactagggaagactcattaagaataactttttactacatgtaggtccagggaaagctgacatgggaataatgattaaaaggaatcaagtaaaggggcagagaggtagatttaagtaatggaaagatttttggtctgctttctagttttgtcctctagcacaatacgaaataattggctgtgggtatattacaggatcccttagatcttattgtctcatttataaaatataaaggctgtacagggtagttcctaaatggcctttgagctttcatcttctcataattgcatcaataatggcttagttgtaaatgaccaattctagtaataggagaaaatcgcatggaaattactgagaaaagcccagtttacttcatgctgttatcttaacatccacaactacatgtcgagagaatacgaaaatgtgttcttaggcttttccttgttcaaccagtctagccatgtgccattggtccttcaagggcagtggctgagcctcttttcttcctcccccactttttgctccctaccagacaaccttctcccataggtgctagtctgtttcctccctgactcgcattcctgcagccaatgcacctgctggtctgctggctgttgtttctcactcactgaaaaccagatctcaggatggacataggttggtggaccattttcttccagtcattcattcattcacttacagattaactccagttacagtcactgtagctagcatcacatacactaagctatctctcatactcttccagacattgcctaaggctgtggccacccagcccctgccctactgggtggagcccacacttgtgatatctcagagtgcttcctccaaccaaagaacccagccttctgcaggagggacacccctttccccctcagacagtcctgattctggcatattaccagaggccagtctttcctgatctcctcctatcctgagacgttctaggcctccttgagttccagttcgctctttcaagagctgcaccaaaacatctttacaacttgtgtttattatttgctgaagtttagctatcttaataaagaattatacttgtgatgaagtcagggccaggtcagtttgtctttctattcttggttcttagcttgttatctggtatatacaaaatgtttcatgaaaattcttcgtattgaagaaagggaagggttttgccaaaagccctactcaaggctgggaggtactgacgcattactgacacctagggataggctacctaaattgcagggtcatggactatgacaaaacagagtgttagtagtgaacatctcaggtaataccacataactttttaaaggggaaaggtcttcctaatttctataaatagttcaaactttcagacttagaatagtcctgcacttgtggcagtgccctcatagatccagaaagaactgatgttatctgatcttggggaaagtccccgccttgggtttgtaaatatccttactgacggtttctagacatttatgcacgacgttttgtcatgtgggatccagcacatatttctgacctggcgaaaactaagaatatctcaatcataaaaataaccagaaaatcataaaacagaaatctggcccaagattttctctggaaaagtaagaagctgctttgaaaggtgaaaatagaccagtgagcccccgcattggaacagattattccaaaaattgtgagcaaaggtctttttctgtattgtgcaagttaatctcctttgcccctttttgtggctgaaatgcatgcctaatctgcatatgagtgcctgccccaggtgggatggggcatgctgggattcctaaaattcagctggcttgcttgaagagggctatcaggctagatttcatgtctcaacaatttctagccggtctccctgagctggcaagcaccgctcagtttataatagtgcctggcacatggtaggtccagtgtttattaaactaacagatattcccaacaggtgtgggcagcagtgctgctaattagcagtaacatagccgcatggcagggacaggaaaggggagccttctgtgtgtccctactatatgcaatgtatgactccaatctcaaaagaagcagagaatactcagccaaatatttgcattgattcctgccaacaccatttttttgtgatttgtatgttcccttccccaccccccaccccctgtactgttaacttcatatttgaagggggttatacttttaggttatttgtgaattgagtcagctcatgtaacagtgattctcaaagtgtggtcccaaaaccagtgggatgggcatcacctgggaacttgttacaaatgcagattattgggtcccaccccagacctactgaatcaaaaatcctggaggtgggtccagcaatcagtgttataatgagcctaccagatgattctaatgcacattgaagtttgaaaaccaccattgtttaaggatcacaacaaatccaacagcactgtcagaagaacaactccttattctaatgggtcaggtgctttctgtgttggctgtcctgcagagcatctctagtgatagttgtattttcaggattagaggtgcaaaactaatgggagtttaagaaggaagtttgagcctttactgctgggagaatcacaagccaagtttatttctcttccattatttgtatggtagctaaaactgccaaggactactgtgatccattgaaacatcagtgtatcacatctcttcttacatctgagctggcattttgggtgtagtgcttcagtaacagttgtattcccaagcaaataaaatcttagccaccagaaatcttgagttggactagacaaaggcacctctccagatagcagctgttgttggaattgaatataagagatgcttaatcaatgtttgtgtaattgaatagaatgggaaatgaatggctcactccaaactttatacaagacagatgaaggcaacttcgatcttaacctttatgatacatagcattttgtactacccttgagaaaatctcagtctcgggttatcatagactcaattggctatcatgggaaattctgtctcagtgatgctccatatctatttaattgaggtttattatcaatttgaaaaatggaaaattcacctcacatattttaaatagccaagatagccagagtgtatgttgtggtttcaatatgtccccaagagttcttgtgttaggagcttggttgcctttgcagtagtgttgagacgtggggcccttgggaggtgattgaatcgatgctgttatcatgggaatgagtttgctatcttgggagtggggtcctgatataaatgatacatttggctgccattttctcttgtttcatgtgcttgcttccaccttcccccttccaccatgggacaatcctctccagatgcctgtgccatgctcttggacttcccagcctccagaactgtgagaaataaatttctttataaattactgagcattctattatagcagcacagactaagacagtgtaagaaagctcttatattataactctctccttctatttgtattcaggttttctcttaattctggaaagtttgggcagcagctgggaatgggaatttattataagacatcccttcagtgtctctacagaattgctttaattaaagtactttgttttatttgtccccatttaattataattcacatcagagaaagctattgttaaaatattttggttagttcagtgtggggaatgggattttccatcccttgaccttcatgactcagtaaggagcagataaaataattttctttgctgggtgattattatgcctcagggacaagtcatatttaagacctgatagtttgattcaagctctcataattgctgtgcagacagtgttcaaagccaaagtcttcctgatcataaggtgctgagaggacattcattttttgccatcattcagagctctgcaagagagcaaattgcttgttacttaaatgtgttacctttgaagaataaaaatctgaattgacactgctgttatttgagccttcaggtgtagggacttggagcacctatgtataccatggaatgtggcttaacaggactaaactgattccttctgcataatgtgctatatactgatttgcactgtatggagtaaaacctcttcaaccatatttgaaagattgatatttactctaaaaagcctataccttgatgatatggtaaaataatcaggttctctataaccttgaatactagtaagctgtttctttgccttcctaataacatgagggtttttagtttttgtttttaaccagcatttgagtacctactatgtgcctaatagagtcagagtgactcacattaaaattaactagagttaccaaaaatttgtccttcttacacaaatatgcaatgacaacagaatgattatcagtaataaatgtatgtgcacttgcagattactaagtgactgatttaccacaaaaaaggaaaggaacattacttagatttgttgctgtccactccttgtttttcattatggttcagtttggattttcaccacaattcagacatgaaaactattctttccataatgaaatcaggtgtgaggttttttttctcattcttttctttagaaaatgtatagcttaggccaggcgcagtggctcacgcctgtaatcccagcactttgggaggccgaggtgggcggatcatgcggtcaagagatcgagactatcctggctaacatggtgaaaccccatctctactaaaaatacaaacacattagccgggcctggtggcacacgcctgtagtcctagctactcagtggtacatgcctgtagtcccagctactcgggaggctgaggcaggagaatcgcttgaacccgggaggcggaggttgctgtgagtcgagatcgtgccaagagagactccatctcaaaaaaaaaaaaaaaaaaagcaagcaagaaagtaagaaagaatagcttatattttctattaactccaaccaagcaaaatttaaaatgctaggttgcactccttgcactccgtagtgcaacccaatagcaccatggctttttaattccctgagagagagatggtggacagggtgttctgggaaactgctgacagtaacatctgtccataccgaaagtcaagtgaaaacttggttcacatgagagcaaatgaaaatatgatgtttttaaagaggctgggaaaaagtcagagaagtgctcccactattttagatgagctcagcagcaagtttctagtaggtaagagggaaaatccattgtggggaaatgtgccaatgactgtttttggttaaaggtttgaatgggcacgatttagcagaactttacaaagctgtgtcttgaagagctttggaaaaacatttagtgttgttgtcgttgatgattttttttcatactctctgttgttcaggttatatgtgactgaaagaaagaatgatgtagtttcagttacttccatgacccaccccgggctagcacctccttcagccacatggtaaggtcccagaaacatttgatagagaccacatgaaagtagatgcttatgcagatgtgacttttgaaatacattcttcctggctttcagatgtgctattaattgcaggtttaaaagcccttttttgtttgatctgataaggtaggcttactttatgtcaccttaaaatgaggttaagccaagaattgcaagatataaagtattcaatgactactctccatttctgctgggaaaaagaccatctgcttaggtaattgcattgtaatactcaaacctggctgaattgcttctgtccctgcaaacgtctcttctgtcttttacattcacagtcatatatctctcctgcatgtagatccaagacccagtgtagccttttgtataatttgtaggattaatagactctgggtctggcctagtacttatattgtaggtctataaattatcataataacataggtataattgcaggtagagttttatatctgggtctgcagtggtttgatcattgactcactgagaacaattattaatcttcaactccaaggtaggacacacagttccaattggtacataaatagtacatacatttacattacagcagggggacattgtctttgaaagaacatgaataatacgttaaacctggaagctgggagggggacatacagtaagtgggaaaagagatattgcagaaagtttaaaaacagagaagaagaaaataaaataaataccaaagcaagcatgctgatatcttaaattaggtgcaaggaattctttttccttctgtgcctcagagctgcctctatgtggccatatgtgccttgagggggaaggagtatagtaagctttgggaatgatgattcttcatcttgcaggatgtagttgctcgtgttggctcaactcagggtaaatattctagatgattgatgtatgaaatcctaatagtatgccatttaggagtttgtttaccatcagtctccacattcagactttttcttgtgggtttgaatgttctgtagtttctgtaatattgaattcaaaggtttgcttttgattggactttcctaattaaaagcaaatttattgtccctacaccttgcctctacttagcccaatctcacacaccctgtgaggctttttcccagatgttatttctccttcttgaagcttcttataggcagaaactggacctcattcatctttttatcttttacagtgctctcgcaaatatttattgaataaataaatgacataatttatacagtctgtgaggcttacaaataccttctttaagctattagtaaaacaaaagtactggcacaaagtgatttcttgttcatataacagaagtattttactttcaaacacacacacacacacacacacacacacacacacacacacacagaaagagggagagaaagagagagaagcccaacccaacaaaccacttaagggaaaccatgaaaatggtatctttgttgagagttaatgagtttatagttaatttatgctttccctggaatacatattatactcattatgtacaagtaaactatgactgtttttacacctatcacagatattccagatcttaaaatgctctgtttgaaataaaaggcagaaggggggacttgggcatattcccttatagttattcttgtgtctcttatggaatagatgcaaaaaagtctaatttgcctttctgtcacttggcaaagtttattatttgcttaagcacaagaagataaatgttttatcctactggcaaaaagtattgtttgcacaaatgtaaaattctgttaaatgtatttatatgtattgtcttagtcagggttctctagagggacaggactaataggatagatagatgtacatatgaaagggagtttattaaggagtattgactcacatcatcacaaggtcaagtcccacagtaggccatctgcaagctgaggagcaaggaagccagtccgagtcccaaaacctcaaaagtagggaagccaacagtgtgcccgaaggcccaagagcccctggcaaaccactggtgtaaatccaagagtccaaaagccgaagaacttggagtctgatgttcaagggcaggaagcatccagcgtgggagaaaaataaagaccagaagactcggcaagtctagtccttccatgttcttctgcttgctttattctggctgtgctggcagttgattagatggtgcccacccagattgagagtgggtctgcctctcccagtccactgactcaaatgttaatctcctttggcaagaacctcacagacacccccagtgacaatactttgcattcttcaatctaatcaaggtgacactcagtattaaccatcacatgtatgtttctatttgagtgtttctgtaaatgacatgctttagtttttgacaagtcaaatcctaccaaaataccctcatagaaaactcttgatgagagtaatggttatatccaagtcctctcaataacaaatttatttcaatcaatatttaatatcacaaaataacagtatgacaaatgaaggatagaatgtggttaactagtgtagagtgtgaattatttggactggattgtgaagtagatgtaactgatactcatggatgaacttgcagtaattatagataataaaaaattaccagccaagtgctgtggctcatgcctgtaatcccaacactttgggaggctgaggtgagcggattactgagcccaggagttccaaaccagcctgggcaacatggggagaccccatctctacaaaaaatgtaaaaagccaggtgtggtagtgtgtacttttatgtaatcccagctactcaggaggctgaaattggaggattgcttgagcttgagtcaaggccgcaatgagctcaggccactgtacttgagcctgggtgacaaagaccctgtctcaaaaaaaattataatgcgtacataattttttcacacatcaaccactttcctaacaagtcattgatcctcaaaataatcctgtgagtattattctcttctatgtaaatggaggaactgagtatctaataggtgattgccacatctaggcagctggcgtggagggtgttgaagatttgagtccggtgcctttgaccccaaagcctatggctggagatgcctgccaaggcaaaactgcccttaccaaagcagattttatcagctgatcccatttctctctcactaaactgagtccatgaatccttctcaatgtagacaaaatctatctgctatcctgacctatgttatttctaagtgtattttgctgggcattaacgcagatggaatacagccgagtttgcgtaagttctgtatagtacaccaccaagcaccttaacaggagcctgcaaattgccgttgagggaggtaacttttagcatctgaggctttgatgtgtttatcttctccaggaattttgttttgcctcctttgggaggggagaggtcttctgctaagcatctacttcctttatttcttactgcacaagaacttcggtctaattggccaactttgagtgtgctgaggtgacctatttctgtctgggataataaaaacattccagatgactgacgccttttactggggacaatttgacctgattctaaccctcctgctctgcctgccaaggaagatgattactacaggccttagtaccgacctctatttacttcatctactttttttttttcattttcttgcaaaaatagcaggcttgtccaagtgcctagctactatggcaataagtgctatttaaacagatgccgatgccgaatacatgtgtcccagcttaaatgagtcagtgggagcagttgtaggatctgattgcataaatgcatgggaataatgtctgtctctggggcaacagaacttcttttgagcccttgagaggaccagttcagttgcagaaaggctgatgtaatgatcacacaccttcaggtgaaagggtcagtttctccctgaatggaaagtgtcaaaaaatggccatttagactttctgctttgtaactagagcaaatgcctcaagaaagagaaaatgaacaggaaagccctcaaaagctttaaagggcttagaaaatgtaaagccattattgttggttattcaaatatccctctgattcaaatagatgcattgattttttaaaaaaatctacagttaacatcaagaaacttgagcctcagtaaatgagcactgccttatagaatattgctgaatatgtcttgaataagttgagaaagcacttggctgtgtataactactcatgtaaaatgctattggcacaaagatgacatttttttcaaagatgcctctatcatgtggctacaagtagattgtgctgattctattcctctacaaagctcagggtcacaggtggtctattagtagttgttggttgttagctctgccataagaagatggcatggttccttaggttagatgcattcagagttggtggtggacttgagtgtctacttatgcgcagagattttcagtcttttatttccatcttgacagtagacagagaagcaggggacaggcttgaaatttcagtcaaatatcaatccagcatgaaggaggacaccctgattttaaacacccactaatatttccttggaaaaaaaaagagcctaacacatctctggctccagctcttctctcctcccctcccttccctcagcccccaattctcttttcttttcctgtcttcagaatatgtgaaatgggggaaatcataaaacagtcaatcttcattattcacagtttccatatttgtgaattcactacttgctaaaatgtcttcgtaacggcaaaatcaatgctcactgtgcttttgtggttatttgcagacatgtgtggaacagtgaaaaactggagttgttccccatgcatgtttctagttgaagttaaaccaggtgacagccctttttgtttcagccctcatactgtaaacaactctcctttttgtggtcagcttagtgccacattttaaaacatttttctgcttttttttttggtgattttactatttgaaatggtccaaggatagtgccagcctactgtccagtgttcctaagtgcaagaaggctgtgatgtgccttgggaagaaatatgagtgttagataagcttcgtccaggcctgagttgtagtgctgttgctgtgagtccaatgttagtgaatcaacaatatatactcaataaacagtctttaagtagaaacacatgttaaacaaagttatgtatttatcagttgatgaaaatgtgaccagaggctcacagacacctagccctgtatctctccccagagcaatgcttcagtatttgctcagaaccaccacaagtaatgagaacaggctaacctaccccttggagttgacgtgaggatctcatgagctaatgcccctaaaatgcatggtgccttacagtgtgccccataggtgctaactatagcagttatcatcatcatcatcatcatcatcatcaatgaaaatacgggagaagaaaaaattaccaataatcccactattgtacctcaacaactctcttcattttgggtattcccttcagtcattgtttcgttgcattcacatctttgtataactgcattaaactgcatacaattttgaatatttctttgctatcattctgtcatgtgcatcaccctgtgttgcgacacagcctccatttctgtggtcttcttgatggaaagcggtaaaaactttgttcctgggctcatgtaagagcagctctcttcaagcatagggatgacttcattgctcacgacaccaatatgccttaaaattctgtgattaattgtaaaaaagaactctctctgaacactacagagaaaactctcacagagcagagaaatttattatgtgatcttcttctctccagaggaaaatggtgtgttttaagtcagaaggtttgggtcattattcagtagaacgaggtgctcgagggattacaaaagaagagtaactctaatctttgtgagagtgatggcctaatacaggtgttagcaaacatttcccgtacaggctcagatagtaaatgtgttagaccttgtgggccatatgatctccattgcagccactcaactctgccattgtagccaaaactatggataatattaatggataatattaaacaattgagtgtggctgtgttcctataaaaccttatttacaaataaggcacaattccaaacaaaatagatctgaacaccaaagtgggcagttcgtttattgctttattcttccacaaaacttctagtatgttaggccttgtcctggttggcagtaacatcagcaagagtagcaaaacatttttctatgcctcatgaagtttatagtctgaagggggagagagcgatcttaataaaataattgtataaatgaatatataattgcatgtgttgataaatactgcaaaggaagaaaacagtgggaaataggactgtgtcagatattcaggcacgaagtttagggaaggggctgcactttgaggtggccgccagacactcattgaaataagagggccttgatcattgtgcagtaagtgatttttattaacaagaacttagtcattacatacctagctgtaagtagatgctagctctgaagaatagattttcggtggtcagtttggcattcaaccaggaccaaaagagaatcccctcattcgctgacttggggctggatttatgagtgtcgtcactccctttgtattttctttttttgtcttattggtctttctaggcagaaatgaataccacatggttgagacacgcataagattcaggtccatcaggtcttgagcatctttctggtaacttaaacataagccaggatccacatatctaacggctacatgggatatagggcctcgttcataaaaacgcatacccatacttcttaatatgcccttgcctgttcctctttagttctctcaccccctgcaaatattcttcctttttaaaccctcagtttcttcaccaaactttcccagacaacctatccccaaggactttctttatccctctttgccagccaacctgtgtaccccttttcttctggaggtgcactgaggacttttccctcctgcctgatcatctgggcctctctgggctacccgggccttgcagcttcatggttcctccctgagcctctctccctagggagggaagcacaaggaactcactggagtgggcagttctgttcacaccctggtaaatgaaatcctctgcctcattacactctgcagacaatttcagcatccagtcatgcttatttcttgaaggaaaaggactgtttttccaccatttgggtctatgactccactggggattaaggaaagagacaacattgtggaatgtgtgtgtgtgtgttgttggagacagcttttgcttgggctggtatcatgtctactccaggattttctgaagtgactgtgggacaggaagaggcccattggtggctacttagcaacaccaggcccttcacgggcagtggaaagtcactggggtaatgccccagaccctcaccctcaacaggctacacctggacagagacagggcacccttatggggctttcagggatgagatgtgttcatccacaaataagggagaagcacagagacttctacaagtatgtagaggagaatctaggagatacaatgcaagggctgagaatttgggatatacacttattactgttggtgtggtcctagccttacaacaggttgtgcagcccaccaaagcatggattacagtgttaacatgcagaaattcctgattgtacctcttttccagctgttcaatcctacatgaggcctttcaaaacccctgtgatttcttacgattagagatgtaggctgtcccatctagtaaatttgtcaaaccactactgggtatcaggtagaaatagagttccctttcatcactagcaatatgtttcttttctcaatggtttgctctcctttgctcattttccatggaaggtcttcattactcctgtattttaaaagctatcttgtcaatattattccaagcgaatttctcagtatattttaaaagggaaaactaataatgtgatcctcttgcttaaaaccctttacagcttcccaagagtgttagaattaatggggctggtactagcatgcaaaatttaagggaatgtcaaaaaagtcagtagtcaagataaataatatttaatgcactattttaaaaatgttcttggcaaactttcgtccacacctgcgtttgtaaatgaggtttcaactcacaccgtgcatgtgacttgagaggccactgcagcacggccaggcctcagtgcactctctggcctcaacgtaactcccttgaccttccatgttgtattagtcctttctcatgctgctaataaagacataccccagattgggtaatttataaaggaaaaaggtttaatggactcacagttccacatggctggggaggcctcacaatcacggcagaagatgaaggaagagcaaagggacatcttacatggcagcaggcatgtgcaggggaactgctctttataaaaccatcagatctcatgatctgtgacttagtcactatcacgagaacagcatgggcaagacccgcctccatgattaaattacttcccactggttgcctcccacagcacatgggaattatgggaactacagttcaaaatgagatttgggtggggacacaagccaaactgtatcatgtaaccaaatatgttaagctccatccatgctgactttggtggtcatgtccatcccgggcctttatatgggttgtcccctttcttcacatctctgctgagctggcccctgctcatccttcagaactcgatcaagtgctccttccctcttgttggccaccctgagccccaaggtgggatcaggctcctctgctaggtgtcctcagggtggtgcgtgggggtcgttagtgtttgtccttagaatacctggcaagcagacatgcacgtgggtcattttgtttattaacaccaaactcctccagttgattataagctccatgagggcaggactgaatttgtcattcttatcgcacagtggcttacatgtcagtcatcactgaacagttaatggtcatttgatctgatatgcttctggtataatttcatgatatcagatctggagacatgaagtcattgttttcctggtggggagtgtgacaccaccatcttgttcaccatttgcagagttctttcctgtcttcgggcaagtagattaggttatatcgttatctctgtttatagctgtctcaaataaatcctttagaagagggagaaagatggtacaaagaaaaaagaagccaaggaggaaagtgactctcagagatgctaatgactttcccaggaaggctgtcacacagcaagaactcagatatgggttttacaactcagaaactcatcctgttctaggccccaacctcactctctcaggagaaggtcctggaggagattcccctctcactttccagaaaaaggacaaagggaattaggaatcttttcttaacattaacgccttgccaatttctagacctcccctcctgctcctcccttaagacatcctatttgcacgtctctgctcttagaggctattgggtttaagcgccacaataaataaaaggcaataaaataaataaaggcaataaaagatatctcctggtaggatataattttctttctttcgttcactgtctcagagttattttatccttttcaccacgagggactcaattggaactggctctcttattagccttcaggttcaactggcttccatggaggcattgtctcctcatagacctgttcacttgacagaccttcacagaagtttcatcagtataaggacccaaaacaccatctaaatggcttcatccagccatggcagatgccctttgctgctgggttgggtttttttttttttttctttcttttttttttgagatggagtctcactctgtcactcaggctggagtgcagtggcacaatctcagctcactgcaacctccgcctcctgagtttcaagtgattctcctgcctcagcctcccaagtagctgggactacagacatgcaccaccacacctggctaatttttgtgtttttagtagaggtggggtttcgccatgttggccaggctggtctcgaactcctgacctcaggtgatccacctgccttggcctcccaaagttctgggatttcaggcatgagccactgtgcctggccctgctggttttacttctgcctgaaacccactggggtgaaaggacaggccttggaaatgttgcattagtagcaactgctccctctaatgggaggacacatcccttccccatagtcagtgcaggagtcacagaagcttgagcacgacctcaggaatcggcttccattcattcattcaacccatatttactgagccccagtgtgtgccgggtacttctggacccttgggatatgaggtgaacagctcacagatccctgccctcctggagtttacattcttatgagagaaacggtcaatgaatgagtagtcaaataagttttacttccagtaatatgtggtatggagaaaaagaaatgaaggagaacagagataaagtttggtgatggtggaaggtggcagacagggtagccaaggaaagccttgcaaacgaggtgacatttgagcagagacatgacatgaagttctgggagaaaagtttatcaggcaaggtatatggctggtagaaaactctgagtccaaggcaaagtgactatccacaatcagccagaggtcaccatggctgggaagcatggcaggaagtgggaccagggatgcatgcaaaggccaaaacaggagggagttcatgctgctcatatctgttctggaaggacactggagaaatgtgtgtgaagaggaacatgaactgacttatgctttaaagggaccattctgaccgtcatgtgcaatgaatggagttgaggggctagtcaggagtagggcagagagatcaggtgagaggctcctagaataatccaagtaaaagatggaggtgactggattggggtgttggcagtggaggtggtgaggaacggtcggtcagatcgtcatgtattttgaaggcggagttcattcaccattgttgctgtaccagttgtgggctaggaaagaaagcagtgtgggtcaagcatcactcattcattcattgacacatacttgttgaatacctatcatgaacctgcccttgttctgggtgatggctataccggtaaacagaatagtcaaagcttcctgcccttgtggaacttacactttattattttatttttatttattttgttgaaacgaggccttgctctgttgcccaggctggagtgcactaatgcaatcatagctcactgcagtctcaagctccttgggctcaagtgatcctctggccccagcctcccacgtagctggaactacaggtgatgccaccacacctggctagtttttgtagagacagggtctcactatgttgcccaggctgatcttgaactcctggcctcaaatgatcctcccaccttggccttccaaagtgctgggattacaggcgtgagctactgtgcccggcctggtttacattttagaaaaagaaacagaaaataaaggtaaaaaaacaataagtgaattataatacatgttcagaagatatttgttatggtaaaaagaaaaaaatagagcagaagagggaccctggggcaggggagcagctgcaattttaactagggcaaccaaggtgggtgttcttaaaaggtcgccaggttttgggccctaagtagttagatggaagctaatactactatttaatgagaggtctataaagattacacaaataggctgggtgcagtggctcacacctgtcaatcccagagctttgggaggccgaggcaggcggatcgcttgaggtcaggagttcaagaccagcctggccaacatagcgaaaccccgtgtctgctaaaaatacaaaaattagctaggtgtggtgacacacacctgtaatcacagttactcaggaggctaaggcaggaaaatcgcttgagcccagaagtcagaggttgcagtgagccgagatcgcaccactgcactccggcctgggcgacagagtgaaactccatctcaaaaaaaaaaaagaataaagaaataaaagtgggaagaggagcaggctggaggttagggtggggtaaacaagctgttgtcatacttgagtccttgagtattgaatttgagctgtctcttagtgacaataccaagtagatagttggatattcaaatctggggcttaggcagaggccagggctatgtatatacatttcaaagtatcagagtctagaaggtctttaaagccataagaccagatgaggtctacaaggatgagagtggagagagaaaaaagagggcccagggccaggggctactgagtcctcagagtagagagaagaaaagaggaattagcaaaggagatgcagaaggaatagccaggaaagtgggagaaaaatgaggcgcttgaacgaagagctgaagaggtagaaagcaagtcacagcgctcaaagcagcaggtgagatggtgagtgggttgggaaagtgactaggagaactttttataagcgacttcctgagcagcaagtgatcaagttaccctgttgttagctatttgacggtggtgtgtagagtcacagaaaggtggcctctccctgtgtgcccacggaaacaccagggctgagccctttgcgtttgccagtgttcatgtgttcacttaagaattaatattattctccaaggcaaggcagtgggtacagatcgcagaagagtcaataccacacacaagattttgaacttaaatttataggcaatggggatttagataaagtttttcagcaggagagtgacatatgtaacctgttccatgtaaatagtttggggagcagaagggaggatgagttggaggaaggagaggtgatagggaggccattttagtagtggagccatgaaatgggggagggggagactgaaccaaaggagatgcagcgagaattcgaaagcagagatgcgagagacacggagaaggtggacatacagcctctggtacgtgattgtgggagggtacaatgagaggaacattgaagaccactcttggggttctatcttgtgtgactgggggatggagcccactgtgggtttttgctgggagatggagaggagaggctgtcagattaaccagtttatggattaattattaagaaacagcagggacctgggatttcccctcctcactgattagttagctggtaattaggcagtggctgagaatgctactgtctgtcccccatcgggtgggaggagcagagctgagcctccccacagttgctgtggtgcatggagtggggacctagaatcactgctatcacgtgacatgccccctgttcctcctgggaacccaactctgaaggggtcttcttgacatccgattttctccttccagagctcttctgaagttcttgcctaatgaagaaaaagcaagaaaagggaaaatatgtgtaccacagaattttccttctctctggtggtgttttgcaaaaatgccatggcaactttcctcttcaaatacttgggatttgtttctcttgcatctgtcaagtgcacatcaaagttgaattttccactttggaattatgatttgtattctgcttctcccatctgggcttctgttctcctgaaaactgcctattctactgtgaaatgagcattccccaaggctgatgtagccgcttcatgctaagtgttgatgggaaacctgaagctgagttgggcaaatgtttttgagatctgtaaattccccagagacttaaattgcttgaattattgagggacattttgacctcttgttggaccaatgagaatgaaagaaaagattggttaaatagaagaaatgttcagaatccccctcagccctccaaattccaaatattttcttttttctttctttttgtttcttttgagacggagtcttgctctgttgcccaggctggagtgcagtggcacaatcttggctcacttctacctctgtctcctgggttcaagccattctcctgcctcagtctcctgagtagctgggattacaggtgcacgccaccatgcctggctgatttttgtatttttaatagagatggggttttactgtgttagccaggctagtctcaaactcctgacataaagtgatctgcctgccttggcctcccaaagtgctgggattacaggcatgagccactgcacccggccaaatgttttctagttaagttcatatacccatgccagagtgcctagctcacacttcattataaatgtctgcctcaaacagaagtcctgggtccatgtttccactgtcctgcgagggatacacaagaacacttggcaaacgaagaagggaaggcctggggctacagtgggtagggagtaccagagacccaggggacaatatatgggttaaatgaggactttatttaatagtatttttaaaaattaaaattgtgacaaaatttaggaatcagtaattatttaaaaatccaaatattctgcttctcttgaaaaatcagaagacatggcatctcggggcccaaatttctatttggcagttttcagctggaggtcagctggtgtccccctaaactcaaggcatgtggtccccagtgggtcacgcccaccagaatcctctgctgtcttgatagctctgaggtccttcagggatcactggggaatgatgttctcctagaagactttctggatcctccaggtccaggttagatgctaaccaatgctcttaaagtagctatagcaacttttattaatatagataatattttatatttttcatattatataatttttgttattatattttaattgcttcctgacttatctcagtcctcttcagtataatttagtctccataagaataagtacttgttgtgtttgttattaatctccaacatcttggctgggcgcagcggctcacacctgtaatcccagcattttgagaggctgaggtgggtggatcccttgagctcaggaatttaagaccagcctggtcaacatggcgaaaccccatctctacaaaaaataagctgggtgcgatgctgtgcacgtgtagtcccagctactcaggaggctgaagtgggaggctcacttgagcctcagaagtccaggcttcagtgagccaaaattatgccactgcactccagcctggcgacagagcaaaaccttgtctaaaaataaaaaattaacaaatctccaacatcttgcataaggcccaggccataagcagacattcaaataaattaatttactaaataaggacaatagactaaataatccctggggtccattttagttgtactattctattgctctgatgtttctctttaaagaaacagattcatgggttttctattagagtaagacactgtatttgtctctacacatacctgagtaagaatgctttgggttagatccctcttttttggttcgtaaaactagagaagagaacagatggaaaggaccttgaagttcagcttcctaatttgcaggtggagaaacaggctcagagaagatacgtggacttccttcgagtcatatagttgtaacccaggttaggacatgtgcctccagggcagagtccacctgccttggtctctagtctgaaggaacaaatgaccagtgtggtagataagaacaaagtatattcaaagcctataaaagaaaagagacagagagaggaaagtggtactagctgacaaatgtcaccttagtggcaaaaacagtaaataccgtagaggtttataggacagaaattacttcagaaacgtaacaaggtttaagcaatccagtgtttattagcaatggttctctgactggggtgtccaaatgcattctaaggggactttgagttccctttgaaaacagtgaatgtacaatttcagggattttcatcatttctgtgagggagtatgacactttcctggccattgaaggggagaagggaattgatttgtaaatgatgtgtatacacaaagtgaaggcccagtgatggaatggtgatggtttgcagtagtttggggctgtggcaattagtgacattttgtttttacattataaacagtgatgtaattggagtgaaatgccattatccactgcgtcattttaatgcagtcaattgttactggcttcgtatttagtttttacacttatgttggtgtcagaattatagaagagttgtaagcaaaagcactttgcatctagttgtgttagttttgtgtacattgatgcaacattgcaatgaaagtaatctaaaacaatgccaacagtccaagagattttatctttcttttagaaagagtctatgcattattcaagcttgttgtgaatgctgacttcctatagcacttgcatttaagttatgagaagttattggcatgagagataatttaagtggcatgagctcatctgctgtcactgcatgaattacttgggaggaacttggtgtgggagatgtgatatgctctcccctcagtaggtggctgttcccacaggcaattctagattctaagataattctgactattgttttattgactttagaaccagatcctttgtaagatgttatgatgtacagggtctaagtggtggaaggatgtgtctttcctttaatgtgatataagccagagttcagcaaactatggcccatggaccaaacacagcccacagtctgtttttgttaataaaattgtattggaatttaggcacactcatttatatacagatggtctgtggctgctttcacactataaatccttagtccaatcatttcgatagagatcctatggcttgcagagtccaaagtctttattatctgacagtgccctaggacccagggtctaaatataaccatttctgcactgtgctttcagcttctgtgtattttatttgtttctctaaagtgacctaattaatctgtcctattgggataattagggaattctagatggttgttgctttgtggaagattccgtgatttctctaataagggaatctagtctattctcaacatagattcctactttcttaaaataggatgctagaagctagcaagatgctgtttgattcaggagccccacctgccagagctagcctcaggctgcactgtgaatgagccacttgtgtttccacccgtccgccctgcttttcggaacccgcttccttcatcatgtctttgcgtcactgccttttcactccatcctgcctctcagtaacatcagtgaaggctctgatatctcacttttaccaccatttaagttcacttcatttgtccacttcttgcttcttccaagggtgtttgcacttgaagctttttgtccccactgtgtataggaagctttgccttccctgaaaggtttgaccaactcagaggagtggagggagaagggatgagggggcagcacaggacggggagtggtagggacagggctgtccctggaaacacacagtcctcctcagtgactgcacggctcattgcacctcattcctgggttgctgtacagatcagagtctacctcacctcaaaagccccacagtatttgttaaatgtctgggggattccagatacttaacaaataatctttcaatgtggtcgacttatttagggaacaaacacaaaaagactcacacaaaaggcatgggagtcaaatgctctttgggatacttgactggagagggctttctacttacacgtgcctagggaaatagtcaaaggatgaggggggttggtatgatttagggacagttcctagaaggagatacttactcctgaatgtgctctgcttaaaaaaaaaaaaaaaaaaaaaaaaaagaagaagaaaagaaaagaaattgtgttgggcgtaaccacagccttcttagccagcctgagttggcattgctcaccctctgaggattaggtcagccacagtgagctttctcaaggaagtggtgccttggggagcccgcgttggaaagcaatagcagatggctgccgtgggatgtatatggtcctgcttttttaatatgtggagaaaagagacctgcgctctctgtatgttcacatatatcaggatcattatatgttaattgcttattatggcaactgatgatttgcctcctgtttcttatgtgttctgtcagttaacatttattgggcacctactatatgtcgatagaatctgcacagtggcaggtaaagttttccctgtctttaaagagctcaagtctgataagaatgacaactcatgaataattgcaatctaggatggagaaacgggggaattctcccttagaattatatccccctcattgacttcacactaaattcgactttttaaattcagcagtgattatctaaagcctgagctgttcagattgttaaataacagtactctaagttaatctacaagaatcttaattaaagaagtgaatttgggtatgttcaaattataactcagctgaaaaacagtttctctactatgcattcccctcaccaatcccacttcccaaataaactgactgaggtgggataaaagggtccagactagaggatggcaaactccagccccaaggtcaagttacacctgccacctgtttctataaatagttctcctggaacacagaaatgcccactcatttacataatgtctatcatctgtggctgctttcaagctacaaggcagaggtgagcagctgggacagaggttgtgtgtggccagcaaagcctaaaatatttactttttgtatcacaggaaaaaaaaattgccaacccttggtctagagtaaactgaacacccataaaaagtaaaaacaacattattcaccacctctgactggcaaaatgacttaagaaccagcacactggtacattttaatagcagttaaatctagacacatttggatttaaattgaaatccaatatcctcctcttcatgatgaagtattaacatggttagctagctaagaaatatttgaccctcacgtacttaaaatatctcttgttttggtgtttgtgtacacaaattagggaatacaaattatgttcatgaagtaagtcatcttcaccaacggaaagaaatattctccaaatcgctgagaccatgcatcaaccctactgcacagttagaagaagggccacattaattacccgaggatacagaatctcttaggaagaggagtggccacagagaacaagagcatatatagtgcatttcagagaagtttctcctgccctccagattcccctgtggacctactctgagtccattctgcaagggggcatttctgcatttgagcagctcccgttcttacccattacacatccctgtgtatagggggcttcaggaagaacttacacaaccaatcgatggcctcagtttaatataacatttaaaaatatctcgctctcctgattctgtagccaaactcagaatcatcaaggccacttcctctcccaggagagtaagcaaacttactgcccagatgtcccccaaagtgtctttgccttcaactttgctgcaggctggaaaggctgtttctctacaaggactggagatgcaaacccttggaggggagggtcctggggagggcaggcacgtgttaaaaagggcagtagatgaaagcaaatgtggctgcaattgtccgcttctgcttgaacagcaagtctgtcccatgctataacagggattctgtaggatggatcctgttttttgttttgttttgttttgttttttgaggcggagtctcgctctgtcgcccaggctggagtgcagtggcgccatctctgctcactgcaagctccgcaggagaatggttcacgccattctcctgcctcagcctcctgaatagctgagactacaggcgcccgccaccacacccggctaattttttgtattttttagtggagacagggtttcaccgtgttagccaggatggtctcgatctcctgacctcatgatctgcccgcctcggcctcccaaagtgctgggattataggcgtgagccactgcaccctgccctgatcctgttttttagagaaagtagattgttaatccgtcactttatgtattgtctctaagatagcatctatcatgtatataggcacaaatgcatactggagtgaattcataaattaatagatgaattaagacctcagactctggagacaagcaaaattgagtttaaatcccatctttgccagttaatagctgttagttatctatcgctgtataacaaattgtcccaaatttagtggcttaagttattatctcacagcactgtgggtaaaggatctgggtttggctttgctgggtaccaaggctgcagtcatctcaaagcttggccaggtggggaaggacctgctttcaagctcacacatgtggttgttggctggcctcaaatccgtcatggctgttggctgacctcaaatccatcatggctgttggctagagacatcagttccttgccacctgggcctctccaaagggctgctcacaacatggtggctggcttcccccagagaggggaatctgagagaaagatccaagatggaagctacagtgtttttgttttcactgggaatgtgggcaaggcattgaaaaagatttttgtgtgagtgataaaatatacacaacattatttgctattgtaacctttctttctttctttttttttttttttttttttgagacagagtcatgctgtgtcacccaggctggagtgcagtgatacttccttggctcactgcaacctccacctctcgagttcaagagattcttctgcctcagcctcccaagtagctgggactataagtgtgcaccaccacacctggctaattttttgtatttttagtagacggggttttgccatgttggccaggctggtctcaaactcctgacctccagtgatctgcccacctcggcctcccaaagtgctggggttacaggcatgagccaccacacctggcctattgtaaccacttttaggtgtgcaattaggtggcattaagtatattcactgtgttttacaaccatcaccactatttatttctaaaacttttcatcaccccaaacagaaacttgaagctacagtgtttttgcaacctaatctcagaagcaacataccaccattctgttatattctgtttcttggaagcaagtcaccaaacatagcccacaattccagggggagggtatcttgaaggacaagaagaccaggaggaagacatcctagaaggcagtcccagaagctgcctgccatacaggctatgtgaccttaggcaggtagtaacctgcctcagtttcaacctttgtaaaacaaggatgatatcttagtctgttcaggctgctataacaaaataccataaactgggtggcttatggacaacaggattttatgtctcacagttctagaggctggaaagtccaaaggcaaggcagagtctgtctggtgagggcctgcatcctcacaggtggcaccttcttgctgtgtcttcacatgatgaaaggggcaaggggtctctctcaggcttctttttaagggcacttatttcattcatgagggctctgttcccatgagctaatcacctcccaaaagccctacctcctaatgccatggcctaggggttaggatttcaacatatgaatttcggagggacagaaacattcagacctagcagatgattttgcctgcctcatagtgctgtacttatatccagggggagcacccccaagtttctactctttaatataagattaaatagatggccccaagccatgatgtttggccaccatggactccaggcagggttttcctgcacggcttctcagatcttcatggtgcttcagcagagatcacatctttagatctctgacagcatgagcagatagagggcagagcagaggcagaactgtggcaatacaaaatatgattcctacatcttcttcccagtacaatctttatggggagcagagcttcctgtaaggaaggagaagcctcccctggacagtgttgagctcccatgtcctcatcatatctcctctgggagtggatccacccctccctcagttgctcacattcaccaccaagatactatccttgtacccattatggtttattctctttcttccatgcacattcccagtatcactttaatgtgtccgccctctttcctggtgagctgtcctgtgcagtgaataagaaacagttacttcccctggagggcttgcatatgactatgcaacgtgcaagcaggctgcttttaaaactattatttaaaatttttcaaaatggtagtatctctttccatccttgtcccctctcacaggtcaaacctaaacaattcagggtctcattccaaacaccagctcatggatgtgttctgagccatcatatattccagccatatctttatacttctgtggtcctgtggaatagtaccaatccagatccttaattagctgaaaattaattcagatgattgcatatttaagccaaagaaataaattaatattgtgtgcaaaggtttctggtgatgagtattttggaaggactgttaaacacatttgaaataaaaatagtttactggctaaggctcagaaaaaaacaaaaattattactgatcagtgttttctaaagtgtgttctgcagaccgaaatgctgtttatttgcccactgaccaaaattacattgataatctgtactaatctcatcagggttgatgagaatatggtaaaacagtcatggactgttttctgctgggagtataaattggacatgcctctaggcaagcaattttgtactatttatcagaatttaaaatgtatatgccctttggcccagcaactctacttctagaagttaatcttaaatcattcttgcacatatatacaaggggctttattgcagtactgttcatagtaagaaaacgttggaaacaacttaaatgtatgtctataatagaccaggtaaatcaattataatatgcctctactcttgaatattgtacaacagtcaaaataatgagcaggcttggtacaggggcttatgcctgtaatcccagaacttcgggaggccaagatgggaggatcttttgaggccaggagttcaagaccagcctggtcaacacagtgagacccccatctctaaaaaaataaacagcccacctgtatgtattcacatggaaagatggacatagtattttgttacctggaagaagcaagtcgtagagcaatattttaatataattacttctataggaaaagatatatacatatggtattatatatataatttctgtgtgtatgcacaatattgtgtgtgtgtgtcacacacacacagcatgttttcatgctgctaatacctgagactgggcaatttacaaaagaaagaggtttaattgaacttacagttccacatcgctggggaggcctcacagtcatggcgggaggaaaggaggagcaagtcacttcttacatggatggcagcaggcagaaaaagagagtttgtccagggaaacacccatttttaaaaccattagatctcatgagactcattcgctatcatgagaacaatgcaggaaagacccatcccataattcaatcatctcccactgggttcctcccatgacacttgggaattgtaggagttacaattcaagatgagatttgagtggggacacagccaaaccatgtcatatatgtatatatataaaatacatgtacaaccacatagatttgtttggaaggatacacaccaaactgttaatagtggttattcttcctcttgagaaagaaatagaattttctagagggtaggagggttgcttcctgctttgctgtgtatccttgcatattgtttgaattttttataattagtatacattgcttctgtaatttatgaaacaatttaaacatctcttaaactcatagacataacatatttatttttaagcaaattaagaaaaagaaccatgtaatctctctgcccaaatgtaattactattaatcttccatacctttttctatagatgtattgtttgtttttaaaaaatgtaatttttccatttagaccattttgtaatctgctgcttttatttcacaatatgggataaatgtgattattccctgcatatttatgtgccagtagatattcagttatatttctaatgacttcaatgttatggtttttaggtatatgagattactggaaactaggcatttgaaatgggcaaggtaaattcctagtgcaatatcctgttacctggcttcttgctttcatcttgttcatccgtacatctagattgtccaccctttatgcctaatctctgtcattgtcttgaataaaattttccatggctgcccattgccctcaagataaatttctagtttccttagatagattgcaaggcccctcactttccagttcatgtttcctctggcacatctttggccaacacctttatcttcaactcccatcaacagctcacctcacccaggcttattctcactctgccttccggtttcagctccaatgactccatttctgattcagttacttctctgtttctcagagcatcttccacttcttccatctcttgtttttgccacccaataggcactctcccttttcctgacaaaacagttcattgtgtgtgagagacttcgggcaaggttattaagctgtccacgcttcaggcttatcatgattcatcatctattaataggacaataatagtaccgacctcctgagattgttaattggaggaagtgaatgaatatctctcagtggattagaagtgcctggggcataataagggctctatgtgtttgaggctgcagttgctgtaattggaatcatctctcttttactcagtccacctagtttggttgaagttggttctaccctctgctctaggggttgctaaggtaatcagtaaatctcatccttctagatcctgtgatgggttcagaagagaacacaaaacccgatttgagccagtgagagtcactatgaagactttactttctgaaggagagaaactctctatctctaggcatgtgcataatgcatgctaggcttactgctattggagctgagacattgcagatggaagcccatcagagcatggaaccaacacagagggaaacacagctgagcaaagagagagaagtcctgtcctggtgatactgggatgagcctttcatgaagcgatgcctgaccagctcttcctccaattcctcagtcgtttgagccaaaatacttccttgttgcttaaaccactaagggttaggttttctgtcacttacaacccagagtttcaagagatatataccatgtcttaccaacatcataccttagtataatggtctttctattgatctctctgctgcatgagaccttaaggtctgtgaggacaggcctgggtcctatttccctttgtatctccagcttccaacatagtgcttgactatattagatgcaagtatttgttgaatgaaaaaatgtctcagaggctaccttgactatttcagcataacttgttcaatgctactggtttatccaggtctaaaagtctgctaatcgtatcagcaaggcataataggatgggaaaagaattaatattattgaatgcctgtcagtaactaggtaatgtatatgatactttacatcatgtcttttaatcagaaagcataattgctttctcccttcctgctatcccatgataggtctattactatacttccaagtcagtaaaataagaataatgaaataagaatatcaatgaaataagaatatcaatgaaataagaacaaaagtcagatgtggtggcacacacctgtaatcccagaactttgggaggctaaggcaggtggattgcttgagctcaggagttcaagatcagcctggacaaaggtgaaaacccatttctacaaaaattagctgggtatggtggcacacgactgtggtcccagatacttgggaggctgaggtgggaggattgcttgagcctagaaggttaaggctgcagtgagctatgattgtgccactgcactccagcctaggtgacagagtgagaccctatctcaaaatatataatatatgcgtacgtttagtatctaacaagaaaaatgaaaggcagataaaaagtatacatattctattctttaaaaggcaataatcatttgaatcttttgagttcaaaatgctgtgttttataaatttataaatgtgtctataaatttttctttctatttcttctacttcttcttagcattgaagtgagcaattttattaaaatctgccattttggtagtaaaacatttaaattcaaagtcaccttaagtgagtgatgtgcttgttgccagccacttaattagctgggggatgtgacacagttgtctacatgcaggacaatttcaaggtcactggtggaaaccctctcacctccccatgctgccagcttattgtcccatacatggtaacattcagatttgggactagatggccaggagaaaagcactgagtagcctcactccagaaggattttttgtgcttggctccctgacttctcctttcgttcagggagcatgcagtggtgagaacacctaaatcatgatccttgtcctccatctataactaattcgtattgttttaggttagtttctcagagcataagaatgaagactgtagtatggcccggctctttcttaagaaagcactcttgatgaaacaatctacataagtagactgaccagttaaatatggttattaatcattcagttttatctgcgtaatggtcttatcaaaactaattattgccatattaggtagatatttagagagcacccttttatggaccaaactctttgcagaatacagatactcaggaagaggatctcttgtcttgaaggagctgaaaattgagttgagttatcccagaatcgcttttttcctttagagttggaattttgacagatggagaaaattatctaataaagtgttcaaaaacttggttggcccgtgtgggttgaggattaatccgttagagccacaggcagattgagcacactattcttagctcagaagaagcaagttattcagagaaggatgagagatggcacattccctctagttcctttttgctgctagagaggtgagcttccaggggctcctagttcaggttgcttgtatttttttcacctacatttggtctccacaagccttcctttcatcgtcagatttgtccaaaatttaacacctgtgtgtgtctaatcaaggaaggacatgatatcacattatgagtgtatttaggtgagaagtcattgaggaaaataatgtttgtcatttgaaagaaagaagagtgttttatttttgagtcacttcaggtctttgtcctgaagaacagattcactcttgtttaaactctgtctcagtgagaatgtttgcggggatgggaggtagcacttcccattgcatctaatcatctagaaaacaagagactacaccttaacagtgcaaatccttttggaattgatctacctggtcttctgctttttcctttctccactctgctttgtcctgaattcccagaaatgccatcttaaaactcttctaaaactgctggctactctttcccctgtttttttctaccagtttttttgtttttgtttttgtttttttttaaaccatcatataaagagacagcttccaaatggtactctgtaattgagcaataaacaacaaacttttgtctgtatgtatccatactaccagtcaaaatacttaataacaaaatatcaataaaaaatggccaatgtgacatttttcatcttgtgtcaaaatcagaaccctttgttttaccatttgcttttaaatctggggggtacataaattcctgagaaaatactaagcatatacatcaaagaaattcagacaaatatatgtgaacagagcaggtcactgacactaatcttggccataacctagagttattcagaaaagatgtccagagacaaatcttggaggttttgaagaatcagaaagataagaggaaaatctggatacagaggtatcacagaagccaaggaaagtgttttaaaaaggaagacgaggtcaacagtgtcaggtgcagctaaaatattaagtataaagaggactgaaaaatatgtcttgaatttagagacttgaaggttattagtgaccttaacaagcattgtttttggggagttatgcagctagaagtcaaactggtaggttgaggaaggagtggaagctaaggcagttgagctgtgggtacggacacttccttcagattagctgtaaagacagtagtaatagaacagtggctgtaggaggataggggactgaggactaggaaataatttattttagatgggagatatttgaataggttcaaagcttattggaaggattcagctgaagacagaagtccggtaacaagagagaaaatataatagaatagataatgttaagttcccaagatccacaatgacccccaaacgtaagaatcatcttagaatagacttgggatacgaagttcaactgcaaaataccctatttttagacagcctccgaatttaggaaaccatgtccagcccagaggaaaaaagaagagggctgagttactattttctccatgtttgattctaaggaatgtagcattatttggatattacataaaaccttggaaaataagggaaggggcaggccgtgaagatatgtgcaattaaaattagaaactagacatggccagtaaattgattacaagttaatctagctttgccataacctgagagaggtgatgtagtcaggaagttaggttttatctcaggttggctttctaaatattgaaagctgtcaccaaagaaactagcatagaaccagtacgttacctgggggagagcacctagagccacagatgttggtgtgcctgagaaagtccagaattttaaaaataaaattagaatagctgtgaccggcagtaccctccagactcctcaattgcacacagctccctttgtgtccattttgaggactcagcaccaagacttctaagacatgaagcactgggcaatgctttggggacatgacaatgctaattatgctaaatactcatgatatgttgtctaatattgatattgataacctaagcaaagacttactttagctaagctgaccttgctgaattgcctgtgttagctgccaacaatgtcaacagagaggagagtaatggtcaaactggaggcagatagtgttatgatttatgaggggccatgaaggcagtgtttttgtccatgggagctgtgattagatgctgtgggtagctgaatacagttgagatttttcaaaaattggcaggcatgttactttggaagttctccagtgacacatcagagatttaattattacagttttgtattcttgctttctgtgacatctctcccctttgtgcttaatcaatgtttgtttcccagtatgtgtttgtcactattattaattttggaagatacaaggaaatccccaaatcagtaaatgccctctaggagtgattctctagtcttgtagttggacacaaacccacaacataacctcctttgtaggctcatgcaagaggaaaggaattcagcatagtgatggagtaggcccagttccaaggatgccactgggtatcctgtacatccagagaggaacagggcaacttcctgactcttttacgtcactttctgaaaggaaagggaacgtttcaaagtaggaccatgcacagatacctgaccacctatccctttttaaagtcccacctgtcaagtctctacaccagttgtattgcattacctgggtaaaggagtcaagtgggaaggggtggagggtagtcccaagctaatgagaccagcattcccctgggttattttatagtttatcttattaatcctagaagcttgactatgaggcctgtgttaggaggtttctccttggggaaagataatcttaccaacatctttgggctgttttcctaattcttaacactactcctgtatatttcaaactgggagctatgaaatagacaggtttgcctctcgagactttctatgaaagcttttttgatgttactcctgggagcttctcagtgggccaggaaagaggccccaaagccacactgtatactaggctaagtcaccacatgacgtatgtaagattcacagaggatcctcttgttcacctatgacgaggccagacacaggccctccaaactccctttctctgtctcataaatgattagctgaacgtttacccccctgtgatcaatctggacaaaatacttactaatttgatttgaccgctgtagtgaagcttgtctcctcctccacagcctgtaaactttgactcattcctgaagctaagcaagtgttggaactgggaacaacccctccttaatggcccttcctgagactctccattggctgcaaacaaatctttcttgttcagctgtcacatcatcccacgtgtgcatcccccatgcctagctccttctagccatgtttattcctcttcattaaaagagaagccctttcagcctgaccatctggatgtttatagatcttatggtcagagtcttttccctattgcaaaaatgatcctgtccatttggcgtattctttaaaagtaaagtctgtccttacctaagtctaggtttgtttttatttgacactactctctatattttggtatttaatactgtgtacattgaacacgatcttttcttgatgacctagcttcatctttaagactattatcacattgtgctgaagaggtagttgtcagtgaggccaattctgggtgggatattggctgacctggcactaatgctggagccaacttatttctgggatagagcagctacttttgttttatgcattttgagttacattaaactcatttggatagagtataatggtgacctttcacttggccagaagaaaaaaaactacactgtttattttcttatttttttttttttttttcactggggtctcactctgtcacccaggctggagagcagtgggtgcaacctcggctcactgcagcctctgcttcctgggctcaagcgatcctcccacctcagcctcttgagtagctgggaccaaaggcacgtgccaccatgcccagctgattttttgcatttttgatggagatggagtttcaccatactgacactgttttaaaaataatcctagaattcgtaactttctagcgtgtgtatgtataaattacaatctgttatgtttagaaattaacaagaatcaaataatgaagctaattttccaaaacgtgattgagctacaatgcaggcgtctgaccatcttatttttagcccccaaggcatgcaaatgttagaagaaaaagaatctttaaaattgcaattgatagtaaaattgcttaattatatgtataatatgtggaagaatatgtatatacagccatttatcaaaaaagaggtcaggaaagttgggtgcagtgtcacacacctgtggtcttagctacttgggaggctgaggtaggagaattgcttgagcccaggagtttgagtccagcctgagcaacatagtgagacactgtctcttaaaaaaacatggggagtagggtaaggaaagaaccaggtaaggatggaagaaaaccatccagccatgaggacttacagagcaatatgatagagaaattattctcatttcttaatataaataagaaaaatgagatttgaagatttgcaatttgcataaatttacctgacttgtaagtgccagaaccagagttagaactctgttattctattttctggtctatgactgtcatcaggacactgtgaagcctttcctttagtgagttccaggtaacacagaccagaaaacagtcctaattgtattcgttgttgttcatgtcactgtcagactctacaacttgttgcttccattactgatttcaataccaggggctgctatccactcttctcttcctccttttctaggaagccttactgttcaaatgtgtaaaaactcattcttgacttccagccaatcagccagagacatgaccttcatgcagaccatcatctctttgaggctgtgtctatttctgagtgcttggaggctgctgctttgctgacggggtagagatagaaagaaagggactgtttctctgtttctccctgttagaaatgcttgttgcccagtgccataaagaaatagcacttgaacataaatttaatttcctcagcaaggccattttttttactttctgcagaaagggtacactcaccagcagttttgccatgaaagtacaccaaacaaaagaggcagggtcatttataacctgatgcgtccaccctactgctgtgtcccgtttccattggctggaacgggacctcacattctgtatttgtcctgattggctagcaacttagaactttttaaaagaggcaaaggcagaggagaacaaaggaaggaggaagtaacttgtggaatgccgagaaaggtaaaaacaccttcaaataaggaagaggaacaggctaagacctaatgcttgcttggaccagtgtaagcatgccagggcaaatatttaggctaaattgtgggagctaagaacataaagtacattgatttctttattatggctagcagatatttaagaatgttagcacaggtctttgaataatttttgcttctaagagaagttactatttattcctaattagatggggaggaaagtctttgaagaggaacccctactttattttctatactccctcaccttcctaggtcgtctgaaggtttcctgaggttctggaaaacggaaagtatcctaaatacttaaatagtattatatgctaccaattaattgtccactctatcatctaaagatctcacgacaaacagtatatggaagtatatgtttcaccttattctgtaggtccaaattctcttttgagaattatgtggacttcagagctagtttgtttcatggaggtagctagtttgtttcattgacatgctgcatgcctcacttggtaaggctcaggcctcgtccagagcagggtatagcctttggtctagccaaccttgctggatgttgtaaagtattttagctattggattatgctttctataaatgtaaagatgtcacgggacctcaggtgtattcatgcaggctttgccatttatcctagctccaattagttaccgcaggtacagcaaaacaaatgtaaggcaccgcaccaacacgaggaattatcagtcttgttactaagaggacagaggaatccctaccatgtagggtaaatttctttctaggccctttaaatgtgaaatgtaataaggcaatttaaagatcatttcactaacatgtaaaggaaaatacaaacatgtgcacatctaattgcaggtcttacaattttggttctaaggaaaataattaacataagctcaaaatgacacttcctgcctgggaacagttctggcgaaataatgaacctgtagaaataaaattgaagagctaatcagccttgaacggcgctgaggtgtgtgtttctctctctctggttgctgttcatctcttgcttgtctctctgctttcccctatgcctttgatgagacacataatttttatgttgggcgacaaggtgacagttctctctgataattacatagatgagaatatatttggttttggaggaaaaaaatttactttacaaatgtatatatagaaataactttgaccttttggtaaagataaccaagttcttcctcagcaacagaaaaacaggcacattcggaggtgtgtgtttcattttatagtggtagctcctcctaataaaaacctttgtaaggaaaaggacaaagttgttggttcagggggctagcggtagaccccttctcctaacagctcaaagataaggtaaatcaaagtgccccccaagagttaaatgagagaaaacccacatgcagtggatagcattagccgtctgtggtgggaaaggaacagattgtcaatgaatgcatggttaaagagtttgagaacacccaaaactttaatcaaggtgatatgggagcaatctcatgaaagtagaatgggaggatggttgcatttagccattacaacctcatcagttgcattcccacaggaagactgcctggatattaagatgatgtcatcacagagctgggattctcacagtgtggtaagaagacctctagcatgagaatctcctgtaaaaatgcacatcctagggctttactgcatagacaccaaaaatatttggagtgggctcaaagaatctgcattttgtttatattcaactgaattttcttttttatagtttttttctaatttaaaaaaaagtaacacaatatgggctcattgtaaccaggaatgcaaatatgaggaaaggaaaagtaaatcttggttgatccttctttttctcttaccctgaggtagcaatactagtagcagttgttactagcaacaatactggtgagcatgagcatccttccatgccatttttcacacttacaaacatatatacatttttaagaggttttattttttgcttctcttgtttgtttttatatactaggtcatattataaaatttggagatttacttttctcaagtcataatgccaaacactccaggtattttaaaaatgtatgtacatctatatatgtattcacacacatttacacatatacatacaaacacccacatacatatgtgtgtcaggttgcttgaaaatgcagcttaaaacccatttagggctaaatactggcacagtagtccagtatcataaggaaaagttgaaaaaaactttgaagaatgacattcttttaaattctatagttttctatggaatggattattaagatattcaagcgtgtcccataggtgaacattcaggttgttttctattgttgctgcatgtgttttatttcattgccattacaaatgcctttattttggggatgatagatgagcagaaatgggatttccgagtcaaaggctatgttcattttaaattctattagtattataatatgactttcctaaaagcttgaggtaaattacagttgattatcatgattccacttagttatgtcctataaaatcaccttgagcactgaagtagcagacactgactcactgtgttaatgtattaatatgttgtatcaatatattaatattgaattaatatgttgtatcagtatattaatattgaattaatatgctgtatcagtatattaatattaaattaatatgttgtatcagtatattagttattaactctggaggaaatacagggttaggtttctgcaagctccttgtcacacatttttcaacccatcaatacataaccttgttttacatgtgtttctgtttaaatacatcttatttatttatttatttatttgagatggagtctctctctgtcaccaggctgtagtgcagtggcacgatcttagctcactgcaacctctacctcctggattcaagtgattctcctgtctcagcctcccaagtagctgggactacaggtgcacaccaccatgcccagctaatttttgtatttttagtagagatggggtttcacgatgttgtgcaggatgatcttgatctcttgacctcatgatccacccaccttggccttccaaagtgctgggattacaagcgtgagccactactcccagtcagcttatttattacatattattgataacctagcattgaactcatggccagcaatatgtcccatgcctgaacaatgcttatctaacacatggactttctctatcaggcactttacagactaaagtgcctttactaaagtctgtaaagtgcattatggagaaagtccatgtgttagataaggattcagccctgtgcagaaaatgtggcattaaattgaccaccaaaaggatactaatttacattatgagggtgaaacaagaaaggagaatgtcatcttgttctgcctggactgggaacatgcatgctgggtgaccacactgcacgtgaccatgaatgaccacaaatgatctccaaagtgccacaagtattggctttggggttacaaatacatttgagagtgtaggcaaatttgtgaatacagaatccacaaataataaggattgactgtatattcccaccagcaaagtgtttgtcatgttgattattcttcgtcttcactgtttcattttttaaaatatttgtgaaattttaggggaaaactatttcctcgttgccaactaactagtgaagttcagcctattttcttaatttattacacatttaaatgcaatctttgataacttacctgttattatattttgccctttttccaaccaagtgacttaatttttttctcatcaattcttagaaactgtatattagggatatcaatactttgttatatgttatgtaaatacttttttattctattgcttgtcttatttttgttttgggtatctttgctatatgttttaatactcaaatatatcaaccttcctcttgtgatttaaggtctcctgtcttattgtatctccaagactacatagaatttcacatttttattccaatatttttattgttacatattttgcattaaaatcttgactccatccagaatgtttttgtttctagtgttaggcaggggtctatgttcattttttttcttccagacgaacattcctcagttgttccaaataggaagagaggaaatcaacctctccatgtttgcagatagtacgattctctgcctggaaaaccccattgtctctgcccaaaagctccctgatctgatacacaacttcagcaaagtttcaggacacaaaatcagtgaacaaaaatcagtagcattcctatataacaacattcaagctaagagcaaaatcaagaatgcaatcccattcataatcgctacaaaaagaataaaatatctaggaatacagctaaccaaggaggtgaaagacctttacaatgagaattacagaacactgctaaaagaaatcagagatgacagcaaattgaaaaacattccacatgaattttttttttcccatctgaattgttcctggatctacattatccatgcctggtttccaggccctctcagagattctgtaaactacttatatcctttattgatccttttctacttagcctggataaagtagattatgattttgcaactaagagtagtaattggtgctggaaatatttgtacctaatggactgtcaagtaaatgggaacctggggttagctatttaacatagttgagtttgaaggcatgtggagcaaaacatttccgtaaatattggctttggttaattggagtgaagtgcctactgaaggcagcattttgggaaactcaagtggctgcttccgtatagtattttaagaaacgtggctgtactggctacatggaattgtgctaaaaatcttaaggaaagaaaaataaaacaggctcaaggttttaaattattgcctcaatgtagtctcagaaaacaagagaagttttgactggcctaaaagaatatcgtcttttatagcaacaaggttgatgaacttgaacatcaaacatatgctctgattctgtgacttattgaattacaggctgcattgaaagattggctgtgtttcttaagtgaaatttaggacattgggaagaaaagaatgggaccctgagaattagagtagagacatttgggaggattcagatgactcacactcccaacctccctaaatcctccttatcagcagcagcagcccttatcctctgaaggacacaaacctgtctgaagaccttagaaagaccttgcctagcttctaagaggatgccagttcctcatcactcactcctatcttattacctctacttatctatttgaagtcagatcccagtgtgtcccagagatttaatcataaagtcacaccttgggagaaatatatttcttctactactgccactgctattgcaattttttacataccaaaaaatcacaagattttgcaatttatgtctacaaaatttgcataaagttatccattgctcatcctaattttcttcctaactaaaagggacatctgtttttgcaatggctctagtagaatactacatttcccaagcttcctaatatctaggggtggccgtgggacctagtcaatgagacataagtttaattgtactgattattcctaaaaaaaagttttggtatcctaagaactgctcttccttcttctgcattcttccttactgcgtgggcttggtcacaatttctggaactatagaggtcatcttgcactcatcagggaaaggccagaagaattgctaggacttccaatctgacatttttaaacccctgaacaagtgacgacaatcacttttactttttttttctgtaattaatggaagggaaacaaacctaattgatacattcagccaaacacaatcatcagcagtgatgatgcaaaaatgtagcaaagacatagaaagcacctattttccccttgaaaaagtgaaaattcttgagtttcactgattttgctaatttagatcccataccaacactttattcaattagtttggccagagagtcgctgtgtgctagttggcttaggccagtagggccctccctgggagctggggtcaatcccattaaccccacttgtttgcagctccatgggaagaagtgctaagaagaaaaaaggagatgtttggatgtgaaataggtgagtaacatgtccacttcatccctattgtgaatatgtcattaaaatttactactcttattccactttcatggtcactgaacaatctgctggttggatttgacttctcatgtaatttataagagggatatgaactaatcaactaatactagcattgtgatctgattgctggtttagttaatacatttacatagacgattttatgaatcagcatctctgtctgagcttagttaatgtaagtactccacccccacctccaagagatctgctctgcctgtgatgacaagccaggtcttgagtctgtaaggatgttcagggccagatcccagaacagggaattctccaggtaaatggcatcctgcccactcactgcctggggaactgcctttgctgtactttttagcttctccttgaacccttgaaactgttgtagatgtcatgagtgttatttttcttcatgtaagatttcagcagtagcatgtgccctgtctccaggagtaccaaagataccatgcagggtgggacagagccagttcccatcttcctggagtcaacatgattctagaaccttcaccactatagattgtcatcacttcgattccatttaagagtgctgtggcagatgtaactagaatgataccaattgcagaaatgcagggtgagcttgcaaaacaaaaagtcattgattctgtaacccataggctaccaagtgtcatgcaaaacatctggggtatagttaacttgccaatatttattgagtacaataagatgtacatctgactaatagagatgttattagtaatactcaataggataaagagagttctggatgggaagatagaagctacactgctaagtgctaattttctttactatggatgcctccatgagcaaatcacttcaattgaacggccttcaagtttttcacctccaaaactgaatactgtactcacaatagttaaatatttcctgagcagttttatttatctcattaatttactttaaaaggcctttcttcgtatcacaaactccaactggattgtggtttctgagcaaattataacaaattttgtgtttgtggaatccaaattaatgagatttaactgcatgctaattaaaacgccttagaattctgcaaagactttcccttcaagagttcaaatttgttgatgaaattttctcgttagacttcacaatgagtgtggaaaacaaatgatcagtctgtaagccctaaaaaaagaaaaactttaagatattcttcccaggttttaataacacaacctggcagcaatggaacaacctcacaaacctggccttaaggttatcttgcaggttaactccctctcttaaagagattcttgtaatgatttaaaaccaaatggcgacgtagcattgaggttcaattagcggattccttagttgggtcttgatcacatctctgattgtcacctctaatagggcgtattaaaatttccattcattatagtcattagtctctgccagtgataaggttgtgaacaaatctgttggtgttcaacttctaatttgtgtgataatttgtttatgcttagaacacttactggttgtggatggagggggtgtgacccatttagaaactattcatgtagataaatctggaaagtttgcctggaatggctaaggcatggtgatgccacctagtctagtaatagacaagggccacttagaaggtcagatgagtcttattccagagtcaggaagagaagtggtttacccagagatgcaatggggttgcttcaaatgatccagaagggggtttttgcatggaaagaaaggttccattcggtcattgttactctacaaatggggagaaaagcacctgcatcagaatcatctgagaagcttattataaaggtaagctcttgggctacactccagacctctggggctagggccctggaatctgtgtggttagtaagcaccccagattacgcctaggcgtgctgaaattgagaaccactgcaggagacacctgagagcagagacacagaaacaaattaggtatagcaaagacatcaaaacattttgtagtaaagtattgagaaaccattcaacttgcatttatcattgggatttttgccgtcaacagctgaaatacaatatttaagaggaagaaaatttcaaatttgcaacaagccataagaaatggggcttggcaaagtgtcttactcctgtaatcccaacacgttgggaggccaaggtgggcagattgcttgagctcaggagttcaaaaccagcctgggcaacatggtgaaaccccatctctacaaaaaagtgcaaaaattagccaggtgtggtggcatgcacccagtctcagctactcaagaggttgaggtgggaggatggcttgagccctggagggagaggttctcgtgggcaagatggtgctgttgcactccagcctgggtgacacagccagaccctatctcaaaaaaaagaagaagaagaaaaagaaatggtttgggtgtgggtttttttttttatatactttagaggctttcaggttttttcttgctctgtgtggtcttattgagttatttgtgtttgagtttggtacataaaataattttagtacttcttattatatatacaagaatcatggatatgctcaactttatgtctcctatgcctgaaaagttgtgcaccaataactcataagtttttttaggacactgtacactttgtgaatctgatgaaaggcgtggaacttgattcccacaaatgtgtgtgcatcagtatataaagcattacatttaatctctggggacttagagatcagtgctctctctggactctacatcaagagcctctgacctgagcctaaaccacccagcctgctgcttcacaaagtcaagtagctccacctatgactcagccatagcaagcagggaaaggccatggtttgtgtgggaaaaatggatgaaagcaaaactgaggaattcagcagtcctcgaggcctcgactcacacctttaaatctgttggaattgccacaaaaatatttgttttcctacaagaatattagagatttacccatcttgagtggcaagcctagatgccccattcactcatcaaggcctgatgccatatttagcaaaagagccataactgaaggtgcgtttgatgaatttaataggattatgtcttactaatgacattaggctcctgggtcgggcttagcctttatatttacgttttatcactgcaaatgaagatgatattctctggcatatgagttttgcaacctcagggttagtcttgtgatatgtgaagtggcccttggcttgttttgggcccattataaattagatttttaaaaaaacattcactgtgtttattttttattttatttttgagacagggcctcatgctgtcacccaggcaagagtgcagtgatgcaatcacagccctctgcagactcaacttccctgggctcaggtgatcctcctacctcagcctcctgggtaactggggctacaggcatgcatcaccatgcctggctaatttttttggtattaattttgtagaaatgggttttcatcatgttgcccaggctggtcttgaactcctgggctcaagtgatctgcctgcctcagactcctaaagtgtcaggattacaggcatgagccaccacgcccagccaaaaaccattcgctttaggaaaaagaaaaatcaaacttcctataataccaccaccaaagatacctaacgttaataatatagcatgtattcctctagcaaaaattctatgctttttgcaaaaatagggtcatactatatttagtgtaatcaaatctggcttcttcacttatatcttaaatatctatttcaataagttccatctatcatgttcactggctgctaatattctccaatatttatgtatactttaagggtcaactaatagatgcttcagctcattccataaatgagatttttctaacatctttctatgcttatagccattaacatttgggatttttgctgctgttatggttaattttggagtctctgaagaaacaggtgctttgtagcatccagttttcttgcttaaaaggaaattcctcagagtttaagggtgtttagatgtaattttcacttttcactttgttctggaaaactaagaataaataaaaatccaaatctatagcccatgtccacccactcctttgaaagtaatcaacctcagtctctgaaatttcaaaggaaaaaactgaaaataccactgaaatcatttttaattagacatttagcagttcctaaagcaagttataatttggccttcaaaagcagtatttttaaagaagggagcattttaattggtatgttctggcttagcatattttctcagacattaaaattttaaaatctagatgtcatatcaaagtatatgagatgaaaaatatgatttcttctatctaactagctaaactgtggcacataactggacgtgtctatatggatggatctctgggagaaaagaaaaacttttctattagctatggcttgatatatctgggggcccagagctgccaattttatatcatgcatatgctgtgtagtatctcctactcaaagtgtggtccacggaccagtggcatcaatatcaactgggaacttgtcagataaatagaaccatgaatcccagcccacatatcctgaatcggaatcttcattttaacaagatccccgggtgattcttatacactttattgattgattgcttgattgattgagacagagtcatgctgtgtagcccaggctggagtgcagtggcgcaatcttggctcactgcaacctccacctcctgggttcaagcgattctcctgcctcagcctccaggcgcattccaccatgcctggctaattttttgtatttttagtagagatggctttttgccatgttatccaggctggtcttgaactcctggtgtcaagtaatccgcccaccttgacctcccaaagtggaggcattacaggcgtgagccactgtacccatgcatgctgttgaggacaccaaacaaatcaaaccaaccagatatatacacaacattcatctacttctctccactagatatacgacatttctttcaaagaacttgattcttgcaggtgtttgtaaagtgatttaaaatatgaagatgttgtatgtgcattaatataggaatgtgtgtgttcaatcaaatggacataaagagttacatatagtgaaacttctcactttattttgataataggagatttggtgagcaccttcattccttcttttcattttaatattgcatactgtgcagttttttaaaatttgttttagacacaagatctcaccgtgttgcccaggctggacttgaactactgggctccagcaatcctctcccctcaacctcctgagtagctgggactccaggcaagcaccactgcatggggcttggaacattttcttaatctggagacatctaaattaagactacaatattaaaatgatgaaaaaattgaataaagatgttcaccaaaacccctagtgttttgggcaataatgattttaaggctttgaggccccttcccaatgccagtcattctacaaattgttcataagcacaagcaaaatcgtaagttgtaatttggccttcaaatacagtatttttaaagaagggagcattttagttggtatgttcttgtttagcatattttattagatgttaaagttttagaatctagatgtcatattaaagtatatgagataaagaatatgacttcttccgtttaactagctaaactgtggcatataactggatgtgtctgtatagagggacctctgggagaaaagaaaaacttctattagctgtggcttggtatgtttgggggtcccagagcaagccagatacttgactggggaggggggaagagcaatttatgtgccagtaattacaattataaacacatgaatgtcctgggattggagaacctgttctgtatgagggtaccaggagatcttaacagtggaagaacatttaaactgaatcttgatgaataagtaggattccccaaggggaaccaggaggaaccagcacctcaggtaactggaagaatgaatatgaaaatacaaaagtaggccaggcacggtggctgacacctgtaatcccagcactttgggaggccgaggtgggtagataacttgaggccaggagttcgagatctgcctagccaacatggtgaaaccccgtatccactaaaaatacaaaaaaattagccctgcattgtggcgggcgcctgtagtcctagctacttgggaggctgaggcaggagaattccttgaacccaggaggtggaggttgcagtgagtcgagattgcaccactgcactccagcctgagcaacagagcgagactctgtctcaaaaaataataataataaaataaaaataaaaatacagaagtaggttaccatgttaacaaatacgttcatcatcttgttagtagggacccattggagggttttaatcaaggaatgccattagatttgtatttgagaaagataattctggtggttcagtagaaatagagcaaggtgaggtcagaggcagggaaatcaactaggaagccgctgcaaccatctgagtgacagaagatgaacttgaatcgaacattgaatgtagcaatagtagtgtgggactaagttcagagacatgctggaagtggagcaggcaggttagggactgagcaaagaggtagcgtggggagactagaaagacaagaaacactttgaagattctagttcggggctgggcacggtggctcacgcctgtaatcccagcactttgggaggccaaggcagccagatcacctgaggtcaggagttcaagaccagcctggccagctgaccaagatggtaaaactccgtctctactaaaaatataaaaatttagccgggcaaggcggcaggtgcctgtaatcccagctactcgggaggctgaggcagaagaatcgcttgaacctgggaagcggaggttgcagtgagctgagattgtgccactgcactctagcctgggcaacaagagtgaaactccttgtttctgtcttcccttccttgtgaaatcattgtagatacatttgggaaaacaacacaaagagattccactgtcccccaatagtaacgtcttgcaaatctatagtaaaataaacccttctaaaaattgtatgatttatgagcaattttaaattaaaatatcagtatactctcatgctgatttctaactagtcatttctctgacctcccacccctcccctcaccccttggcccctaccaccctcccacacacatacctaatggctctccagaccaggtcctgtccccatgctcccctgatcaagcagatcttgaaccttgtggggaaaatcacgtctctggtggtcactggatgcctggtgtccatcctgaccctctaaagctagggcttcccattgtgggctggtactccctacatgtaccctccatgtcctcttgtagggaccccagcttcagcagtgctctttaccatgttgttaaatatatggcaggttggggtttgattctggccacagctctccccagataactgacagagtcatttagggcctttgtcccacatttctgggaaatttgtttctataatagttaggactttggtatgctagtgacagatgcacagatcaaattaacttaagaaacataaatgtactggcttactgagttgggaagtccagggataaagctcccttcggagattctgggactcaaacaatatgatcaagattctctctcccttgcacttttgctgatttgttgacctcatgctcttcatggtgtggtttatatggccattggcagatctggagatacatccttatatctcagagtgacacatgaggcataagactcgcttctccaccatcactgcaaaaccctactggagaagggctctgtttggcctcatttacatcctgtgccaatcctgtgggccaatcacttgtgcagggcgatgtagtgtattttggatgaatcaaccaatgactcagcctgagctccttatcatctgatagacttggaattggggtatcaaattgtctggcttagtagaaccagatggaaagggaagaaagagtttttcaaaggaggagatattgacgggatgggctaggcagaacagctaatgtccattttagttattcctggatctagcgtcttctcctgtggtgaggagagaggaatgtcacatggcacctatggttgtctcttgggagttatggtcagtgttgacagaagaaggcaaggatggctgtaagcaccaagatgtttatatgtatgaggttggaatttagaggtgttcagaactaatagccttaattgtctttgtgaaattgaaaacaaaagcacttgtgaaaagacaggaaggcagggtggggagcttaaaaagctagttgagggtttgaaggatgagagagagatcacaaggacagtgtagaggactgctaagagatattgaggatccaactaagattggaaactgtagcactcaggattctccagagacacagtaggatggatatatatgcgtacgtacacacacacagaaatttatttcaaggaattggcttatgcaactgtgggggttgcacatctgaaatctctaggacaggactgcaggctggaaactctcaggcaggagctgatgctgcagtctcgaggcaggatttcttcttcctcggggaaacctcaattttgcttttaaggccttccaggtgaagagatgaggcccacctgcatgatcaagggttatctcctttactgacagtcagctgattgtagctgctaaccacatcaatcaaatacttccacagcaacacctaaattagtgtttggtgggataactgggtaccgtagccttgccaagttaacacatacattggagtgtcacagaggcctaaactctgtgagccagtctgcatgacactagatgatctatttttcctcttcagttccacagagataaatacctagcaaatagaagccaagagagtggattgttaaactgattgatgattggaggaatcttcaggctggggtcactggagtctcaaggggagatcttgacgttgctgtcgagagaatggtggacaaagtccctcagggttgtggctggactgagaagttagttccccaagcgtaaagtgacaagagcatcaaccccaccagttaaaatgaataatgcatgaataatacttatgttgggcactgaactaagtatcacattaattttaaattattatcattgttacgatttcatttaattgtcaaggaactgacactacataaagtcagagtggatttagtgggagtaagagggtgagctaaatgtggtatattggagtttatttatttactcaaccaccagttatttaataagcattgattatgagccaggaactgttttaggtgctagagatacagtggcaaacagaacagacaaagtctctgccttcatggggcttaattctgttggtgggaggaggtatctgctaataagcagacaacttcagcaagcaacactagccccaggtccagtggtaagcgtgttatgaagaatagtaaagccaagttaggcaatagagagtgatggggccagacagggctggggtaggatgctagacttataagagaaaccctttcggataaagtgacatttaaacaggaccccgaaggcatgaagggagagcgtgggctatgaatatatagggaagagcgtgttcgagagaaagaacatggtgtgtgcaaaggtgctcagaggctggaggctgcttctccctgtaagtgaggaggagaggggtgggggatgaactgggataggttgcaacaaggagccatgttgggtgtggtgggtcattataagttctctggagttcatgctgagtgaggtggcaagacagtggagagttttgaacacagaagtgacaaggttcttctctaagggccgttttggaggccgtatgaggctgtatgaagggatactgggaggacaaggatagaagaaggagaccagtgggaaactgttaccgtaatccaggcaagaagaatttgtggtctgaaagccatgctaggtatgagcatgaccaggaccatgccacgggtatgcattgctgaagcagcctgccagcgaagaccaagatggcccaggaccctagagcagcatgtctggaggggtctgctgtgttgacatggaacttcttcaagatggagacaggatgggtgggcatggggagaagaactctgacccagattctgaagtcctccaggagagggaagatggtggaggaaagcagcaacggggtagaaagaggagcattagctgcatgcaggcaggtgcttgaggctcctgcctctgggtctttgcatgcacttctttcttttctgaaacattctcttcctaatatccacgtaactcagtctcttccttcccacctcagatctttatttaaatagattggaagactgctgtcaggacatagtttatgtaagaatgaagataactctcttgcctccatccttatgtcacctggcatggggtggcatgagcagccactgcctggaaggtctacttggaagtggtgtcctcaatggagaggcggatctggcttgaggctgggaggtgaggggactctcctgtgaaaggggtaggaatgctggggaccttattgaccatgggctaggggtttcagcaggcactgtggggagtgtctttagggaagtcaggaaaggagggtagaatcaatggggatgaagtaatgagaggaccagagggaacaggtgctgggatgggagctgaggatgccagaacatgggattgactgccctgggagggcctggcaagcctgaggctggcgtgcatgcagcctgtacgcttcctggggcaccaagcagagcatgggtggccacaggagacgtaagggagcgttgtctgaggggatgtgaggaatgaccaggtgctacccacctacagagctctcaggatgcttaactcctgaagaagctgtagcctggaatggcttgtagacctgaatgtataccaggtgtaactggcagagagggagcaggccccagaaggtccttgttcatcctagtcaggtccttcatcctgtcccacttcagggcccaaagtgctctgattctaatgccagcctctttggccttgcatttgtagagaagcgagttccctatcattggaggtatctaagcaatgaagtggacagccacttagaaggagtgtgcaggatggaggcttgggtatttcttgggggctggactcgaagacctttattttccacttggcctggagcgtctgtgagtccttgtcaaatactgcctggcacttacctccatcgggacacagtgcaggcatggctcaagtgggtaaattgtttatggaatgcaaacctcgtgggacttatagatggcttatcaatgtggaaactgtattaaaaataagttgagatcagcaccttccacagcctctgcatatgaaatgtcacttacatttaaacccacatcaaaggttctgggttgattctttgtatacttgttagtagtccaatgcttaggacaccattttcaggtagctgttttttagtgtgtgtttggcagggctggttctatacaaacgttcacagtgagcagagggacagcatgatgtctcctgccatggtttcacaattagctagaagagagagggttgcaggctcactgggccagaccggacgctagaggctgtattcagtaggtggggcagtggcatggacctctctgcccatgatgtggacatcctggcagatgggctgtttcgagagcaagccatggcttcaagaccttggctgtttgtggtgatggggtgaaggaccgaatagttagagttcgtactgagtgtctgtggtgcagggagattctaatcacatcatttgggggtagcggctgtgcttagcactggttaagggaacgaacgggcatagttgtgctatgcttgtgagtatgctcacttcctggagatggggagagtcaaattcttagagtgttgtgtggcttatatattttattaagcacctgtgttctaagtccgataagcactttgcgtacactgcctttaattttccgaatcattccgttttgcttgttgaggaaggcaagcagttaagacaggctcatctcttgacatgaccccacatagtgactgtacctcagaggggtaaccattttctgagagctgggtcccaactgtgttagggtcaaaattctgatttgcataaccagaggtgaatgaagacctgggaaactgacacatactatcttgactcataagagactgatgtataaaaacagaaatgatgccagctgcttattttgtgagaagaaaaaaaaaacaattctgtgaaccagatacatatgttctctcatcagtgcattcaatatgaaggcaaatttatatgaggacataaattaagatcagaaggttgcttatcagcatgaaacagtgtaggctgagtgaggataggacaccttactgacagggttacagagctgtgatcgtcttggctccagtgccaccctgcctgctgtagggctggatggtaaggttacctcacagtgacagggacaccaccaccagtcccagccgctctcagtctctgcttgcagtgcctctaacactgatcatcatcagcccattgggctgattcatcctttctttagacattttcctcatggaccctcagtaagttgtcatcttcctttgagagcaagttttctctttgtggtatctttgcatctcaccactttatttcgttatttttgttttgtggctataagctctacagagaagttgtattgttccatttccaaatttgtgggaaaggggaagaaaagaggagaggcaccatattgtcagcctgatttcccacctcagagacgatattcttgtcctcgttttacaattgagtcaactagatggcatggctttttttcctagctcccattgccatctgacgtggtatttatttagttgtttgtttattgtctatttctcctgttagaatgtaaacttggggacagcaggtctttgccatattcttggcatctggaacggtaagtggcctgaggtaggtgtgggcaggtaggagtatgcgtggattgaagaaggatgaggcaggccctcaatcccagtctctcccacaccccaccttcagtttggtgaggtgacagaagggaggaaaatatgagaagatctgagccaaaatgaaaatcagacaaaaactcagggcatgttctgggggtccttgtgtccctacatcgtcttaaagaaccagcctgggacagtggggactggagctggtgacacacaaggacccaagaatatggaaggcctttctctggcataattgaaataaactttaatgaacaatttgtcctgttttaaatatctttatagataatatctggagctggacaaatcatgtataatctacttcctttatcattcttatttcaattatatccatctacaatgtctcagccaaagggaacaccatttacctggtagcagccacctgaattttaggcattgatatctaagagaaaataagttgctcaatggttgctcctttgtaacgccaaacctaggacttgactatatggttctgatacagtccaacaatgtgctagttgataacagcttgtagatggatatatatgtattctgcatattttgtttggtgaataacccacagcattctaactcaggtgtccagtactgcttatcaaataaggctttaacatagaaatacataaattctagaaattgtcttgcatttattgtattagaaagtgaaattggtttctttaaatctttgtaagggctattaacataatatcttgttccaaatcaaatagagctacttactactaaagacttttgtactttcttcaataattaaagcaagcaagatttgtagacaatgcaattttcatgatgcattgaaaaatgtattcttacagcagctgtgtttatcacacactttcattttcttaatatcttaaaattgcttggcaaaatgaaagggaaggagggtggtcagggatgtttccaacattctattaggatcattttcacacaaacagaaaatctgaagtaattgttcagtgggtcccctgcacccatcacgtacattttacaattaatgttttcctctgtttgcttcatcactggctatccatgtattcatccctctcttcatcttatttttggtgtattttaaattaaattgcagaaatcagtacacttcaccactaaacagttcagcatgcttattattaactcgagttaaatatttaatatatatttcaggtaaaatgtgcgcacagcaacataagcacattttaagctttccattcattgagttttgacaaatgcatacacctgtgtaatgccaatcccaagccaaggtacagacattctttttttttctccaatttaaaactttaattaaaaagtaaactttaatgtcgaaaatgcaaacttggggaaggcagaaagatcacacacaaggctgtcacttcacacttggaaggttgcacagcggccgggcagaggcgctcctcacatcccagacggtggaggggccgggcagaggccctcatcacttcccacacggtgagggggccgggcagaggtgctcctcacttcccagacagggctgcggccagagagaggcactcctcacttcccagatggcagggggcgctgagcagaggtgctcctaacttcccacacgcggtggcagctgcgcagaggcgcttctcacctcccagatgggcggcggccgggcaaaggtgctcctgcttcccagacggggcggcggcattcttaccacccagaatggtgatgctagtgcctctttccagtcgatttccaccctacgtgcacgcagagggaacccatgttctgatttttttctcagcatggattactttagtctttcctagaactgtatacagttctagaatcatatagtatgtactatttgggataagtacatgcaatacatactactttgcatgagactttttcacgcagcacatttttgaaattcatctatttttgtttgcatatgtcagtaatctgtacccattttagtgctgaatcatattccattgtgtgaatatgccacaatttttaaatctatttacttatcgatggtcacctgcgctgtttccagtttgcagctattatgaagaaaattgctgtgcatgttcttatgcaagtctttttgtaggcataagctttctgattacttttgaaactcctggaatatgtagtcttagcacagagtctacacacagtaggtactcaatgaatgtatatattgccctggcacaaaacccacatgacatgttgggttttacagtacaccagacgttttcttcctcatctgttctcagatgagcttcgtaactacctgctgaagaggcagaggcaatccacacaatggaagctgagacattacataatcgctaattgttggagctaaactagaaccctggtttcctaactcctagtcctgtactctctgactgcttgctattgagacgggagagttcccttgacccctttgcaggacttgtgaaaggggtgtggcccacttatttgactgccaccatgctcaaaccccctgcctgagagggagcatgcaggtgagcaggtacaggagctgggggaatgtggcaagaatgaaccccgtactggtactggtcaacggcagcatccagggttgtctgcgacctctggagccctcgagggcatgtgttacaacgctcatagcagttactatctgcagatagctaagtgttaaccagctcagtggcaagtcagggtgacaggcctttacaccctgccctctgggtacctggcttcctgtctggtgtccaggaagaatcaggtcacataggcttgaaggatggttcaaaatatggagattttattaagcagtgggagtggctctcagtggaaagggagctggaaaggggatggtgcgggaagaaggtgctctatctctgaagcttggccgtctctgaggaggctcttctccaaagttgttctctttgaagttaagccgcatctgtttatagtttcggacactcagttgcttctccttttcacgttcagctgcttgtctctctgccagctaaggtctgaggtttatgtgggcacaggagagggggagcgggtaggccaaaaaggtaacatttgggtgggaaaacagggataactcttctcatttagggctgtggtttccaggcttgagggtggggcctttgccaggaaactgccctcttctacccagtacttccctgtctcctgtctgtatcgctatgtcagtgccaaaccgaaggtatgtgtactttacatcctcccttccccccaagcattgctctgtgccacagttacggtctttgagagttttgggtttgtactttggctctatttaagctcctggtcatcagaacttatgtatattttccccttttatatcatcttgttttctcagtgtgtatatattgaggtgaggggaggggcagcagggagggcctgtagagggagttattgaaaagtgacctaagccaatctggtacttttgattggcaatcagagaagtcagccatgaggttcctgagtctctctttctctgccactcccagctgctctgggatcatgaaaaccagcctccaacctgattctgcaacacatgaaaacttttattaacaaggagattcatataccatgcctaaaacactcatacaacctgttctgtaaactcaagttgtcccccatccgtggtttaggcagcccggttgttaccagtggaaggtgtccgagttactggcagcaattccatatggatctgcagcaacttcaattcttgcctcctcagaagaaagaattcaatggaggggcataaagcagaaaaagagactgaagttaagtttcagagcaggagtgaaagtttatttaaaaaggctttagaacagtaaagaaaggaaaattcacttggaagagacccaagtgagcacctgaaggtcaagagccccgtttaacggtgatgctaggactttctaggattcccatgattcctcccttagggtgagctgcctgcatgcacagtgccctccttacctttgggaattgtgcacacacagtgtgtttaggaagttgtatgcatgcccatctgtggctttcttcccttttctggtggtgtgcccctggaagtcatactttgccattttgtctcttaatgcacctgcccaggaagttgcttctccctggagcctgcgtttgattaacactttaatgttaacagatgtgcctcatcaggagattgtctctccctggtgcccttggactggctgctgaattatcatttttagagaggcagtgtgataattgtcagaccatcacctgacattcctagtgggtgggggagaagagccttctcctgccccgctcatgcctgtctaactacctgtaacacagtgagcacctctcttgacaccagtaatctgatagcaggatcaggaagctgcttcttgaggacagagtctttccggaagcagtaggacagtggtgtgaaggaagttctgggcctcagccctcctctgaaagtgtttgctaggctggctaagcccagcacccttttcatggaaattttgaggtttctagccatccctcaaatctctcatagccttcatttgaccattgaaaataatttctaatatccctttatgctaattaatgaactatctgttgcagattcagatgggagagttagaagcttttatgaggccacctctgggaatataaacaccatttgggatctttcaaatgctcactaacaccactgtcttggtacttcctgcttagggtgcttcatatattaactagtaactgttgagggtgtcctaacatgaatctacacacacacacacgcttaaagctcactatggatggcggagtgtttcaacataaaacccaggtcacattggggaggtactagagtccatgtgtccttcccctaacccccaccctctaacggtggcatttccaccagactcttgagttttcagtttgagggaatcctttgaataaatatgattttctgcctccacacttaatgtggttagagctgcagccttgatcctaatctgtctgatctcccatcctcattgatagtaaaccagtgagtaggcaagtcaactgtgagttaatcggggtgggggggatttttaaatgcaagtctgatgtttaaatgtagctctgattatgcctcttggctatcagaagtgagtttcatttggatggagagccattttactgagggcacacagcacagaagctgagctgcagtgtaaagctttcaagtgactcttggagctattaaagtgccactcatttggtaactgttgctgttaattaagtttgtagccccattattaattcttggctctactattattaattatgcttctataaatttatagtaggcagtacctcagggaatttttcaagttgtatattaaaattagagataaataaacacttaagcttccttctcaatataagaagagtttggggtttttatttccggtactaggtaaatttgaaaggtatgtgatggtcattttctctccttactgaaacattttctacatggtttgcagcagaaatttctgtaacatatttaacaatgcggtttagtatttaaatatttaacccattcactgataacttgtagctaattcctacaattaaacttacgcctttggccaggcgcggtggctcacccctgtaatcccatcactttgggaggccgaggcaggtggatcacgaggtcaggagattgagaccatcttggccaacatggtgaaaccgtgtctctaccaaagattcaaaaattagctgggcatggtggcatgcacctgtaatcccagatactcgggagactgaggcaggagaattgcttgaaccagggagtcagaggctgcagtgagctgagatcatgccactgcattccagcctggtgacagagcgagactctgtctcaaaaaaaaaaaaaaaacaaaacttatgccttttatgagagcaagcagacagagaaggaaaagaaaaaaagcctggcattttgtgtataaaaaatcagagctcaagtaatgttggtcaaatatagatgcaaacaagtccatgtgcatattaacaacccctttcaccatgtgctttatttctgaaaatactttaaatccttttctgtcttctgatccagctctccagacaatagttaataaatgggttcataggtaattatgatgcattttggttcttttacctacagcaaattcctttttttctctctctcttattctaagaaggaacaaaaattgcccataattctccaggttatagaaaacgtctattggcattttgatgtagttcctttcagatgcttttccaagcatatatcaaataatttagatcacacaatgttatggtttgattttaccccttaacatttgatgtagcaattctttattattggacatttaagttgtttataatttttgtccttgcaaataatagatatatgatatgttggatagctctttaaataaatatttgagagtacctctaattatctattttaatgcctagaaatataaattttttgcctaaaggcatgaacattgttcaagttcttgatacatactgaaaaattgctttccaggaaatgacgccaatttccagtccactagaaacattccacggtgtctgtcttactgcggccatgccatttaatatagctaatacaattataataatattaacttgctaactttataatttttgaattcggaaacttgaatgagatatgctggaacatcaaatagtgacctattttatctcaacgcttcattttgctttttggagccaaaagagttctttctctctcaaattggattcagtagttgaggggctacacattaactgacagtagccatattaacaagagaaaagacaatatttatttacccatgcatgggagagctgctcagtaatgagtaacccaccgactagccagagataagggtttatataccaacttaacaaaggtgaagggggcaattagggattcagggggaaggcatgaaggtgctcttgggcttttcagtgataatgggaataggaaatatgtcttcatggcagctgaattaggaggaaactgcctttgaggggagttaatggcagctgtatttttgggaggctctgctatagtcagataagggaagttcagataagacttctttctgcatctcctgcagctcaaatgttttcaccttaaaataacctttataaagactctgagggtccaagtgcatccccatactttctatttattttaacatcacaaataaatgtgctcaataatagataaatttttcatcatgaaatgtattgaatattagtaataatggtgttttctgccgtttttgacaggtaaattaccagtaagggatgacacaggaggagaaaaggagaaaatgaagaactgtcataaggataatttttattacagatatgaatatatttgtttggaactaacaactatttttagaagacaaattaggcagaagtggtcactactgtatggacaagggtgaatagtagttgtgattttcaaaaattttttaaacatatctcttgatacagtatttttccaacttcatttcttttctttttttttttttttttttttttttttgagatggagtctcgctctgtcatccaggctggagtgcagtggtgcaatctcggctcactgtaacctctgcctcctgggttcaagcagttctcctgcctcagcttcctaagtagctgggattacaggcgcgcgccaccacacctggctttttgtgtgtgtgtttttaatagagtcagggtttcaccacgtgggtcaggctggtctcaaacttctgacctgacgatccacccgcctcggcctcccaaagtgctgggattataggcgtgagccactgcacccggccttccaacttcatttctttcaagtcacagtcatggaacatgtttacaacttctgagttacactattttggataaatagtcataaatatcagaaattgaaaattagattaattcctccttattttgatattcacctaggaaatagtttttctacagatattattctggcaaatctcagtttcttgaatctcagttccttgaatcttgacttttgtcgccacccttgatttgaacatcccttggcagctttgtggataatacagtgtgagagacataattgaaaagcatgacaagtgagaaaatgggttacatacctcaaaacaaaggctcattatacatgacaatgcaattcatttgggtctctccattgcatatttgctacaggtattgattgccttccaactcttcccacagccttttgctagtcttaaaggcataaatcacttggtgaaaggatatttctatttcagccagataaactctttcctttttgtttagatttaatatgaaggcaaaatgcactgctctcagtgaacagccttgtttcctttcgtttaatggggaagggaacactgaaacatttcctacattctctaggaaaagcaccttttttttttttcttgtctttataaccctgtatctgttgtcactgattcagctattcagtctgggacaaagcgacttttaagttctagagctatgaggaagctataaagggaatacagttcactctgtagagaaataacagcctgggagatcatggaccagaaatgttactctccaaaggtttgctagagctttactttgaattctattcatcaatatttttgttggcctggatcagtgactctaattatgtatagaagatagaaacagcagttatatttagcaagctggaaaagtccctgcagtctaccctcagaacagctaaacatacggagtcaacctgagattctgaatgctctgttcactccctgagagataatgatgactgaagagtgatagcgcagggaacagagtaaagctagaatgggaggcaaggaaagttatcagtcagacctctaggagaagtcccagcccctgccccatgcttttgttttttatttgtctaactttttttttttttttttggagattttccatttcaggcttttgttgcttttctcaaatgtcaaccctacctacctctctctgaacgaacagcccacactttctacttcatcaagaaaattgctaccacagggatgatatcatagcccattactgtatgatgctatctataccttagcctgggcttccaccatttctttgtctcccaaggagaagggacgtgactgcaccggatcttagtgtcatcttttctgcctcccattggggactgtgaagttattccaaggacagttgttccccctaccatagctgctagctccttccctcgtgccaggagccacttagtcacagggtaactgaagagaaaaaagaacgagacctattgctgagcctagagcaagctcccccatacctgcaccccacatgtgtaccaaaagcttgctttctctcccattcccaggtctttgatggggacgaagctaagaccatgtatgccattggccccaggcaataagaggtgcattgtctgcaaaagtcttaaaacaatattaaaatcaactaaaaattggtctttttttttttttgagacaagagtctcactctattgcctaggctggagtgcaatggcacgatctcagctcacagcagcctgcacctcctgggttcgagtgattctcctgcctcagccttctgagtagctgggattacaggcacccaccaccacaccccactaatttttgtatttttactagagatagggtatcaccatgttggccaggctagtcttgtttttattatcaccatgttccagcaattctaaacgatatcagcgttggggaggaaaaacatctcttctttctacctgtcttaagttcattggctggggcccctataacaaaagacagagtaacaagagaaaagcacacacgtttgttgaatgccagttttatgtggcatgggaatcttcacagggaaatgactttgctgagaccagctcagtgggggagaccctaacccagcggtactagaggaattaaagatatacacacagaaatatagaggtgtgaagtgggaaatcaggggtctcacagccttcagagctgagagccccaaacagagatttacccatgtatttatttacagcaatccagtcattagcattatttctatagatgttaaattaactgaaagtatcccttaagggaaaggaagggatgggccaaattaattgcagcaggatcacgcccttaagacacagattgctcatgcttttgtttgtggcttgagaatgcctttaagcagttttcctccctgggcgggccaggtgttccttgccctcattcctgtaaacccacaaccttccagcttgggcgttatccttccagcttgggcgttatggtcattatggacatgttacattgctgcagagattttatttatggccagttttggggccagtttatggccagagtttgggggggcttgctcccaacagacttgaagaagcagttaaactgggagtttttatgctagcttgagtgaagagtggagagtcatggagaaatgtgttaggacagaaaaagtatgagccgaggatagtcaactgggagaaacaacaaggtctgtatgttcacattcctcttgacatccctgtgtctttggagagaaagatgttattttcctccaggcatagggagggtacctttcacatgatctgcctcagggaaggatcagacaatctttgctatacatgctgttttccaaattccttcaacctaaaatattcagtattccaagtcaccatattttggggtagtatgtcttgaaccttatcatcagtgatgtaatattcctccccagaaaatccttttgttggtaagttacaaacaattgctataacgattgttgacccactggcttcctacaggcaacccagctatactcagctgagtgtcaattcataagggttggaatcatttgagtttgctgcctgcacagtttgtgtctctaagccctgtgatactacctagtcctacgtttaaaaagtaggttcaaaataaacaatggtaatacaacaattctaagggtaaagtgacagagcttgccttattgcacttttgtgtgcagatctttctctaaccttgtagcatttattcctttggacgtgtttcttttatgctctccttctcccttaaaataaatacttaaatgtaattaaaaattattaatccattactttgtttccttttttgtactgtgatagttttctaactgacttgaatgtacatacaaaatttaataaaagactatgttttatgtttgccattattttttggcttttattactattattttaagaatattattgaaggcttggcgcagtggctcatgcctgtaatcccagcactttgagaggccgaggtgggcagaccacccgaggtcaggagttcaaggtcggcctggccaacctggcaaaaccccatctctactaaaaatacaaaacttagctgggcatggtggcgtctgtagtcccagctacttgggaggctgagacaagagaatcgcttgaacctgagaggtggagcttgcagtgagctgagatcatgccactgcactccagcctaggtgacagagcaagactccatctcaaaaaaaaaaaaaaaaaattattgaagacaattttgttgtgtagaggaggagggtcttaaatgatcctctctggctgtcagatatgctggggactccctgtgttcctgcacacctgcccaggctctctcctctccttcctccctcattcctgcacctagaatgttttcaaaagttattctaaaagcctaaaataacttccgtgaagacttgctgtgataattccagctctttctttcttctctgaattcttctaacacattgtagttttccatacaatgtagcaagtgatggtatgccagcttagactttttctaatactttttttcccaagatagaatgtaagctccctgaaagttggggttagccttatatttcttcttttgtgtctccccaaagacaacttttggaagtatcccattaaaatgtatactctgtagaaaccagctcaaatccttcaaaaacagctcttctactcctgcaaacttcattatcctctcataactttatgtgatcatttaaaatcaggtttttctaaaacttcggtctgagtgaccaaatgcaattgcttatcttcaaggaaatagtgcttgctttaggcattcactccagaggcacacaaggagagataggtgaaatcaacatgagcagttaatttctggtttcacccgtaaaatactgatttctgtggtttgaatgtgtccctcgaagttcatgtgttgaaaatgtaattccaatgcaatagcattgggaggtgggatcttcaaagagtaatttggtcaagagggctctgtcctcataaatggattaatgccattatcttgggagtgggttagttatcgagagagtgggttgctaatgaaaaggatgagtttgttccattttcctgttgctctcttgtggactgtcttattcttctgcctttcactgtgggataacacaacataaagaccctcaccagatgccagcccctcaaccttggacttcccagcctccagaactataagaaataaatctctgttcttaattatccagtctgtgttattctgttatagcaacacaaaacagactaagacagtgactctacaaccctaaagaggtagtcactgaagaactattaagcattctctcagttgtgtcagtgaaagccatctctatttgtgttccctatcttaagccaacagttctcaaaatatgatccagggactcccaggagtcctagagacctttccaggggttctgtaaggtcaaattatttttataacatgacccagacattatttgcctttttctctctcctaagtgtgtcaaggcattttccagatactatatgacatgtactatcattatagatttagcgtggaagcagatatgagaagccagctgtggtccattaagccagagggtaaagagatttgccaagaatgtaaaaagaatgtcttctcatggagttttttgtttgggaaaatagagtaataattcataaaaatttcctatttatgttaacatatgagtttattgctaattttaaatcaattcataaacacatattttttaatttttcagttttaattttgtatacagcaaataacactctatgtaacccacatatacaaaaggtccttgaggccctcaataagagtgtaaagaccaaaaagtttgagaacttctatcttaggccaaagcagagatttttagaaacatattcttttaattctttctttggttacttacctccaaatcaaagcaatgtgctgcaactgaatccagtggaaaaattaattagctctatgttaattctttggctttgctgtgaaaagcctgatctttgggccattgacatctgttagaaatttaaactcttgagccctgacccagacctactgaatcagattctgcattttagtaagatcactaggtaattttaacctacaggttgagagttatgagcactgctccactttgcctttgtgaatctggctgggatctttttccaactttattgaccatgttaattaactccctcttttttgattctctcctaataaggcttgcagctataactgcagtttatcctgataaaacttatttctgtagggggaaaaaaataatcttctccttcactcttcaagaatttttagctgggactccctgtaacaaaaggtagattaacaagggaaagcaaacaaaagcttaataacatgtatacttcctgtacacatgggagataatgcagaaaaatgagtaaacctctagagtagatctaaaaaagttgtcttagtcttcaggcttaaataccatcctttgctaagacaaaagaaagttatagggaaaggcctggttaagaagaggtggccaggaaaagcatcataaacaaaaccaaggtttgttatgcagatttaagtaatgccttctgcattgataagagtctctagtgatttagacattttcctcttcctggtgcagagagggagacattcctaccaatagggatgtcctgtatagatgtaaatttatgttacaaaagggtaacttttcagtgcttcttctgtatgtgcagtttctcaaaataaccagttcaaaataatcccatgccaaagaggcctatttggatgggcatattctggtttcctacaatcatatgttgggatgacatgtcctgaattccatcacttcctaatgaaatctgataaaggactgacttgtctgacatttattttcatcctacaatgtgaatgcaatgaaggatcaatttgcaattgtattttttatggccttttggatttatgcactagagaggtgctaaagctgatgtgttgattcaagtgaggagtaagaggggtgagaaactgtgagaaaaaaaagtactataaagacacatgcacacgtatgtttattgcggcattattcacaatagcaaagacttggaaccaacccaaatgtccaacaatgatagactggattaagaaaatgtggcacatatacaccatggaatactatacagccataaaaaaggatgagttcatgtcctttgtagggacatggatgaaattggaaaacatcattctcagtaagctgtcgcaagaacaaaaaaccaaacaccgcatattctcactcataggtgggaattgaacagtgagatcacatggacacaggaaggggaatatcacactccggggactgttgcggggtggggggaggggggagggatagcactgggagatatacctaatgctagatgatgagttagtgggtgcagtgcaccagcatgacacatgtatacatatgtaactaacctgcacaatgtgcacatgtaccctaaaacttaaactataataaaaaaaaaaagtaactgtgttttcttctgtttaatgattgttgcactctcctacaaattctctttaaggaaattttcctagaagccttcttccttgaatttgtaagaaagtggcttttcagtgggttgacctcttggcttttacatgtaaatacaccgaaaaaaaaaaaaaaccccaagggatgtaaaaacattgagaagtttctcaaaaaaagaaaaaagaagtccatttagtctggtataactatgaagtaaaataaatcatagtatctgagaaagaaggggaaaatattcaattgtcaaaattagcctgtctcatttatttggccttggagaataatagtcattgatatagaccagtgggtttcaatcttgaataaacagaggatcacctataaactcaagaaaaagcccatgtctgagagattgaattggaatttggtaggtacttatctttaaaattttgacaaggtgattatgaaacacaatgagaattaagaatgtatggtatggtcaaatacgtgagcagatggaacacaaagtccctagtctttaagtgtgtggattcaatcatttattcatttttctttatccagggttagatcctgtaggggcaaagataatttccccctccccctctgaaggttcaagtctgctgaaatgaactgatgagagagattaacagggcaaaggcatacaagtttattaatgtgcataagcatggaagccatacaaaaaaatgaggctcacagaaaggccagatagctgaagcttaaaaagcactctctttgtagaggagccagagatggtggatgcatgaaattgagggttagtagtaaatgctttttaagagagcttaatggacccaaagaggaaacaatagtttataaatgattctctttggaagttgaatttatgggacggtaaggggcagaactgcaaagcaaacgaaggttgtctttttatgcagataaagtttcttgggtaatttcctgaagcggtcctcagaagggtagatgaaaagtttgtctgggtatggtcagaattttgctttcttctcttctccagtggttaatctttcttgttaatttaatgaaattcctagggagggggtttaagactattacaattcttttagaaaaagttttcttaatcagatagggaaattccagagagaggtcctccctgcacttagaagcaaggaaaacagaaagttagcaagtccttggttcagaggcactttctgaggtattccaatttctttcaattcaaaagtggtcagcatgccaaagcactttactttggaatatcatttttctgagccacaacaggcctgtccagagatttgaattaagcaaattaacacaggaacagaacaacagatgccacatcttcttatgagtgagagctaaatgttgaaaatatgtggacataaagatgggaacaatcgacaccagggactactagaggggaggatggaaaggggagcaagtgttgaaaaactacccattgggtactatgctcactacctgggcaataggattgttcattcccccaaaccttagcttcacacaatatacccatgtaacagatctgcacatgaaccccttgaacctaaaataaaagttgaaaagaaaagaaaaatgaataaatcctgtttaacacaagaattttatggccttatacattttctaatgactattagccaagtgggaaacttgttgaaggtgtagagaactaagttcaattcctcatttattccctagatgagctatgccattggagtgaagactctgaactaaattaaaaagaatgtgttagactagtttttgtaccatagataagatggatgcacttgtgctttttaggtacaggaattcagacctgtggaagatccctggagggttaaggaatgcaaatctgcattatctgtaagccaaacatgtaatatgattcactcatgcgtatgcccgccattctttgtcaaatgtatgtgtgggctttattgacagaaaaggttttcaaaaaatcatttagaagcaccactgaacaatgattctttttatcagttagtttagaaattattaatgaccatcaactatgtatcaattacatgtaccctgggatacagtagtgaatctgacagccctaaatcagggagacatacagattaacagatgattaccatctagtgaatttagtgctgatcccattatatctatctgcagtataaatttaggtgtctgtaatcctagaaatactgctttaaagccagcatgtctgctcccatctccctgttagcctgtacaaatctgctcaagtgttaattagtaatcccaggagagaagtgctgtcattcacaattttctcaaaattacctctagaaatagtaaacagtggctcgtaactgatgaatgtgatggttttagccaaaacatattctcaatctatgtctactcaaagtagggcaatagtcatgatggggggaggggtgatagtaaaaatgcattaacatgaaaatgttgaaaacaatgatgcagtccaattatctctttatagaggaggactctataaaatgttaagagagatacaatgacatgttctagattcatggtctattaactcttgatcctaggtttctcaaagggctgaactgactcaaatatactggggactccctctgctcctcacacctgcccaggagggttacttctcaaggtcttgtgccagccattagtgttgtccactcaaactgctcaggaagcgtggtaagcacggtcagttgtgtcagcatttgcacaaagtcagtgacttacggtgcttccttgtggaggagttctctatccaatggtgccaggcttggccatgtgacttgctttggtcaataaaatgtgagcagatgtgatatgactatccacatccgtgcttaggctgtaagagccatcatgtgactcagccatgctcttctctctgccatgagaatggcatattaccataggaaatagtccttcagcctgtggagatagggcaaaacagagccacggcccacctgccactggcatgtaaggtgagtaggaaataaagctttctttgtagtgtacacccctgtgattggaaggttatttgttactgctgcataacttagtgaaagacaacttatatagtaggccagagacctgccaactttttcttaaagaccagatagtaaatattttaggcttgtgggccatttacagtctgtcatagctactcaattctatggcaaaagcagctattgacaatatataaacaaataggtatggctatgtgccaataaaactttatttacaaacacaggtctttggcttgtgggctgtagtttgcccacccctgccataggattttgcttcctcacctccttgaagttggatgtggccagtgaagttgggtgtggcacttgctttgcctagtggaatgcaagctatttaaagaagtggtgtaagtggtggctactctgtcagtctgagtcttgagagataccattagagagctgagcatcggccaacctatgctggacattcagcataactaagaaataaaccttattgtttaaaaccactaagatgtatggggtgtttgttactgcagcatatataactgcgcctatctgtactgatacaggtctatctggcattacgtttcggggcaccacctctgctcactgccatcccagggcacctcacgtggcattctttgttactgacttctttataatgtttgcgttgtagaccacgatgacagaatttacttaacgatgatgttttgattatcatgcaagtgtgggggaggattgttctgttgaaacagcgtgactgcaaatattttaccaatagatcagtgaaattcacgtgcccttgaacattttcaaaggtatgaaatcacctgaaataattttttagttcattttttagtggctaaaatctgttaatagtttgattcacaagcctggcctttgaaaaagtaaaaattggataatgctgcacaagccatgttctccctggtgtgtaagggttaattattggactcttgcttgatgatgacagtgcaggttcattgaagtcatcactttatatcaccagcctgtctgcagcactgttggggccacgcctcttgtgcgatggttggctcagacctgtagcttcctttgccttatcccctttcacattgaagcctcatctgctgcttgacagtgcatgcctgagagttgcttttccacagtccctgttcttctcctaggtctggttaattgcttctctgttaaacagagaacatgttgaacagcagccttaaattattgtccaattttagcctactgggaacccctctgcagctactctgatcaccactgatatttctagaaagttcctattcacaggggactcttttctcccttctttatgctcaagggagaataaatcacagaagcagcaatccctccatgtgtcaaactatcaatcctacatggagctacaaaacaaaaggcagtatccctttgttgccagagaacatccagtccctgtacaagtctgtgcctcaggggctcaggctcattagcaccatagcagtggctcatgctttccatacacttttctctaccaacacctacagttagtctcagagttgttctttatcatgataggttacagagcagtgttttaaccatattaccttgactgaggtatggtgaggccagatgtggatcaagagaaagaaacagggatggattttatggttttgaggctcacagttccctggggagacacagcaggctgtgctgggccactcagcggaagcacagagtgaggcatgaggcagagggagatgggggatggtagggaagcagctttattgtcgtctccagggaaaggaaaaggaaaggcagggtatgcaggtttaggattggctaatttgaaaatgttcttggggctctggggcatagaggctgtccccggttgtctcatacctggccccagggtgatgaggtaggtccacggtggcctagggtgcaagagccacttaagggaagtggtgggagtttaaactacttggttgactcctcaagaaggggaactgactggcctctagctagggcctcaaaacagggtgaagacagtatagaataaaaaatatattacaactaggacagataccaacatactgggggtttgtacctaccacagttattccttacatttatgtttcattttgtctagtaatagtgaagtgaatggagttctagactgaagtctctgtttaggcagactctgaatttgttttctcattggttcccagagatggactgagatacctcagtcctgtggatacctcaggcaggcttaaaatgtggcacaaattctctttaactattcagttgatactttttcgtgagggcttcaaagaggctgattttctattgctaaaaattgcatacctctctatgttcaaagaaaataccatttactttatatatgaaagagcatttgcttatttggaaaacttttatttgcatttcacattttttatcacttcttactaaatagaagtttctcacattctctagggattgaactaagtgataacttagaaagaaagtattgttcaaatacccattttttggcttttatgttagtaaaatgtttcccctttttctagcttttctttgtgatttcagaaacgtgcaacttctttgaacgcatattaaatgtttttaaatttaaataatgaaccacttgcttttgttacagcccagtggttcttcttgcctgctgcacagacagagccaaggcactgagacagtagtgttgcagcgagaaagatttaattattgctaggcagtcaagtgacagaatgagaggcatttctcaaatccactgccccaagagctcagaggctagggtttttaaggataatatggcatgcagggggctagggaataggtgctgctgattggttaaagatgaaatcattgaggtcttcatgcactgagtcagtttctgggtaggagtcacaggaccagttgagtcagttccctggtgtgagtcatgggtccaggtagagtcagtcagtagccagaatgcaaaagtctgaaaaatatctcaaagaccaatcttaggttttacaatagtgatgttatctataggagcaatttgggggcattaccaatcatgtgacctctggctagatggctcctgagcagtaagaaattatagaaaagcaagctaggggacaatggttggttatcatttagttactcctacattttagcagaattcaggcccctcccataattctaaccttgtcgcttttcattagttttacaagggtggttttcagtccctaaacaaggagggggttagttttgggaaagggctattatcatccttgctttaaaattaaactgtaaactaaattcctcccatagttaggttggcctatatccagaagagttagcttgggaggttagaagcagaatggagtgagctattttgctgactagctttctgtcattgtcataatttttagaaaggtggtctcactcttagtaaacagtagtatgctatgctttactcagttgtataatttcatttgaattcaacaaataactacagacagctgtcaacttagtgatgttgagattggggctaggcctgcagtaatcctctgaaatatgtatgtgcaccccaaaaacatgtcattgagatgggtagacacctgcaagaggagtgcttttaaaacgtttttacatgaagatgctttctacttcagtgagacttttgccagtggtgttagaagttgctgtgaaaaccaagataaggagccactgtgtttttgatttgttctagggatttaatatccctcatagttaatcactcaggcaattactgggttaacaatatgtcctgaagaagagtagtttttgagccatgttctttgaatcactaagattcttcaaaactgctttagagtttcccatgaacatttggatcacattaaagcaggctcattatttccatcttcatgtccatgtaaatgaggttgagttcttcacttggttctcagctttagtgttgttagtatatagaaatgcacctgattttttatgttaattttgtatcctgaagcttcattgcagtcgtttatcaggtctaggagtcttttgcaggaatcttttgggtttctctaagtataagagcatgtcactggggaccccaaaagtgaggaaggtgggagagaagtgagggttaaaaaattctctattgggtacaatgttcactatttatgtgatgtgttcactagaagcccaaaccttaccattatgcaatatacccatgtaacaaacctgtacacatactttctgaatctaatataaaataacaaagaaaaaaataacaaaaagtaggctcgttagtaagacaatagctgaggagccctgaggattggtcaccttctagcagagagaggaagggccaagctgatttacaacagtcctgatcaaagaagggtgacctgtccagggcaagtccacaagcctccccctctgtgtcatgaggccacagagcactggagttccatgaagtcaatggaaaagaagagttctactgcttaaacaagtttaaaaaccactgctctagcattgtttataagaaaagaaactaagaataaaaacaatactgaattcaaacagctaattccttaagacctgggaacattgtgtgttcttatgcagttataatttaatccaaatacattggaaccacaccataattcaattctaggtcaagagcagagttttgtatacagcagattcattttggagcactctctggggatttggttacagaaaaatccagaggatttatctgggctgtcttactcataaaactgcacaatggcctagattttagagatgacattacagtgaggtctcctccaggacatgctatggtatacaccactatacaccacttaatctttagagggctcatttgaatcacattatttatgtagtgtgtccacatgttagatttggccagattctcaaactggggtgtcagttccacgtctagcccattaatttgttgccattgtgaagacagtagacttgaatgccttcagaaggagcatgctgtactgcacaagtgcgaggggcctcattcctaaagtgatcacactgtgttttagggaattgtgcccctttacaatgctgtgactttgggtgacactctctagcttctatagtacccaagtctgggttgcgtctgaatttgaaatctctactatgagactgtattgtttgtttttaaagtcgatggagcacttgacttggagccagaagagaaagcttgggtcttcacgcttcttgattaattatcaagccagttaattttctagagcctctgtttattcatttgtcaaatgggacaaataatgtctgtttcacagggcttgttgtgaagattatactctgttgtgttatagaggtttaaagtggacctgtgggtttgtatgaaatacagcaaggtaacataaattaaaagtagatgagggataaaagcggggaaagggtctaaaatggggttaacaagttgtaccttttgtgcagatctatatgcttgctaggaatgagccacaaatttgcttctgtgccctctagcagccaaggagaaaatggaaaccttattttctttaatcatggtgtctacgagattgggaacacagtagggagtcatgaaaaatattccttttcctagtaacttaacagagagagaccaccctcaggggtctgcaaaagaggacattgcatggtacagcctatagtgtctgctacacagagaggttgcaaactggcagtccaccagtgtcaccatttgttgggatttttgttttgttttgtttaggcttgatgtctaaaaagtttgatccaacatttaaaagaatcagattttgcaaaaataacatttttaagttttctttcaaaatcagatgatcagttaatattgtaactatatatcaaaattaattggcactgtgtagcagcttttttttaatgtagcaatgatttcaggtttgccacagtctccaccattccctactgccttacttactacattttatttcctacttggcatttaggcatctgatttagtgactcctattctacagcatccttgtagtaggctcagcagtacgcttcataaggctgagaatccctgagaggattgattgatatgggaaaatgctggtactctgtacaatattgttctacaataaaaatgtagaattagaatattgaagttactgttagaactttgaaatcatgactgagggtttaaaaatgcttaatgagggccgggcgcggtggctcacgcctgtaatcccagcactttgggaggctgaggcgggtggatcacgaggtcaggagatcgacaccatcctggctaacatggtgaaacctcgtctctactaaaaatacaaaaaaaaaattagccaggcgcggtggcaggcgcctgtagtcccagctactcaggaggctgaggccggagaatggcgtgaacccgggaggcggagcttgcagtgagccgagatcgcgccactgcactccagcctgggtgacagagtgagactccgtctcaaaaaaaaaaaaaaaaaaaaagcttaatgaacgagagtctcaaatagctaattaaaacaacctcaacttccaaactaatctcctagcaagtagtttacccagagtatccattccaattgctctttaatcaaataaaaatttcagaatattttatttaaatatttacatagctatatattttcatcagaaaagagtatcacaggaaagacatgttttaagtatgcttttaactgtataaagtttgattgttaggctctatgatctggtgacaatagtcgttactgttagaggtgaatccttgtaaagttgttatttttgtcaaggtccactttggcttctagacttgttgagtttggtaagatgttttgagcgctgagttgctaattttccagaaatgtaatttgcaatgaagatgttggatggggctttcccaattatcagaaggaattctccaaagttgaaaatgagtgataattatctaatattctaaaacatgctgctagacatggatatagagtgtttaataaaagatgtcaaagttgtgttgtggccaccagccaccatcacagctctagccaacattagagatgactggtgatctaggaggagattgtggagggttatctcagtgaagagcctcataaagagtattggggaattttccctcccattgccgtggagagaagagatgagtgctcttaccctttccccaagccaagagagaagagctctgatctagagataggggttatggcaaccatgggagattggcatctcacttcccacttggatgcctgcggagctctctccaggcccatcagaatggagcacagcgatgattttagggatctgtgagcatatatacagatgcttccaacatacagtatttgatagatgcaaagttgctagagcagcctgtgaaagtgaggcaaagaaaaagatgttcagtggttgacaagctcaacttccaccatttggcagagaaagatgtgtacattttcgtggggccaagcaacatcaggaaaggtagagagtttgagcaattgttgctggttccttgtccagaggtggccttttgggttgaggcaacccagactgtgagaaccctgacatgtatgttgaagtagaagatgtgtgttttgggggaggggctcacaaaaggctggtcaaatggttcttccaccatgctagggaacttggaatagagggtccatgtgggcctctgaagaacctacaaatgcaccctgtgaaggtcccaggatgtgactgcctgccttgcacagctgactttggtagccaagagaattgaaaacagcacgacctgatgtaagaagatgttccgtttcctcaccactgatgtcacttccctgtgttaacctgagaagagctacggcacagagtgatggaggagagaatgaaagcagaggaggagggtaaaaggaaaggctacagtcccttccccactacaggtcatacaaaaggaggagggaaaagctttgagttggatatgagattgaagttttgatacgaaattactatacttttagtaagtgagtgagtcttagtttccataaataaggctattataagtgaaagtgatggaaaaatgatggggtcttcctgagctgtccagctgcagggaatggagatccactggaacaagtcaaagataataataatgagaaaaaaaaagattcttaaatccccaccattcaatgaaccagttaccaaacccacacgatacagagacattgagattccaatatgaatctctccacagaaggaggcaccttctcttgccatcttctgtgtattataaccatttttgggggggtttggtgcttcttgttcaaaattgaagtcttgtagccaaaagtcaaaatcatattcttctaaaattcacttgaaaaatatttccttttacagttgaattaaagcaaattacttggttaattaatgtcaaaggtgactctgttctagagataatttctgagtcatgatacctaatatttaaaaattatgttttgatttttatctttagtcatggtgatttcaaatgaggttattaaatcactgtaattcatgatttatataaaatatgaagacattaacctacaacatcttggattgctttttttttttaattgcattagtcactagtaccttctaacagttccagtttttggaaggcagcctctagtttcctattcagcctcatcatagctgttccttttggagagcggtggagaatacaggattgaaggtgaccctcacagcatgacaaattgtcaatctggctccctcagaaaccttatagggagtgtattagtcagctttggctgtcgtaagcaagtaccacagactgggtggcttaaacagcagaagtttattttctcacagttctggaggctggaaagtccaagatcaaggtggaggcctctcttcctggtttgcagaatcccaccttctcactgtgtcctcacgtggcctcttttctgtgcacttaagggagggagagagacagctgtctggcgtctcttcctcttcttctaaagacaccaatgctacctattagggcccatctcttatgaccatagttaacttccctaaagggcctatctctacatatattcacattggggattaaggtttcaacatataaatttgggggcctggggagaacacagttcagtccataacagagaggaagaaagagattcttaaaaagtgttctcttctgcaagttgacatttctgaaaaatatgtttattctccaaatttaagagacttttagaaccaattacctgtgaaattttcttttccaaatgaccgaaactcaactcaaactagctgaagcaaaagtggatattttttggctcacatagcagatggccaagggtcagatatgtcagccacagctggatccagggtcgatgtcatcaggtctttgtcctccccttgagctctgtgtccccccatgttggcccctcctcaggagggtccttttcctgtggtggcattgattacctggggcagctccaggctgatctggcccttagaatttgcagctttaaatggagagaaactgtctcccaagagtcaactctgactgcccccgcctgggttagggatacatattagcagcctggacccagggcctatctgggtggttatgggctggcattcccaacagctgggagaggaccaaatgaaagattccaggcagatcaaactgtaaggcatgtccacagtcttccccttctaagtttctgagctaaaacaacttatttgtcctttgtgacttgtataattgtataattgatagtccagagaaggtccaaattagttcatctttatatgtgtaagagattctatctaaaggtcatcagaacctttttgaaagtcaactgatgtcatgttggcctttgctggtgtttctctgcagactctccggacgacccagccttgtcaccacctggagatttggctccagcctggctaaccacaggctgttgacatgatggctgtggtctctctgcactcctcctccaacctcccccttctctatcctcttatgcatacctattgttgtggtctaaatgtatgtgtcccccccaaattcatatgttaaagtcctagcccccaaagtactagtattagaaagtaggtcttttgggagctgattaggtcatggaggcagggccctcatgattgggattagtgcccttatcaaagaggcttgagagaggtctctcacccctttcaccatgtgaggacacagaagacaccatccatctgtgaaccaagaagtgagccctcaccagacaccaaatctgccagcatcttgatcttggacttcccagtctccagaactgtgagaaacgaatgtctgttgtttatcagccacccagttggtggtattttgttatagcagcccaaatggactaatacacctaatgtcacccatctcatgtgaatgtaggtgctcatctcttgcctgaaattcttggggtcaagtgtgttctggaactcagtttctaatttcagaaaggccatatcgtatacacactgtttactgacacccttagcagagtctgggacagcacccagaaatccatctcattaacatttctgcagagaaacacgtgaacattcatactacgtaggataaagaaaatcaatagtagccttatatcagttcaggtcaggttttgtcaccaaacacattacgagaaaggtttgttctcagggcttttcgtaatttcagaattgtaaacaagggatcccgaatttatattttcttgtatgcattaagtgctacctttgttggactctcagcagctaggactggtctccataaaatttaaaacttaagaaacattttaacttaaagcactttaagcagcactttccaaagtttaaagtatgtaagtaaatctgtgtgagtagataactataaagaacaaactttcagccaatatcttcactttgagtggttactggggggcaaagaattagaaagccactatgtataaaattaaacatttttatttgttcatttctttaaagtacaacttattttccgggagaggaaagtactctcaccaaagaagatttttacagagagaaatcaggtcaacttgaaacttgtttgcaactctctatttgtaacaacctttgtggggttttcataaaaggattttccaagtcttttgtcttcaagaacataaattagaggacactcttaccaggagtacatgcagtttaagtacccaaaaataagtttgtttaccacttagaatcatggagttcaagagaattttcaagtttgcaatcctgggtctctcccagggacattgagagggcagaatcgattctagttttgctaatgcgcctgccaactggtgtcaccatttcccatcacgatatctcagttatcccatctgtcagctctaagagtctttgatgtatttcaacataccatgctttcaggaacctctcggtaccacgttctggtgcttggcagctgtccaggatgaatttgatgtacctctccctgatgcctgccaggagggagttggaggaggggcttaaaggattttctggtaaatccaaatgatcacatatgagctgttatcaatgtgggagaatggaattaggggatagtcttctcattagaattgtgaaaattcaggatggtggaaatactcagtatgaagattttcaggttggctaagtgtatgtgaaatgtcctaatttgaaaaacactttggatttgattgaattagtggtgttaaattagtggggtgtggtgggcatggtgacacggtgctgggcatccttgcatacatgacggatcagaaaaccagcaatccaggcaactctgtggccaatgcggcattttgggtccaagccccttgaccctgtgtctctctccttgcttcatgggaaatcctgccacctggctcagacacaggcctgggggttaaatggagcatgtgctgccaggtactggtcagtgccctcaagggtggagaagacctcttgggaaccacagacaggctgtagggttgtcgtgtttgtctgtttttaagtgacaggctgcttgatctcatcccattagtagtgacgttgctagaggtagagcttgcaaccacccccttcccattaactctaccatcaccacctgccgctaactactgacggctacccaatggccacaaggcacataatattcacggagagccaaagtggcttgcctgtgtcattacagtagctctccttgttaagagtctcttaaccatttccctccttcccacaccccactcttcacacatacatgtacatccctacctgagctagagccctgcttccatccactttcctggccttccccaagctgcctgtgcaaagcctcccttttctgctccctcagcctccggtttcttcctttttctatacctttccccaacaatttcagcctttattaaccttttccttctctaactatcagtcctatcgcttttttgggggggggggcgggaggcaggtgggaggtgtacagctcctcatacttgctgttctgtttatgtatgctctatagcaaactatccccaaatctaacggcttaacacagtaaactgtttccctatcatcactcatgattttgtggatcgggaattccagccggactcagctgggaaattcttttgctcctcgctgtattgaagggggtcgctggatactttcactgggcagatgggtgaactggaggtgattaagatggcttcacatgcctggcgccttggtgggatggctggaaggcatgttcagctgggtgtgtccactggggcttccacacatggtggtctcaaagtagtcagacctctttcaggtagctggcttccacaagagtgagcatttctagagaaaggaagtgtaagtggccaagcctcctaagcctgggcccaggatcctctctgctgtattcggtggttgcacagttatgccgtcctcccagtttttacctagcccccacctctctgtgtgttacaacaaagtctgccaccactattaatcttccacacgtgcctcctccattctcgaatgttcttgaagattatattgctttctccaaacctaaactgtctcataagtttttggcgcttaagacaagtttcaagaaataagaattgaaaagtgttggaggaaagaaagtttccatctctaaccactttctcagaagggcatcagggtttttgcagcaatgtggggatacctcttctgatctcatagcttagggctctgaactaaactgatggccttttctagatttcttcctaggggtgtcaggttggaagtgctgagggactgctctttctccccagggctcagctgtgtcaaggctaagaccaggagtggttcccacagccaggctgggtgagggcaagtttatcctgcggtgcagcacctcagaccagggtctagccaatggtggcctgcaggctgaccccagtccaccacctgtgagcagccaccaccacctgtgtttatactacccatgagctaagcacgattgtcatattttgtttgtttgtttgtttgtttgtgaggcagagtcttgctctgttgcccaggctggaatgcagtggtgcaatctcagctcactgcaacctctgcctcactagttcaaatgatttctggctaatttttgtatttttagtagagatggggtttcaccatgttggccaggctggtctcaaactcctgacctcaagtgatccgcctgcctcagtctcccaaagtgctatgattataggcatgagccactgcacccagccaatttttatatgtttagatgattgggaaatagattttaaaaagaataatatttcatgatacataaaaattataatgacatgcaaatttcagtgtccataaataaagtttctttggaacacagtcatgctcattcgtgtacatggtagctgtggctgctttcacactgtgagagctgggttgagtagttgtgacagcaattattagatgacctgcaaaaccaaaaatacttgctatcttgctctttacagacaagtaacttttttgctgttcttgccaaagaccaaatgcatttttcaaagctggattccaggctcagagttacagcaaagagaacagaaagtatagctcatgattgggtgctgacaggacaagggagagagacgaaaaccattaggagcattagcaacaaatatattttttgccattccaactccatggagcaaatggcttcctaaaagccagcagagaaactaattacctgaactgggagaagaatgaaagactcattgttagaatattcctcagagctgaatcccttctttcagcctactgtattttagtgattcctaataaaagaaaaaaatgtatttttgtcctcacagccaattaatttctgctccaaagcatagaatatgattatttctgtcattattttagtttccagagtcattgatgagacagggaatgacacatacctattaacacactcgcacactcactcacacactcgtgtgggtacatgcatttccctagaagatgtactggaaggatctgactttactttcaggtgccttcatgtcctcgcaattattctacaaatggtttttaagatatttctattgtatttgttgaaattttcctgacattttgacttgtctagacgattattcttgcatccagcacattgtaggaaacactcatttgaaataccccactgtgcttccgggggagctcatctttctggagcatggcgggtccctcatgaggccctctttcgttaaccgaagaacaagctgcagtctgaatgtgagttgttaaaggtatggtattgggagttttctgttctcctgttttcccattctgtaatgttttctttctttctttccttcatttcatttcatttcatttcacttcatagcaacttttgaatgaaaacctccccacagggtttgacaggcaatgaaacttcctcccttgggaggtgtctcagcctgagggaaatggaacagcaccccacagaggattttcctcacttcctccctctctcctttacaaatcaatgttaaagagcctgcatggatgtggttagcaccatctctgccgcatgtgacttttcagtcattttcacccgaaataggatttcattcaccagttactataagctactcgtgccttctaatggactttgcagcagtgattcatccaccctgtgctgggagagagaaagagactttaggtgagaaagaatggttgggagaggggagacaggtaggcagaacagttgtggtaccatcccgccccataagacaataatgatattcagtgttaggcgctttataccaagaaatattccacctgacacattatcctggttgaatcttatgacacatctgcaaatagacattaccaaatacagagggggacttttaggttcagagaggttaagtgacttgcccagtaacacactgctggcaattcgacctgatctctctctttcttccgccttttccatttcagtcagtggcagtgccatctttccacctgcttctgtcaaatgtgttggtgtgatttgatttcttttctgtttctcttgtatcttttaatccagcaataaatccctgctggctctacttgtaagatatacccagaatctattacctccgcccccccaccacccaccttgctccaagcctccatcatctctctcctggagcactgtgatacccttcttcttggtcatcctgcccctgccctgacttccctaaagttgatgcccaacacacaggcagataaaccagatcagacttgtgactgttttcccattctttgggcaatcccattgcattccagataaaagcggaagtccttagagtactgcagtttgcctcctagcccacgttatctctggccttcctttctcactttctccctccattccagccacgttggcttcctgctgtctcttgaatagtcagggcctttgcccatgctactccctctgcttgaagcactcttatcccaggagactgcatgattgagacccttacctccttcatgtctttactgaaatgtttttacagtgaaacctatcttaaatttttttttttttttttttttttttttgagacagagtctctctctggagtgcagtggcacagtctcggctcactgcaacctctgcctcccgggctcaagggattctcctgcctcagcctcccaaatagctgggactacaggcacccaccaccatgcctgattaacttttgcatttttagtagagttggggtttcaccatgctagccaggctggtcttgaactcctgacctctagtgatctgcccaccttggccttcccaaagtgctgggattacaggtgtgagccactgcacccagcctttgtatagctttaatgcatcaaatatgggcttagttcctcatgtaaacaattctcccaggaaattagaggataaaaagttaaaaatagcatatatgtcctgccctcaggaagtttacgttttgaaggggggatacaacaaaaagctagaatttgtagcagcgtacaacacatgccaataaaacttgcaactcaagccctgtgcacagagaaccatttggcagaaattctagagaggcttcctggaggaggtgctagtagaggagaccttgacaaatggggatggatctagatcaaattcccctatgccacgtgctcctctttgcgttcagaatgctcttgtttgcaagatttcagccatgtacaactcttctggcactcagccatggactaaaacgaggttcatgcccacagtattggtctgcagaaaagcatgagactggatgacagtcagaacaaatggaatcctctagggtagggagaagagaaagaaagaggaaataaaacagcataatcccaggaactgccaataggaaaggatgggagaaaggacaactggcaaagactctgatgtggtgtccagcctttcagatgtcacctgaggacgttgctacaattaacatgcagccagacacacacagtgactacacattttggtgtggttggcggcattagttgagtcttaaacaaaagcaatttcagttgcaaatcttgtgccaggctttcagagaaagagaataaattatgctgctgtgacaagctgttccactgtggcaacaatagtttggacttccagtgctgcctgtcaaccaggactgaaaatacatcttcatttgttgctgggcagctgggaagatgagtcattaaagaattttataatacatcaaaggccatgattttctacctttcacgcagttacaccttttcccaagtcctcattctgccacaaaaaacttttgaatgcaccgaaagttaagtagaattccttttaaaatgttctgttctgtgcacatatctctaggggaagtgcagaagacatggggcattcccttttgtcatgcatttcagctccataaagatttattgaccacctactatatgccaagcattatgttagtcagtggggttaaaaagatgagcaaattgtggtcttgaaacccatgccttttgttcagattattacagtgcaagagaagcagcatcagccatgtgtctgagaggccagaggaaggagagagtgaggaaatattgtacctcattaatattgttcctctcgtttcaccactgtattaatctgttctcatgctgccaataaagacatacccaagactgggtaatttataaaggaaagaggtttaatggactctcagttccacatggctggggaggcctcacaatcatggcagaagttgagagaaaagcaaagggacgtcttacatggtggcaggcaagagagcttgtgcaggggaactcccatttataaaaccatcagctctcatgagacttattcgctaccatgagaacagtatggggaaaaccacccccatgattaacttacctcccactgagtccctccacgacacatgggaattatgggagctacaattcaagatgagatttgggtgggcacacagccaaaccatatcaaccactgtagacatgaccaagttcagacttggtcagtagtcaaatgagcctgtgagagaatggtgccacatctttcctgtaagagcacagcattttaacctgcgatggatttgtgagcagtcattccaactctgtattagttttctacagttgctgtaacaaattaccacaagcttaatggcttaaaaccatgtaaatatattatcccacagttctgaagtcagaaatctgaaatagataggctaaaagcaaggggtgacaggctgcattcctttctggaggctctaggggagaatctgtttccttgccttttccaacttctagaggccgctggcattccttggctctttgccccttcccttcttcaaagccagcagcagtagttgagtcctccttaacacagcatcactttttttttttttttttgccttcttcttccacttttaaggactctgtgatggcactggggccactgggataatcgaggataatcttcctattttaagaacagccaattgacaaccttaattctaagcaatcttaattcccttttgccatgtagctgaacatatccaagttctggggattaggatgtggatgtattggggtggggaaattattcttcctaccaccaaccctcatccatctctaaaggcactgatttttttgataaatcagataagtaccagagatgtgtactctgggctcaggagtgaagagggttagctggcctttgccaacagtgacttcatatcaccatactcaatgcaattgaggtgacttaatcaaggggaaaagatggacagcatgttttatggaaatagcacttgcctggtaatcaggagacttggattttagcttctctccttcaaacagactactgagtgtcagtaggcaagttgttgaactgctctgggcctctgtaaaaaatcaaggttgtggttagatgttctcaaatcctctttcatcctctagccttccatggctctcaatttctacagggaatgtactggaaatggagagaggctagcctgtggaaaatgcagtgccattatttcagcatcaaaatcctgaaataagatacagaatgttgtgtaatatacagctcggtgtctgtgcccttttatttctctcttgggcccagccccatcatcctgtccttgatcattgtaatgcagtgttcactaccagtcttttctccccctacattggaaattatgccaaaagagtaatgaatgaattaggtaaatgaattagatgaattagagataaaattatggctctacagttgaaatatcagctttaagagaatcgacttggagaccaggtgcaatggctcacgcctgtaatcccaacacttagggaggccaaggcgggtggatcacctgatgtcaggaatttgagaccagcctggccaacatggcaaaaccccatctctactaaaaatacaaaaaattagcagggcgtggtggcaggtgcctgtaatcccagctacttgggaagctgaggcgggagaatctcttgaacctgggaagctgaggttgcagtgagtggaggttgcagtgagctgaggccgtgccattgcactccagcctcggctacaagggcaaaactccatctcaaaaaaaaaaagaaagaaagaaaattgacttggagatgtacgggttcacatataattgaaagtgagcattccacagtgacttgagaaagttgattccggctttcaaagcttgcattatgggtaagaaacttgagcctaaaaagaacttatatgtatgtgggtcattagacaatctcctccctcaccacctttttttttctttaatcaaagaattatacatatgcaagtaactgaatcacctcttctttcatttttttccctctttaatcacagctgtgtggaaagtttccagctaggcattaaattgggtcaacagctaacacagcataagtgtggacagcaggggcaatcggtggtatatacataggaaataaacgacactgtgctgctggcattgataagctgttgaatagtgcaagggccctattaagatttaaagtaataaaagatgggaggaaatatggttaccagcagctgataaacattcttgccttatgaaggcattagtttcacttaatggcttctagtgcctggagtataagctcttgtaatttttctcccccagagcagactgaaagaatacctaggaattgtcatctttgtagttgctcaagaaagatctttgggtggctgtgagcagatctgaaaatagtaagtatggcaggtacatggagctgcatccgtttgcaaaagctatcaataaagaaaggtatagaaaggatgcccttgaccccggtatgtgcagatagaagtggaatttcctccggaatgtgcatgcaaatgtgcctagctgcaaaagaagaggcattccctgctcaggtgtgtagagtgatttagaaccatttgtttctgctcaatggttctcaaatgaacagtatttcctcactaggaaacagtgctaattccaggctaggacggtccacagagatggtggctgtgcccagatcattcttggaaatctgaggaagggagtcatttcttctcatgccacacccagtaaggggtacattagatactctatttcctccaggcagatctacagtgaccaggaccacgtactaggataggagaggttctggcactattcatcattggctccggaaatagctttcccctctgagctcaaaggtaggctcatcctctgctagagtctattaggtctggtgggattggaactcaggtgcatacccctgggctctccaaccactagtgctgcatccagggcttggggtcctgctttgtgccatcaggtcatcagtgacatgactagggcagctcaacccgcacctctggcatcactgccttcctcccatggccccctagcatgaacccaaagaccacagggccggttccctccttcaggcccaaggctgggcctccaaataatggcctcccaaagatgcccacattcacatgcccagaacctgtgcatatgttaccttatgtggcaaaagagactttgaaaatgtgagtgaattacaatatggagattggcctgggttatctgggtggactcaaagtaatcaataagagggtgacaggagggtcagagtcagagaagaagttgtaatgatagaggcagggagccatgaaccaaacagtgtagacagcctctagagactagaccaagcaaggaagtggattctctcccagggacttcagaaggacctcacccctgccaactcatccgaggacttctgacctccaaaagtataaaataatacatttgtgctgctttaagtcactgagtttgtgataatttgttataacagcagacagaaactaatacagtttatcttattcctttactcatgatcaactactttggggttaacgaacaacagtatatttacttccttcaatgaaacacttacctccacccaccagagtgaaagtttgtcaccctggttccaacaaatgccacaaaccactgtatgatcatctttgggtaggtcagcttgtctgctatggtatttttcttttatattgcagtttacaaagtgctcatttgtcttgtatgatagttatatatggaaggtagcattactatttcacttttctgattttctaaaaaatatctttaatgaacacatattaattttgtgattaaatgacacaataattagaaatgttaaaaggagatggcagttttagtcacttaataaccataatactaacaaattcaggccacatgctatctcagtggatagtccccagaaccaagttaggctagttcatgaggcatttcagatagctgaagggactaagtatacactggaagattgggtacgaagatcaaaagacagctctacaacaaagcttcatgggccattggtttcacagtagggggaactgaaatccaggctacagattcaaaagcttacaacctggcaatttatgtagcatagggaatcaatgtctatagtcttaattacatagaggctaaagcctcaattattctatttctgtaggcaggattcctacataatctatagcatctattggcataaaacattcttagtggccattctgggtacaagcatcccatttctctttctgtccttccacacactaccagtgtctctcgcttatttcctcccaactctaatgttcatatgtgggttatttgagcttctaagttaattccttgcctatatgtaaggaacatattggaaaattataaccaaagtgtagtatatattgcagagtctctacttcccatgagcagctttggagggtacctcacaggagagggttagctggcatctttccattaggaagccagcatcagcacaaggggaaaacttctctccaacgtctagacctctctatcccatgagactttggggactgggactgggtagcagggcagaattgggggaaggaggcacttaagagctttttaatttcaatattctaaccattagtgagggtgtgctgctgggtacatgtctgcccataaataaacatggactgttcattgaaacttgcatttttatgtagaaaagctcatgctaccttatcactttttgcacaaaagttgacacattatgaatgctttaaaaaaaaaattataccttactcccatacactgaacatatctttcctcatctaaaactatccaagcagccaactttttaaaattaatggaaggagagggtctacagcatgtattctcaatgggggcaatgtagccccctaagggagccaaaattggttctgggttgggagtggtgaaaaaagtctttaaaaaaataaattgcagaatatacatgcagcacatagattgatatatatatctgtgatattaaaatttcatatggaggtagttgggaaaaaatgtctaaaaaacctccttagggtgatatttgatatggttttgctgtgtccccacccaactctcatcttgaattgtagctcccataattcccatgtgtggtgggagggacctggtgggagataattgaatcatgggggtggtttcccccatactgttttcgtggtagtgaataagtctcatgagatctgatggttttataagggatttctgctttcacttctcattttccttcttgcctattgccatgtaagatattccttgctcttccaccatgattgtcaggcctccccagccctgtagaactgtgagtcaatcaaaactcttttttctttaataaattacccagtctcagatatgtctttattagcaacatgagaagagactaatacaatattgaaaaaaaaaaagttgagaaacactgatctatagtaaaatttaaatatccaacttctactatttttttggctgtccattcccagtagaatacaagttccatgaaggcagggatatttgtcttttttgtgcactgatttctcctaagtgcctagaatggtgcctgggatgtaggaggtattcaatccatacatattgaattgaatgcatgaatgaacaacttccctcagtgtcccagagtccactttctctcaacactgcaagtggtggcaagctggaaggtttgtgagcagtgctggagctgggctcttccaggtgcattcacaatagtttaaaatagcaggtgcatcagaggaggcctctttgttcctggtactatgctcattgatgtttactatgagccccttgcagactcaagcatccattgtttgccttttaaatatctctactagccgggtgcggtggctcacgcctgtaatcccagcactttgggaggccgaagcgggcggatcatgaggtcaggagatcgagaccatcctggccaacatggtgaaactccctgtctactaaaaatacaaaaaatgagctgggagtggtggcacgtgcctgtaatcccatctcctcaggaggctgaggcagaagaattgcttgaactagggcatcaaaagttgcagtgagccgagatagcaccattgcattccagcctggtgacagagagcgactccatctaaaaaataaaaaaaaaaaattttaaatttaaaaatctctactctccaggccaggtgcagtgagtggctcctgcctataatcctagcactttgggaggccgaggcagtcagattgcttgagttcaggtgtttgagaccagcctggtcgacatggtgaaaccccgtctctaccaaaaatacaaaaattagctagacttggtggtatgcacctgtagtcccagctatttgggaggctgaggcaggagaatctcttgaacccagaaagtggaagttgcagtgagcaaagatcatgccactgcactccagcctggacgacaacgagactatgtctcaaaataataaaataaaataaaataaaaatcctctactgtctacttcccccacccctaatatcctagctatgtggcccaagtacttatttagcccagtccatgaaagtaaaggacagtggacagtgtcctttgataggaggatggggcagaatgggaaaagaaaatggtagggtctggaggtacaagtgggggccagagagaggggctttacagattattcgggtgtttgaaagtcagttggtgttatctttaacatacaaacatgtattatgaatctctgagcatccttcaacgattcctgaattttcaaaacagttgtgtccaaatgacacaccttgtccagaaacaatttggttttgatagaaaaagaggcaaaataaaaacactgatttacaggctcatggtgaggggtttggggaggcagatgagaagagaacctagaaaggatgtcaagagcagacttagctgacctcactttgctttgggcttgctttcctacagacattgacagtgagagttgtttttgctcaccacactgggaatatgtattgcttaggagacacatggcagttaaggcaaacagcacatgccaacaatatgttgcatgatttgatgcctgttttcagggaacttcactaggaagtgtgtgtgtgggtttatatagccacgtacatacatatacatttatatatgttttatatacttagaaataaatacggaatttgttacaggaacgtggccttacacaatcatgggagctggtctgccatcttcattaagccattgtctggtacagatgctggagtttgaagtctgtaggataggaaatcagatgttgtctcagttggcacctgctgcataatacggtaccatagactaggtggcttaaacaacacacatttattctctcatacttccagaggctggaagtccaaaatcagtgtcttgcagggttcggtttctggtgattccccacttcctggctgtgggcagtgccctcttgttgtgtgctcacgtgacctcttctttgtgcacatgtggagagaacaggctctccagtgtcttcacttataaggacactcatcctatccgattgagaccctaccttatcatcgcttaaccttaattacttctgtaaagggcgctatctccaaggacagttatattgggattggggctttaacataagaattttgcagggacatgaattgcagtccatgacagatgtaaactttgagaaacaggaaaaagctggaacctacaagcagaagtgggaacctgtgaggttggactgaaactcagatcagttcttgctgcctctgaccttgatgtatgtatcctggaggagatgctggcatctctcatcatggagctaattgtaggacaggcccagaaatggaagaagctggaagagagtctagtggaaggtggggcagcgtgggcccagctgctgttgcctgccaaagaggtgagcagcagataagtgacgaggtatgtgagctcacacacccaatccactgtggcacttctgccttccagatcctccataagaaggtctctttggcctactctgctcagaaatatataaggcaggagattctgagaaatctagttgagtccagccacgttgacatgctacaaagccaccacagactctaaggagaaattatgtccagggttgggagaagagagccattagctgtacttggatgaacagttagtggcctagaaactgatctagaaagggatctctgttgatgaaaaaggacagtggtgtaaataaaggaagagtgatttggcgatggggtgttggttcagagttaaagacatgagaatgacaaagaaaggacaagggtggcaattgagatagatgcctttattaagtatagggtatagaagtgtagaatagagaagacaaagaaaagcaaaagaactgaatagctagaatgtattaatgcagggcatcaggcatgtggagccagctaaaaagtgagagatcaaacaagattcttagagcaagagaacatcagtaggaactagccacatttatttcacggactcaatgatactgagtttctactactacagggtactgtgtttgatgcacataaaaattattaacatgtattcctgcttatcattattggaggcaggggttgtgaagtcagcatggtccccaccgccacgcccccaccccaggccaaactctaaaggtatttacctgggttttctttcgaaaaaggaagaggtcttattttttttttttatgggagctgagggcagtggataaatttggaaccagacagttgaagtattaccataagcatcagaaaaagtgaataggtttttaaaataatagggaatagagatagaaagcaatcaacaaggcttgttttagaattaaaactctacaaagtaaaagatgtagcctgaatgacccttgaaatcacatgtataatttatagcacctgattccctccaagtcatggtacagaaaatgtatgtctcagctgtgccatgctggccaatctggtctagcctcaggcttgtcacatatgaagtggtgatgacatatttatatcacagaacaattgtgaaaaacaacggctaatgtagttactcaacaaatgtagtgtgcactaaccttatgctaggcactattcccggcactagggacacagaaatgaagagagaaacaatgtcctcattctcgtggaacttgcaaggtagtcagaagagacattttattatttaatctctcactgtctaatatcatagaaatcatacattcacattcatccagagagatagttattattacctttttcacatgctgaaacagaggttacttgtctgagacctcttgctatcaagtgttaaaggtgagactgagtccaggtcttatatgactccatatgcccagcactcttcaaacggccaaatgcctcgtcccacagaaaatagaagcccacagtcctcatatactataaaacttaaatagaatacattatctcatgtggacagatggttatgactttataaactaggaaatcctatgtaggcagatgtttagttgatgaaaagaagtgtaaacatgaccctaatgaatacatgttctgcaagttattggttgctattaatacagagatagttatgctgtattaacggacaaataaggcatatgtagcaagctaaaaagtgagaagtgaaacaagattctttttttttttttttttttttggagacatagtctcgctctgtcatccaggctggggtgcaatggtgcaatctcagctcactgtagcctccgcctcccaggttccagtgattctcctgcctcagcctcctgagtagctgggattacaggtacctgccaccatgcccagctaatttttgtatttttagtagagctggggtttctccatgttggccaggctggtcttgaactgctgacctcaggtgatccgcctacctcggcctcccaaagtgctgggattacaggaatgagccaccatgcctggcctgaaacaattttcttaaggcaagagaaaccactgggaactagccacatgtatttcatgacttcaaatgatactgagtttctactactagaggaatacatgcaatagaggaaataaaagggggtgatgggatcgagtgatggaggagaagatctctttagactggttggtgagggaaggcctctgtgaggagactattgagatatacctgaggaatgggaaggaggcagatctctgaaaatctggaggaagccctttctaggagaaggaacacacaagcaaaggccctaaggcaagaatgagcttggtgtccttggggaacaaaatgaagatcagagtggctggaggttgctgagcaaatgggacctggttaattcatgcatctggaaaggtagaaaggagctagatcctgcaagtccttgcaggccacagtaaggaatctgaattttgttaatatataagacacaaggtattggaagacacaaagtcatcggaagattttaagcgagagtgacaggccattggtattttttaaaaaatcactgtggctgctataaaactatcacttatggagcaactgtaggctttttgctctttttaaagattattgtgcattggatcattcatggatgccagacttgaaatgaacaagatggggaataatggggaacttctggaatatcagtaaaaataaagaagctgctaggatcctggctacagtgtgaacccttgagttgtggcagccgtgagagatggatgtgatggctgtttggtcctgcgagtcacttttctctatcaaatatacttgaccttcatgtgaccctttccatctctttgtgaccaagtaccaagtgataagcgttaattaatttttgggtcactgtgacagatcatcagtgtgctacacttttcaggtaacaggtttccgtgaaccatttgcaatgcccaaattataagaaatcccttaatatctgactctaacagagttgcagtttccaagtctatagcatcccactaacagaggggttggaagacaagatggagccacaaaggtagcagtggcaacccgtccacccctgcttaatgctactcctggtttaagacatgagcccaatttctctttagctggtaggatgacagaaaaagttttaacagcttttttgaggcataattgatattaaaaaggacacatatttcatgtgtacattttgatgagtttggacatatgcaattacctgtgaaactatcatcacaatccagggaataaacatgcctgtcacctccagaagtttccttgtgcccccttgttgtttttgtttgtttgtgtggtagaacacttaacatgatatccaccttcttaacaaattttttaagcgcacaatacagtattgttaattatagggactgtgttgtacaacagatctgtagaactcattcacctttcataactgaaaccttctacttgttcagtaataactccctatctctccctacccccagcccctggcaaccacgattctactctctgcttctatggttttgactattttacaatcctcatataagtgtgaccatgtagtatttgtccttctgtgactggcttatttcacttagcatagtgtcctccaagcttatctatattgtcacgtatttcagaatttccttttttaaggctgaataatattccactgtgtgtatagactatattttctttattctttcatccatcaatgagacacttaggttgtttctatatcttgactattgtgaagaatgctgcaatgaacttgggcgtgcaaatatctcttcaagatcctgatttcagttattttggctatatacccagaagtgggatcactggatcatatgatagtgctatttttaatgtttttaggaatctctgagatggtttggctgtgtccccacccaaacctcatcttgaattgtagctcccctaattcccacaagtagtgggagggacccagtgggagataattgattcatggggatggtttccccatactgttctcatggtagtgaataaatatcatgagatctgatagttttataagaggttttccctttcccttggctctcactctctcttgtctgccaccatgtaagacatgccttttgccttccaccatgattgtgaggcaccccacccccagccatgtggaactgtgtgtccattaaacttctttttctttataaattacccagtctcaggtgtgtctttatcagcagcatgagaatggactaatacagtaaattggcactgcgagggtagggagctattgtaaagatacctgaaaatgtaaaagcaactttgaaaccaagtaacagggagaggctggaagagtttggagggctcagaagaagacaggaaaatgtgggaaagtttggaacttcctagagacttgttgaatggctttgaccaaaatgctgatagtgatatgaaaaatgaagtccagattgaggtgttctcagatggagatgaggaacttgttaggaactggagtaaaagtgactcttgctatgttttagcaaagagactggtggcattttgtccttgccctagagatttgtggaactttgaacttgagggagatgatttagggtatctggcagaagaaattgctaagcagcaaaccattcaagatgtgagtttggtgctgttaaaagcattcagttttgaaagggaaacagagcataaaagttcagaaaatttgcagcctgatgacgcagtagaaaaacccattttctgaggagaaattcaagccggctgcagagatttgcaaaagtaacaaggaaccaaatgttaatcaccaaggcaatggggaaaatgtctccagggcatgtcagataactttgctcccattacaggcccagaggcctaggaggaaaaaatggcccccccacctgctatgtgcagcttagggacttggtgcccggcatcctagccattttagccatggctaaaaggggccaaggtatagctggggccatggcttcagaaggtgcaagccccaagacttggcagcttccacgtgggcacacagaagttaagaattgagttttgggaacttctgcctagatttcagaggatatatggaaactcctggatgtccaggcagaagctttctgtaggggtggggccctcatggagaaccctttgctagggcagtgcagaaggaaaatgtgggattgaagcccccacacagagtccccacaggggcactgcctagggaagttgtcagaagagggccaccatcttccagaccccagaatggtagatccactaacagcttgtatcgtatgcctggaaaagccacaaacactcaaagccagccctgaaagaagctgggaggtaggctgtaccctgcaaagccacaagggtggggctgcccataggaacccacctcttgcatcggcgtgacctgaatgtgagacacagagtcaaaggagatcattttcaagctttaagatttcactgccctgctggattttggacttggatgggacctttagccccctcattttggccaatttctcccatttgggatgggtatatctatccaacgcctgtacccccattgtatctaggaagtaactaacttgcttttgattttacaggctcataggcagaagggacttaccttgtctcagatgagactttggactgtggacttttgagttaatcctgaaatgagttaagactttgggggactatagtgagggcatggttggctttgaaatgtaaggacatgagatttgggaggggccgggggcagaatgatatggtttggctgtgtccccacccaaatctcatcttgaattgtagctcccgtagttcccacatgttgtgggaaggacctggtgggagataattgaatcatgggggcagttcctccatactgttctcatggtagtgaataagtctcatgggatctaatggttttatatgggttttctctttcacttggttctcattctctcgtctgccaccatgtaagatgtcctttttgccttccaccgtcatcatgtggaactgtgagtccattaaacctctttttccttataaattacccagtcttgtgtatgtctttatcagcagcatgaaaatggactaatccaatctccatactgctttccatagcagctacaacattttacattttacatttccactaacagtgtacaagggttccagtttctttacatccttgccagcacttgtctttttgataatagtcatcctaacaggtgtgaggtgatatctcattgtatttttgatgtgcatttctctcatgattggcaatgttgaccaacttttcatatacttgttggccatttttatgtcattttttgagaaatgcctgttcaagtcatttgcccatttttaaatttgtttattttcttgccattgagttgtagtaggagttccttatatctcttaggtattaaacccttgtcagatatgtggtttgtgaatattttatcccatttcataggctgccttttcactctgttgattgtttcctttgctgcacagagctttttaatttgatgtagtcccacttgcctatttttgcttttgttgcctatgtttttggtgtcacatccaagaaatcattgcagagaccaatatcataaagttttgccccatgttttattctaggaattttatagtttcaggtcttacatttaagtctttaacttactttgagttgatttttatatggtataaagtaagcattcaatttcattcttttgcatataagtattcattttttgcagcataatttatcaagggactaacctttctccattgtatattcttggcacgcttgttgaagatcagttgactgtatatgcatgaatttattgctccactgtctcttctgttccattgatctatatgtctgtctttacgccagtaacatactattttgattactctaggttcgttatatattttgaaatcaggaagtgtgatgcatccatttttgttcttctttctcaagattgctttggctttttggggtcttttgtggttccatgagaattttagtattttttttttctatttctgtaaaaaatgcccttgggattttgatggggaaagcatggagcctgtagatcactttgggtagtatagatattttagcaatattgtcttctagtccacaaacacagggtatctttccattttttatgttttctttaatttatttcattgatgttgcctcagtttcagtgaataatcttaaaccttcttggttaagtttatcctaggtattttattctttttgctgctattggaaataggacccctcccctcccctccccttccctcccttctttcactctgttgcccaggctggagtgcagtggcacaatctcggctcactgcaatctccacctctcaggttcaagcaattcttctgcctcagcctcccaagtagctgggattataggcatgtgccaccacacttgcctaatttttgtgtttttagtagagacggggtttcaccatgttggccaggctggtctcaaactcctgacctcaggtgatccacccaccttggcctcccaaagtgctggcctcccaggtgcaaactaccacacctgaccaggattgttttcttaatttccttttcagatagttcagtcttagtacagggaaatgcaactaatttttgtatgttgattttgtttcctgatatttcactgaatttatttattagttctaacagtttttgtgttgagtctttagggtttactgcatataatatcatgtcatctgcaaacagagatattcttacttctttctttcctgtttggatttctttttcttgcctaattgctcggattaggactttcagtagtatgttgaaagtaagtggtgacagtgggcatcattatcttattcttgatcttagaagaaaagcttttatttttcgttagtataatgttaactgcgggattgtcatatgtgaccttttttatttttatttatttttttgagacagagtctcactctgtcacccaggctggagtgcagtggcgtgatctagacttactgcagcctccgcctccccagttcaagtgattctcctgcctcagcctcccaagtagctgggactataggcatgtgccaccatgcctggctaattttttgtatttttagtagagacggagtttcaccatgttggccaggctggtctcaaactcccgacctcaggtgatctgcccgccttggcctcccaaagtgttgggattacaggcatgagccaccacgcccagccaacttttttatattgaggtaaattccttctatacctagtttgttgagagttttatcttggaaggtcagatgctttctctgcatctattgagatgattgtgtgatttttgtccttcattctgttaatgtatattatatcaattgatttgcatatgtcaaactatcatcagatcccagaaataaatcccacttggtcatggtgtatggtacttttaatgtgctatggaattctgttttctagataggtgagactttttacatctatgttcatcagggatattcgcctatagttttcttttcttgtagtgtctttgttttgactttggtgtcaaggtaatactggccttataaaatgagtttggaagtgctttctctccttcagttatttttttaagactttgggaaggattggtgttttaaaaaaatatttggtagaatttgccagtgaatccataatggaaatattgtatataggtaatttagtaagtcaagaattgtccctcaaaaggtactagaaaactcagttcttacttttaagactcttctaattatcctggtggaatggcttctggaatatcaccataatactgaaatttactccataatactactgaatggaagggatccagtgctggaaactttacatttgaccaggtgcagccctcaatactaggacagtttggctagggggctacccccacaggtagcagggaagaaggctgcattggtttgactgggatggaagaagaataagctaagtagtctgtcagagtttgccaggttaaagaggaaagatgatagcacaggctggagggaggtcaaagtcacattctggggaaactagatgtatgttgaccagtaggggcaagcctagtatggaatggtgggtgacagtgaacattgagggccaatgagatttagagaatgaattgaggagtgaggcttaggggaaagaaggccgggcacattagaaggctcagaggtctaagaagcatgaggaagattgtcctccagagagctgtccccttgaaggaggtgcgttggcatgatcttgtcatgaatttctcaccctgtcagaaacatcttatgtagattttttaaagggcaacagttttcctgctcactctgagtacctgaaccttgattctaagacttaggtaaggttcacttggcctggatgtttataaatgccagtaccaaggggagtccttgaaatggcatagaagatggcaaagggctctgcagagccacgaaacccaaatttagaaatgagaattactaacaatgcatatacaacatgtctacaataaactagaaaggatgatatagtttctgataacagtctttgaactttccctacctatgaaatggtattaacccttaatcagcagctcaggaaatagtccacggtagatcctcatctttgtatttcctttactgtctggttacttactgaaaagtggtagctgaggccgtatctcctaacctgcatgctctccctctctattttctttgtctcccatgttctccctacaaagttagcattcattcattcattcttattttctttctttctctctctctctctctctcactctctctccccctccccgttttcctgtggtattgaaagcttattgtcaggatgagccccttattgcttggaacccaatctgtgtccatgaattgcccatttcacagaatcacgaaagccacgctgcttcctgagcaacacagctaagtggcattccccacccctgctcttagcaaaagttcctcaggacattattgttgaattactcaatgcctattatcatagaacctcatgttcacgctgggaggtagttactactacctttttcaaatgctgaaacacaggttacctgcccgatacctctctgctatcaaatgtcaaaggtgaaattcagcccaggtcttctgactctacatccagcattctttatagagctaaatctctcttcccacagaagatagaagcccacagttctcacatacttacaaaacttaaatagagtacattatctcatgtggacaggtggttatgactttataaactaagaaaatctaggcagatgtttagtcaatgtcaagaagtgtaaacatgaccctaattaatggatttgctgaaagttattggtctctccttgtcagaactgttgttttccctgtcacttctcagattggattagaaaaaattaagcatgaagaaaattggcatttaaaatgtgtttattcttcactatcaagacagatagaactttccattcaaaagagaatgaaaagttcattttggcatggtgaatcataaataagaaaaacagaatagagaaatcctaggacgatcaatctctcataaaataaagaaatcgagattttatcgcaaagaattctgcagcacataaaggcccttaggactggactgatctccgagttcaagcgttacacccagtatgctgcataaaccctattcagtgtttgggctcattctcaagaggttgacatccttcccattttcatatcacctccctggtccacctttgctaggtcacaggtttttcaggcactttgcattctgccctccctcctctcaaaagacttcccggcatgttttcgatagcttcacacctagcagatggcagtttttcttctgaccttctgccagccctcttccttcctcagcttccttcctctccacagcttccatttaaggtattttggaagtccctcgaaatgggtccttggtgagtaaacccctttattgagtctcggactttaagaagttcttggcttcatgggacccccttcttctagttgacacttttggggattgatttcaagaatcatctgttgctgataagtcagtgtggcttctattgctgcagaagcaaggaagaaactaggcatatagtggaagaaaatgcgcttaattagaaactggtcctcattagggattcttaaaggaagtgctcaatttgcacctatgttagcagagcctcacacggattaattaaaagctgctactctcaccagcaacacccttcatggctgggttgaattgtttgtagctgtcaactctgtgccaagggcaacaaggtttgaatctgagttctttgaaatgcaggttctttcactcactatgcagaatctagggatccagactctcaagaggcaaagctctggaagaacaggtggagtgagtatccctctggcttctgctcccgccagatgatcaccatgcctctcaactctacactcttttccctgcctgtgctccagttcacactctccacatccctggggccaggctatacctagatccttctgcttgatctctcaggctccgatgtttcaactcgtcattccctaggctattaacttcaagcccttagatggcattcaagctccttggtgacctctctgcgtccgtctccatccccatctgcttccgtgagcttcataggcaagccactctccatagttatatgtccctcaaatacccagcatccccatgccatcatttcaaccagactgtcctttttcttttcccacctaaggaaattctattagttcttcatggctgggttcaaatccacctccttcactctccaggaagactacattattcttttcctaacactcctgaagtgcttgtcctctacagcattgctgcacatattttgttctgttctttattacactagtccatatggctttactccctgctgaatttaaactcttcaagggcttgatctctgtcttattcatctctgtaacctcacagtacctaatcaagttctttgaacaaagccagtgttgaaaagtgtttgttgaattgagaacagcaagccagactttctgatgggctagaaagatatacctagaaagatagagcagagtagcatttctaaagatggaaaggacaagcctggctaaaatcatgctcaaagaaaggttttcttttagggtcctcatcacatcacaatagcaaatttttaaaaaaagaaagggccgagcacgtcagtatagttaccgagcgtacttgtgtactgggcaaagtactgagcgcaatagaaagttactaaaagaaagaacagatgctttttctcctttagagctggtcccttttcaaaataaggcctcaaagtgcatcccattattaaccctgaaatagtgggacacaaacgtccagatagatatgtgcatgccaatacgtgtttaaaaatctggcgtcacacagcacactccagaggaagccaagcctaagagacatgaacacagtaacacggtagggagccgtgtgatccagactgtcctaagcagaagaggccccgggtggagaattctcacactgacagccgcagagcctgccttccccagtgtactggttttcccagggcatcaaacattttatttaataagctacatgtttgagtcacaagcgtagacttgacacccctgtatggtcaactccagctgtcgtttgttctcctcccctctcttctggcacagtggctggaacctgtatctggtgtatcacaacgctccatttcgctgatcacacacagccagaagtgacagtcgcttctctcactgccaaggacagaggagactctggctggacaggagaaattcaggtcgaaccaaggcaagtgaacgatggaattaaaaacggctgagaaatcccatagacttagaattactcatatctgcagactagagggaaatgagttggtcctgatgacaaaacaaccctttcttttctctagtctgttaaacttctattttcccgtcagactgttttaacaatgccctctactgggtattttcaaaactgcagggttctgcaggcctgacctgctcttgttctccttgagtaattctttctgcaagatgaactgaacccaaagttttcttcacataagcaagatgttactgatgtatagtttcttaagagcataaaaagtggaccagtgcatcccctggaaggagggcctcttgccctcttgagagatttctttgtaaaggtgcatgaggaattgaaatctcaccacctcctgaactggcccagagctgtcctggcatggatgacacagggaccttgacatgggctgatggattaagaacaatgttacattttctgaacgcatcacttttccaacagctcttgatctcacatgtgaggctctttctcatccctgaaggctactgacttttccctggatatatttgtattgtgattattctgcatatctaagaatttcatccctttctaaccgctcctctgccaaaacagaaaccaaaaaaagccaaaacatcactctgtgctagttagtttctttgacccctcttaaagaaactctaaacaaaaaatctgcgtccagttatatccaagggggtgttcttactgggtattcccgtcagaacctcccatctgtctattttggttcattctttgccattatcatgtaacaagttcaagataattgtgtttcatctccagttattattcatagtccctctgcatgttgaagattgctgagacagcacagaaaaatagtaaagcaacagatgaggtctgtttgcaaaaaatgtagaacaattcgaggtgcaggatgttcttcaaattgtgatggggtgaggttttgaaaagttcttcggatgggctagtgtttgttttctctctccctctccctctcttcccccctcccctttccgctttcccacttcctctctcctccttccttcctccccatccatttctcttaaatagaaacaaaattccatatattcttagaatccataggatccatatattcttagaatccataggatccagcattgcattttatttaaaagcaaatgccgaccaagtagtcagtagcaccctttcagctccaatagttggtgctatattctgtactcagcagtagactcatttcattattttggagtatggacctgaagaaaatgaatatcagacatgggctaagccaaggccagttaataaatattttaggctttgcaaaccgtatagtctctgtagcaactattcaactctgctcttatagcaccaaagtagccacaaataatagtaaacaaatgggcatggctctgttctagtaaacttacttgtggaaacgggacaggctgaatttggcccacagaccctcgtttgccaatccctgggctaagctattgcaggggtactgctgatggatatgcgggctgtgtcctgtgtgacagtgcctagccaagggggcaagtgggacctgaaatacaacccatgctctgcttctccacgccttccaccacaagaggtcctttttgtaattcagacagaggtaccatttgttcacaggctgtctccaaccagaataagcacatttcctaatggattagggtacttaacatggtttgcataagtgggaggaagagggacctgattttcctgtattaggataagggttacctttgatcccaatggctgttattgaaatgactaaagccacatggttcaaacatggctgccttagcccacatctacagactgggagtaggtggtgggagcaattccaacagagatgtagactgggaaagtgccccaggtaagaggaaccccaaagaaggtgagtttattggttagggggcttgttggatattattaccaaagccatagtccctttatgaagtttgttctgtccaaaaatgtgatttaggccactgtatgagtccattctcacattgctgtaaagaaatacctaatgctgggtaatttataaagaaacgaggtttaattgggctcatgttgctggaggctgtgcaggaagcatggtggcatctgcttggcttctggggaggccttgggaaaacttagaatggtggctgaaggtgaaaggaggagcagcacttcacatggccagggcaggagggagggagagaggggagctatcacacactgttaaagaaccagatctcgtgagaactctatcatgagaacagcaccaaaggggtggtgctaaaccgttcacgaaggatccaccactatgatccaatcacctcttaccaggccctatctccaacatgggggattacaactaaaatgagatttgggtggggacacatatccaaaccatagcagccaccactctccatcttagaatggtagaataataaaattaggaggaaacttggtatgcttttgcatgcattttaacatcagaaccctttgttcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaagaaccctttgttcaaataaaatcttatctagaactccagtatacgcaactgtgaaaaagggagagtgctctggtgcagctggagaggaaagacaaggagtgccctcagtaaccccctccccagatccggctggcccagagagagctgctgagactcccccaggacccagtttggagccactgatctcatcactgcataggagggagagagagaggggagatatgaaacaacggaggcaaaatgaaataaaataatcttaggtgacaacattttttaccaggttttgttggtataaaacaccctttccttttcagttcccctacctgaaagtctttggttgcttatatatatttaggatgtttttatatagggtaatatagaattgtaaggcttaatataatattaatatttgacattctattggatttaagcagccagtgggaagagagtaaataaaaataactacacaaaggaaactgctattagcgtttgttaccatgtgaatgaaatagcacatcagctgtgcatttaaagatctggatagaagtttgtttcagttatttgtttgttttgaggtacatttacatacagtgaaatacatagcttttaagtacacagtttgatctgtgttgactatacttacgtaacccacagctctaccaaaatcaacaacatttccatcatgcgggaaagttctcttattccccttcccaataaatctttcccacccagaagcaatcacagatgtgatgtctatcaccacacttggttctattctaggactttgtataaatggaatcataccatatgtactcttttgtgtctactttgtttcacttagcataatatttttgagatttatccatgttgcagcatatggccatacctttttcctttttatgcctgagtagtgttccattgtgtgaatgaatatgccagtttatccattctcctgtttatggacacttggaatgtctaaaagctgccatgaaaagccttgttcaaggctttttgtggacatatattctcatttctctaggataaatgcctaggagtagaattgctgagtgataagagtgatgcatatcttttaagaaaaaaactatcagagttttcacaattatccattttacacatccatgcaatatatgagcattctgattgttccacatccttgccaacacttaatattatcagcctttaaaatttcagctattctatttggtgtgtttctcatgtagttttaatttgcatttctctgtaataatgttgattgccttttctaagtgcttattggctattcacctatcttttgtcaaatgtctattcagatgtttgccctttaaaaaattgtgttgtctttttattgttaaattgtaggagttctttgtaagatacaggtctgggaaatattttctcccaatctgtagtttgcttattttattgagattgtcttttgataatgagttttaaattttgcagttaaatttatggatatttttctcttatggttattgcgttctgtgtttgaaggaatcttgccttcctcaaagtcacaaagatttatcttatattttcttctagaatatttatacttttaagttatacatttatgtctatgattcatcttgagttaatttttatatacaatatgtggtaagattcaaagttcttttctttttccacatggctatctagtcattccagctcaatttcttgaaaagatgtttctttttcaattgaattgctttgatatctttgttgaaattgatttggccatatatatgtagggctacttttgggctttcagttttatttcattgttctgtttctattttatttcactaaaaccacactcttgatttgtatgtttatagttaatcatgaaattagatagagtaagtccttcaactttgttcttctatttcaagaatgtttgggctattctaggtcctttgcatttctgtataaattttagaatcagcttatcgatttctacaaaacgtcttcagaaattttaattgagatctattaagtcattagataaacttgaaaagaaccaacatcttaagaatattgagttttctaatccttaaacatggtatatattattattattattattttttttttatactttaagttttagggtacatgtgcacattgtgcaggttagttacatatgtatacatgtgccatgctggtgcgctgcacccactaactcgtcatctagccttaggtatatctcccaatgctatccctcccccctccccccaccccaccacagtccccagagtgtggtattccccttcatgtgtccaggtgatctcattgttcaattcccacctatgagtgagaatatacggtgtttggttttttgttcttgcgatagtttactgagaatgatgatttccagggacatggatgaaattggaaatcatcattctcggtatatattatttatttagatcttctttaatttctctcaacagtattttgaggttttcagtatatatctcacatacctttcattaaaattattcctaagtactttctgttttgggaagctattttaaatagtattttaacatgttacattgatgaattctttatgtagaaggtttttttttgaagattatagaattttatgtatctaccaggtttgctaatttgttttagtttatttatatctttgattaattatagccttgtaaaatattacttaatattacatactggtcatttcctgttctgtcttgcagatgattttatagctgacatcggtcaagaactacattatggtgggataaaattttaatttactagagtattatagtgagggaagttttttctttcttatggagagtttttattatgaatgctttttaaaatgctttttctgcatctatttagatggccatttggtttttctccttttaatctattaatatgttgaattatattgactaattttaggatgttaaacagcctttcattccagggttaaacttcacttggccgtgatatattattattattatgtatgtgtggatacatttgagtttttaatgttttgctaatgatttttgtgtttgtgttaatgagagatattgtcattaatgttcttttttttttttttttttttttttccccccctctgagacagagtctcgctctgtcgcccaggctggagtgcaatggtgccatctcagctcactgcaagctccgcctcccgggttcaccccattctcctgcctcagcctcccgagtagctgggactacaggcacccaccatgacatccggctaatttttttgtatttttagtagagacggggtttcaccgtgttagccaggatggtctccatctcctgacctcgtggtccacccgcctcggcctcccagagtgctgggattacaggcgtgagccactgtgcctggccctaatgtttttataacttgcttgtttcagtgtctgggcaacactggccttttaaataattggaaatgttctctcctctgtttctcagagaatttgtggaggattttactattttctttctcaaacatttagtagaatttgccagggaacctctccaggttgggagagttctttgtgggaagtttgtatttatgagtgaaatttctttaattgacacagggctattcaatttttctatttcttcttgggtaattttgttcttttcagtctttgaaggaatttgttcatttcctgtaagttgttaaatttattggcataaatttgttcatacaatttccatattaccttttattgtgtctttgtaggtttttatggtagcatctttatagagatataactcacatataacacagtttaccatttgatgtatacaatccagtgtttttaaagagatttagctatacagctaattttagaacatttttatcaccctaacaagaaatcgtggtgccataccagtccttcccaccctatttacccagccttaggctaccactcctctcttttcagtctttgtagatttgcctattccagactttttatataaatgagataatataataagtggtcttttgagactggcttctgtcacttagaataatgtttttaaggtttactatgctgctgttaacattcatgtacaaatgtttgtgtgaacacacatttttatttctcttgggaatatacctaggggaagaatttctggatcataacgtaactctatatttaagcttctgaggaactgatggactgttttccaaaataactgcaccattttagactttcaccagcagtgcaggaggatttcaatttctctgcatccttgctaacacttggtgtcatctatcttttttattacagccatcctagtgggtgtgaagtagaaactcattttgctttggatttgcatttccctgatggctaatgatgttgagcatcttcccatgtgcttgatggccatgtgtatgtatctttcttggggaaatatccattcagccttgttatcctttaatgactgtagaatctatagcaatatcccttctcactttcctgatatcagtaatcttcatttctctcgtttttttcttaatgagtctaaataggagtttataaattttattagctctttaaagtgccgacttttggttttatcatttttctcttttgtttgttaattttatatttcatttctcctttttactacttcattcttttacttaccctgagtttaatttgctcctcagattatttagatcaaggatctaaatttctaccttaagaaactagctttttctagcatatgatctatcctagtcaacataccatgtgaacttgaaaagatcgatgtattgatagtagcttttactttttctctatcttttttttttctgatactattgattgcttagaagaactgctttaacatagatttccaaactctatacccataaaactggaataggttacactatacccaatttatagataaaaaaatgaaacttgaggctcagaaaggtgaaatagattgctggtctgaaacttacctagagatgaaagttaggtagactccactgcttaggttggaagaatatgcagacaggaaaccagtgggaaggggacagtacaatgtacctgcagacctgattattccagtatagcaaaagcattctgtctcagcctgtcacactttgataagatatatttgggggaatatcatgagtttttggcttatttgttaaacacctggatttttatggtctaactttagttgttgactaagcaaagtatttgttgactaatgtgactgagttgtgaaacgtctcgaaatggcatttcaattgtcagtgaagggggtggcatagacatatgattccttcatatccactcaactgagtctggcgtctccttgaatgcaggcatgcggaatgtccatgtgcctggcatcttggcggtggtcagtaaatgtttgtcaaaaggagctgaagtgtataccgtttctttgacttcttctgtgagtcaagcaccaggttcatctgagtgaaaaaatgcaatgtggatgagactgtgatgtgtcctgtacactgaaagagatcttgatcgttactaaatgggtattaaatgaggcagtgtggccatgacagaaatatgcaagaataaaagaagtgttgtagttcgcagaactttagagggggaaaatatgatttatttattacttgtggaatctcttgatttgatacactggtggaacatagcattatagtcaaagcagcagtgatagcttggcttgtgtgaaaacaaggtaggatttgtaataccatctgatattcttctccgagtttcagattcagaaagaacagtatcaacatgtaccgagcaggggaaacaatataggaaagatataaaagaaaatatgcaatccttgaccaatgtaaataaatgggaacttttgatttatttgtcatgtactcagattgatgggtttcgtagtgaagtaaatgtgtgtgcatccctggttcaggagagagtgttttgtgtatcattctagactactccagactgacatttcaaagcaacgtatcatcagtgaagtatgtatttatcgttagctcttgaaggatttttttttttagttgatagagtcatgtcttagtttctcaatgtggagaagctaaaactgtgatcctgtttctcattttctctctcaccacataggaaactatcctggtcagaagctaccccttggttgtatcagtttgctagggctgtcacaacgaagtaccacaaactgagtcacctaaacagaaatttgcaatctcagttctggaggccaaaagttcaagactgggatattggcagtgttggctcctaccaagagctgccaagaagaatctgtgccacacctcttccttagcatatgttgttggctgacaagctttggcattccttggcttgtagaagcatctctcccacctctgccctcatcttcacgtggtgttctacctgttgtatgtctccaagtccactcacactggattagggacccacactactccaggacaaccttaattaattacatttgcagaagccctacttcaaataaggtcacattttgaagcactgggggtggggacttcaatatatgaattttgggggacatgataacatgctgcttataggtggaaaataatttctacatatttattaataaggaacctctaagatgaacagatttggaaatctagtttatcttcagtttgttctaagcatctgtgtgacctggaataaattacttcattatcccaacctcagcttcttcatctgcaaggtggaagaggtgatacttgctctcctatgttatagagtcgtagtcaattataacaatagctgctgccatttattgagtggtaataagagccggcactatcacaagagtggacaccttttacaggctaggaaacagtggcacaaagaagtaaagtaatttgcccatagccaattaagtggcggagccaagattcgaacccaagaagaatggctacagtgccaactctttcaaccagggaaccaggagagcatcactatataaattctgtgtaaagtgcaagacacaatgcaaaagttcgttgtcactaaaaggagaactcagggcaaagtcttgtccttcccacttctaattctttttttcctactccagtgtttatcaaacttttcccccttttagaatacttattggaaacccatacaaaactcatatctcctctgatgtttttgaaatttcagaacctgcatcattattgaagtaaatccaagcaatcagaatttgaaaatctagctttccaaacggcctcagaggcccccaacacacacatacacatacacacacacacacacacacacacggacacataacacacagtgtgttaactcagtccttcctgccttcagtttctgtggtacagccatgatatggcttggctgtccccagccagatctcatcttgaattgtagctcccataattcccacatgtggtgggagggacccagtgggaggtaattgaatcatgggggtggatttttcccatgctgttctcgtgatagtgaataagtctcacaagatccgatggttttagaaagggctgttcccctgtacgtgctctcttccctgccgccatgtaagacatgcctttgctcctcctttgccttctgccatgattgtgagggctccccagctatgtggaacagtgagtccattaaacctctttttatgtctttattagcagcatgagaacagactaatacaagccataaaaggccaagatcatcattcctttacctacattctttttttgttatttgcccttgcttttcatcatgcaccacatcatttatgtaactaaaaataccaacttccaggccaggtgtggtggctcacgcttgtaatcccagcactttgggaggcggatgcgggtgggtcacctgaggtcaggagttcaagaccagcctggccaacatggtgaaaccccatctctactaaaaatacagaaattagccaggagtgatggcatgtgcctataatcccagctactcaggaggctgaggcaggagaattgcttgaacccaggaggtggaggttgcagtgagctgagattgtgccattgcactccagcctgggcaagagtgagactctgtctcaaagcaaaacaaaaacaaacaaacaaatgaaaaaccagcttcccttagattcccccatgagtttctgactccactacctaattcaataaaggcatttttaagaaatataaatcatatttattcatggttatatgtacatgatacaaaacatttcacagcagaaatggactcttttttaccccatcctcaatcaactaatttccttccctataaaaatctattatttgttttgtgttgtgtgtttcagccagagatactctatgcatgatgcaaacatattagcatccatatgctactttcatctaaaaagtagcatactctccacagtattctaaacctcttctttcacctattaagatatcatttctctattgtaagacttaaaatttaatgtagtgcctttgagcccaaaagtcttgagtttccctacttctaccagatattccccccaaccttcccaaagagaaaggctccctacttaaatggttcctctatcatctgggcctgctgggccgtacccattcctcaacctaacaggtttcacctcccggccagcccatgacattagtcacatcctcctgtaggaacctgaggacacctctcccccttgttactacatagccggcctcccacagcccttgtggtttgctctgctgtggactgtagcccctgtatggtgaacagtgtcctcctcccccaggctgcaagtgtatgtgactagtaaaccacgatctgtctcttttaagtggtgtggggtgttgtttgtctgaccttctcatattatttagggcagaggatccacctttaccaactgggtgaataggaggtgattagaactagtccatattaccacatagagcaatcctttgcttttcctaataagtgcacagaactctatagtatgaataggaaccaatttacttatcttgttccctgttggtagacactgggtttttactctttggttccacagcaatgctctagtgaattttctattccacattttgcatctgaagtcatcttgcatctgaaggagtaaattattacaagtaaagtatgggtcaaatgctatgcacattaaattttaataaacattggccaggcgcagtggctcacacctgtaattccagcactttgggaggccaaggcgggagtggatcacctgaggtcaggagttcgagaccagcctgaccaatatggtaaaaccccatctctattaaaaatacaaaaattagctgggcgtggtggcatgtgtctgtggtcccaggctactcgggaggttgagacaggagaactgcttgaacccaggaggtagaggttgccatgagttgagatcgtgaaactgcactccaggctgggcacagagcgagattctgtctcaaaaaaataaaataaaaaaattaataaacattgccaattgcttttcatagaatgtgtaccaatttagacccccacaggcagctggacagtctatttccccacatcctcatcaacccaggacattaccaaactttctgatcttggccaaggggagaggtgaaaaatgtcaagtccttgtggttttagtttacagttttacaagaagtgagggcaagtgtcttttcatatgcttacaagtcatttgtatttctggcctttctcttattgactcgaggaagcttttcctttattgaataaattaccactttttctatgatatgaagttgaaatatcacttatcatttgtctttgtttatagtaggttttgctgcctagatttgtattttatgttatcacatttaccttcttttgtggattctagtgttggggttacatatagatgcatcttctccagtctgtgtaggagaatctcattttattgtgcgttctttgttgtgattcacagatatcacatttttttacaaattgaaggtttatggcaactctccattgagcaagtctatcagtgccattttcccaaaagcatgtgtttactccatatctgtgtgtcatattttggtaattctcaaaatatttcaaactttgtcattatcattttttcttttatggtgatctgtgatcagtgttgtttatgttgctattataattgctttggggcaccatgaaccacacctgtataagatggagaacttaataaatgttgtatgtgtactgactgttccaccaactggccattgcacatctctctccctctcttcaggcttctttattccctgagacacagcaatattgaaattagaccaattcataaccctacaatggcttctaagtgttcaagtgaaaggaagagtcatacatctctcactttaagttaaaagctagaaatgactaagcttggtgaggaaagcatgtcaaaagctgagacaggccaaaagctagacctcttgggcaaaataattagccaagttgtgaatgcaaaggaaaagttattgaagaaaattgaaagtgctactccagtgaaaacaggaatgataagaaagcaaaacagccttatcgctgatatggagaaaattttaaaaggtcaatgcctggcttcaaaagacaggctgactctcttgttaggggatagtgcagctggtgaagccaatgctcatttaccattccaaaaatcatacagcctctaagaatgacgctaaatctactctgcctgtgccctaaaaatggaacaacgaagcccagatctgtttacagaaggatttattgaatattttaagaccactgttgagacctactgctcaaaaacaaagattcctctcaaaatattgatgctcactgacaatgcacctcatcacacaagagccttatgaagatgtacaagaatgtgtaatacaaggcatgttgttttcatgcctgctaacacaatatccattctatagccctggagcaaagagtaattttgatttccaagtcttattatttaagaaatatactttgtgaggctatagctcccatagataaggattcctcttggatctgagcaaagtaaattgaaacactcctggaaaggattaacagttccagatgccattaagaacagttttgatttctgggaggaggccaaaatttcaacattaactgtagtttagaagcaattgattccaaccttcatggatgactttggaggggttcaagacttcagtggaggaagtcactgcaaatgaggtggaaatagcaaaagaactagaattagaagcagagcctgaagatgtgactgaactgctgtgatctcatgataaaatttaaacaaatgaaaagttgttccttatggatgagtaaagaaagtggtttcttgagatggaatatgctcctggtgaaaatgctatgaacattgttgaaatgacaacaaagtatttagaatattacataaagttagttgataaggcagcagcagggtttgagagattgattccaattttgaaagaatttttgtgtgcatgtggaggtaaaatgctaccaaacagcattgcatgctacagagacttatttcatgaaaggaagaatcagttaatgtagcaaacatcattgtggtcttattttaagaaattgtcacagccaccccaaccttcagcaaccattatcctcatcagtcagcagccatcaacatcaaggcaaaacctcccaccagcaaaaagattacaacttgctgaaggctcagatgatccttagcatttttagccataaagtattttaaaataaggtatatacattgttttttagacataatgctattgcacactcaatcaactacagtataaacataattttatatgtgctgggaaaccaaaaaattcatgtgacttgctttattttgatatttgctttattgtggtggtctgaaactgaatgcacagtatttctgaggtatgcctatagttgcattaaaaaaaattctcctgatgttattgtcaagattttaatggcttcacttttacatttaaatatttgattcatctggaatctatgctgatataaggtatgagataaagatctataatttgtttttacagttgattatttgacaataattcttttttccattaacatacaatgtcatatttatcaaatactgagagactgtttctgatctgtgttctgttccatggatctgtctcttcatgcacaaaaatgagaatgttttaattattatatatttaaaatgttttaatattgattattatgtatatttgtcttttccttattcttgtttattttgttttccaaatgaactttaaaatcatcttgcctatgactccatgaaaaaattatattgctgtttttggattcttgaaaattcatatactaaagtaagaagaattgaatctttaaaatgacaaattttccaatcaaagactgtgacatgcatgttatttctttaaaggtcttcatgccctgatagtgttttagagtttagtttatatagctcttccacatgtctcattacatttattcctaggtatttaaatagtagtctttccttcctttgagactttctgactagtggtaatttacaaatattaaggctgctgatttctagatatgagcttcccccagccatctaattaaatgttttattattctaattttccaggtgtacagtgatatcatctttaaatatgatgattttacttcccttgcttcaatttttgtagtccttacgtctttctcttgtttattttgggttggccttcagaacgatgctgagtaaaggataaaggatgtcttcatcttattcttgattttaacaaaaatgcttctgtagttcccctaccgcaaatattgagtatccatgatgttctaggcaccaggatgtagcaaatacaactgtccttcaggactcaactcaaatccaccttcttccaaagccccctgtgatcatctcaaacagaaattgtctttgcctcctccaaacttcatattttccttccctttactgtcctactttttatcttgctttagaattatcagtatacttgtcttaaatagtccactaaaaatcggtatgctcagagaaggcaggatctttgacaaatcatctagtcatcctcagaactctgccttgcccacagcaaatgctcaacacagtcctgcttaattaattataaattagttagtatgaaaatttgttcaaatatatttgagcaaatactaagtaagcatctgctcagataaaaatgcaggattctcatacagagcacttggccatgagtaataaatgtaagtccggctctcaaaatatacatgtattcctatttggcactagccaaaagggggtgcaatatttacctttaaattattatagagagaatgagctagaaaggaaaaagccagttggagccagaaagcttggagtctttgaacctccctcagttctctaaatctagatgaaatgatatgaatcatcaagtcatttcatgccttttacacttcactttaggatctttttctctaaaaagcctctctcaacagggataatagggtgagtggccttagtatcagtgtttggtttctttgcgatgtgtaattggttttagctagtgtggaatgtcctcttgattttaaattcctatttttagctcctctgtatattgtgttatgtgttcactgttgctccccacacccctccttgcaagtctatacagaagcatttcatgtggaaccggagctgttctagggaagcctgtcatcaaggctgccctttgctctgcacctccccagcaccctcagaggtcagagcgaggctggtgtacagggcagtggatgtgagagcttgaatttcttgccaccttgttacaagccaaagtaggaagaaagtgtatccagaccaggaaacatgatttgtaatcgtggttgcaaatctagcaccctaaacctagcacaccatttggcacatactcggctcttaaatgtccatttaatgcatgaatgactaagcagataagtgagtgagtggatacatatgtgtcttattgggagacggctcatgaactgacattcaccatgggcttttctaagtttttcagtgggatcaatgttggtagtttgtatatttgcacttggtttagaaaactttcctttacctaatcctcaggcgatactgtgaactttgggttgcttacttgataaatatagttttattattaattcatgcatttgaaataacacatgcattgaaagcagcagcaaatccttttaagctctgtgctcttttaaataggttctttctctcatgctcaggaaaaaattcagtggagatgatggcaacagactggtccctcaaatctctggccatagcccaaggaggagagaacccacaattgcaggccatatgtattgccctgtatgatcagtattaaactcaaagtatgtctttgtaactagagacatattctgggtagtgtggctgttagtttgtcccaatctttattttaaggcactatccacatctctttctcttttcctttgcccctaacattgatatcaactgagttttcagggtgccagctgcccatgtcagctctttgagagagcagcctctctcctccttctgcctctcaatcctttcctctccgccagctcttctcggcatgttggtcattcattattgatgaccctccagcaccttctccaccccggtgttcccatagccctgtgcactgctgagcagagccaggtgcaggatctagtcggggtccaggactgctgctccaaggccgccaagactctttcccttcctggctgtcagagaggatgcctggcactagagatacagcagcagcggcgtcagccgctggtcttgaggagggtttgtttctctcctctgtcttctaggaagcaaaaggttaaactgttcattttaagagcctccctgggtataaaatactgagctttgtctttctggagtgagccgattcctaggccccttgacctttgctccaacatgtctgctgcccatcccttagagtgtttttctttgctttctatttagtcagaaggaatgaggctagtgtctgccgttagcttaattattggggaaaagcgttggaagaaaagaaactgattctctccatttttctaattgttacttaaccaagtcttgacaagatacaatttggtggctaatatgcatggagtgccctttctgaaagcagaggctctgcttgtggattctgcagtgaaggctggagtcacaccttggaaatgactgtccaccttcacatttgcacacatcacttacacacatggagctccttccaccaccagcctcccctgagccttcataagacacaggctgctgctttaaggaacattaacaatccagacccttccagggacccatgtgactccagcttctcccacaatagtcagaaatcgtaattgagagttcagaattcataggtaccaggataatattgcagaaagataatcaggcacctacttcccagttccctgaaattaaaacaggtattcatcttgtcagaataagaaaacagggtcctgctgtgttccagccacctggcaaccttgttcttagaatacagaaagggagggaagcaatgtgtgcgatcactctagccgaagaatgtagagagaagcgaagaccatttttttagtcctaatttcctacaagggacaatgcacctaaagtttttcaagccttgctcagaatcatctcacaaaaggaaaggccctttgcttcacaaaatattttaatgaaagcaaaacagtgactaagagcctcatgtactgctggttctgcctgtttcaaatcttgaaaggcctttaataacctccattatgtgactatgtgatttttatcacacaatctcagattcttacattttttaaataactcaccagcaagaaccaatgtcagaactaaatgctaataagatttggcctgggagagtaacatagtaagattgttaatgtttaatgcactctcatcaaagtgggataatcctacggctgaaggttaagtgagccttttgtaaaaaaaaaaaataatagggaagaaaacattattgtagcttttccattttactcagtcaaatgaattcaacataaacttgttatagccaagcccaggctagacatttcctggtgatctggtaatttcccttgtattgttcatgtggtttgtctctttcctcttcctctttgtttctaatgatgatgatgaacagcatctctgcaataggccacattctcaaagtgctccattcattgtcacttgaaaagaccactgttgggttttattgccatcattgatatacaaggataatttacatacaaaattgtggtttggttttagagccatggcaaccagagtatcacttctgatgggaaaaggaagaatggccttcagtgatggagtaggcaattgcaaagagttctgctcccagttctcttgctaaatcaaaagattgcaagggtcaagatcgatttcttcattttctttaggcagcaatctgaagaggccccagcagaaaactccagccttaggatttctggtaatcagaaaaagaagcaactgttcttgggtaacatgtggtgcccataaaagggcatcagctcttgggggcagcctgaggttaccaggttcacctttgctcattctgcgcaaggatcgctcccctcagagtttctgcaggggaatgtgtactctggtgttcggtattaaagcttctacatgaatttatagagttgcttacattggctgagaaattgttttttttttttttttttggtactcagccctaattttccctggcaaatattgctctgtaactttgagatgaatgtacccatcaaaaactccagaagaaattctcatgcagttctattattgctcatcattttgccaaggaacgttagtaaagagagctatgaagtggctaaagaagttgtgttttttgtttgtgtgtttgtttttccttttcatcgttttatgtcttagtaggagaagaatccaagatgaaaaggacaggctctggttttagctttgccactaatttcgtgtgtttccttatgcaagtgtccagatcttcttgggaattaatttctttatttgtcaaagggagctaataatacctgccctggccaacctgtaacatagttatgcgtaggagtaaaatcacagatgtgaaagtttgcaaaattctaagatccttaggtagctcatgcgtcgacaggagtaatgaattatacacctaccgcaaaaggtgattgtggggatccagtgtcaaagggcttagaagagagtgtgacacataagtagcatttggggatggtagctggaagaccaagcagcaagggtgttaccatcaaatcccttccataacccctctcccatacaaagcaaaggggtctaaatagccccagtgctcacttcaatgctactcatattctttggctttggagactttgcttttttggagcccctcattcctactttccagacatttgcagaattcagctgtgctttctaagagattctctggcattaacacagaatgaccttgcagtgggaatgaccttggagctgcagcgacttgagtttaaattctagctctgccccttactagctgggtgggattgattccaggtaactgtcagtaccttgtgtctcaacatcttcagttggggatagcgtcctaccatctccctcatagaggagttaacgagttgaaatgacacagatgctacagtcaggagatgctacgtaattttctgggcccagtgcaaaatgaaaattcagggccccttgttcaagcatattaagcacttcaagatggcaacagcagagcatgaaaccaaggtctaggtcttctgagctcagggtcttgtgcaactgcataggtcacatgcccttgaagcccaccctggccactgatcccatagtggcagcttgccacttagtgggcactcagtagagaccgcttgcttttctttcttcctctttctctcttcttctcttgatagccttaaatccctgggagggggggcttgcatttactcttacacttcctgccacagtttctccccttatgatcgttccttctgctggttaaattgccgcttctcttttgcccctgaaatcagggagccaagtgattaagagaagctagcttatctacacgagcctcccatctctatgtctgtatttcccaagttctttcaaagataacccaataaaataaagaactaacagcatcatgatacatacaaaggggctatggtgtatgtgtggcaggctggggagtaaggatggagaaggtattttgaggcaaagaagaaagaacaaaggaaaatgaaggtattagaagataaaagcttgcacttcacagaagatattattttgctgccatgtatctaagcacaattgaggcagattagttgtaaaatcacctcatttacttttcccagcttttttcagccactttcactaaatcaaccaaccaaaccttttctgtgcccttatgtcccttgtctctgaacttcatcaactaaatatttgttatgcattattttattcagcattcacagtatctgtgggtttgggtatgctacttctttcttcattttatagagaaggagatgatagagtaaccgtccatagttactgtgttcattggaaatgttttgtctccaagtagcagaaagcccaacttacagtgtctgtgttcggggttggaagttggggagaggttcctcctaatgagatgcttggaggcagaccaccgcctcaggggttagacagctcactgacatcctggctcctgtctgctgctctcttggcttttccctcataatcacaagatggctgctgtgggtccaggcatcacaacatggtcaggagaagaagaaatgagggaagaaacagtatccagcctattgttgtcttttcttgggaaagttacactttctcaggcatccactggcttacagacttctacttatgtctcattggccagaactgtgggagtttctagctatagaaatggcggagaaggtgagtgtttagcttttcccgcctttttcctggttgggggagacagctctagagtgaagcacacaacagtatatactttatagtgacaaagatagcaaggggcaaagacagaacctgaacccaggtcctctaatcttgagtttagagattttgccattctgccacattgctcttcttttaaaaatactttcagcaacatccagcttgtccacttcctgctgagacaagccaacaggtataactccaagttatggaaatttaaaacaggaaatatgtttatactatgccttcccttaaggttcctgagagagaactttctacaagttatgtaaaacagagataatgtggcttatagaaaatttattcctcacatgataaattctgtgcatgtgaagtttcgtagaactcactgtagcgcatttagaaacacacgaccagaaattgtgtgaaacattgctttgggatggatggtgcccgtctgaccttaagctatccttcccccactctgctgctcttcaaaccacagccagtttattttttggtagaaactatttacgtatgaagatcgtatttggatgcctttagtaatttattaaactcactttcctaaagcaagatcagagtttaaaacatatgtaaatatcagctgagagattagaaacaaaagccaagaaggaatttctccactgcaattaccacatgcagttaccatggcagggaagctgtgcgggataattcagtccaaggtagagaaataacagagtctggaaatgtaaatatgtttctgttagagatacttgaaataacgtttacactggcttcttcctttttagctatgggatattgtgcaaaacttttttgttgtgttttctttaaatgctccgggcagtaaattggaagtatatagcacctgctacatgtttagtcagtagtcgaaacattgaataaatcatgaaatctgtaggtgaactgaataatagctgccctggagagaactgtaattcactgttgacaaaataaatccccctgcatttttctggggaatcttttatttttagcaagagtgtttgatactcctaagttaattagtagttttaacagagtggaatgttattgaacctaccagtgttgtttaagagctaatgtttatgtgccaggcgccagattaggtaattttataagcatagatcattacattctcgcccagccctgtagggttcctagctctgcttttccagatgaagagccaagacccttagaggttgtaactagtccagagccacatgggctaggaagaaaggaagacctttcaccacttatttacacaagtaagttcttcccaggcagtgtggcagactcagcagattggcccacttaactcttgttccacccccactctatcttgtctacttctaccacagaggccagaaaccacaaatccccagcctcctgtggcttggcttggggtagcccaaatacacagttctgtccaaccatgcataggcagaattccctggggaacatttctctctccccaagtaggtaaagcttctttgccctttaccgtttgttgttccttttcttccttcatggaaagaagagtcactttcaagacatgcagcaaccaccctctaacaatcagaaggaaatacatggttaagattgttgaaacaagaagtaaaagaagtcaagttgcttgacgatattctcttttgtctttttattttttttattttttaaattatactttaagttctagggtacatgtgcacaatgtgcaggtttgttacatatgtatacatgtgccatgttggtttgctgcacccattaattcatcatttacattaggtatttctcctaatgctatccctcccccatgcacccaccccacaacaggccccagtgtgtgatgttccccaccctgtgtccaagtgttctcatcattcgtgtcccacctatgagtgagaacatgcggtgtttggttttctgtccttgtgatagtttgctgagaatgatggtttccagcttcatccatgtccctacaaacggcatgaactcatccttttttatggctgcatagtattccatggtgtatatgtgccacattttcttaatccagtctatcattgatggacatttgggttggttccatgagcttgatgatattctcaaatagattccctagccctaggctgcctgccattgcattccttattacacaagaataatcatctcttattgtattccaatcattgattggcattattttttttctgcatagcaaaatacatggccaaatcagtaaacctgaacttctcaaagtggccatctggtagctactagcttataaactgttccctaggtatagagaattgaaagcaggtgaagtgtgtgtgtgtgtgtgtgtgtgtgtgtgtgtgtgtgtgtatttcacatatcactcaggtcaatgttcctttgaaaatggagaatgcaactctattaagataatagtgtaaatttggtaactgatcacttacagcaattacaacaaaagatgcaaaagtcaggcagaactgggttctaatgctggctgtagcactggttggttatgtgaccttgagctcattagttagccttgcacacatttcctcatatatgattgaggataagagtagttttatctcatagagatttgaggggcatttggcacaggatcaggcacaaagtaagcactcagtggtattgctgccaataataataacaataataataataatagaattatttaagacttgcagattgagggaatttgatgaaatatataacaactgaggttaaagtgttctaattttctgtctagattcatcttttatggtccctttttaatctcacaccagtgtccttccagaattaaaaggtcaatgattttacttcctagagaagcttccttaggggcttatgaatggtgaaaatgtgcacgtttgcctcgactctctatttccattgtcgaaggccttcgcaaatttacctagtgattctagccaagtgcttcctgacattcttaggggctcgaaggtcaatacttgatttggattttttgttgttgtttctttttccctccagcctcctgtgttgtgttgatttgtaaaatggccattgtaaatgttaaaatggaaagaaaaccgagtctgttataagctttgatgtagtaaaaacagcatggagcatcttaaattttaagatgtcatcagaaaagaagctcttcccagtttcctcttgaaaatcattgtattagtcagggttctctagagggacagaactaataggacagatatatatagaaaggggaggttattaagtagtattaacttacacgattacaaggtcccacaataggctgtctgcaagctgaggggcaaggaagccagtccaagtcccaaacgattttatttgacaaaagacaaaaacagaagttatttacaatagtttttgctcaaataattcagtgggggcaactgtacttttcctccaggtttatcttataaccaaacccaagcagaggctgccccaccccaacaccccattttacacagctgggaatgccaaccagaattcagcagcgtggctccctcacccctcaccaccctctattgctcagtgtacagtggggagggaaagatcccacctcagcccaagaacttggagctgaagaacttggaatctgatattcaagggcaggaagcatccagcacagtagaaagatgtaaggtgggaggctcagccagtctagccttttcacatttttctccctggtttacatgctggccatgctggcagctgatttgatggtgcccacccagattaaggatgggtctgcctttcccagctcactgacttgaacgttaatctcctttggccacaccctcacagacacacccaagatcaataatttgcaccctccaatccaatcaagttgacactcagtattagccctcacaatcataaaacagaaaaatgagtgaaaagcataaattttgctttcaaaaagctgggagattctatatccatgaaccacaatatatgacgtaaggctggccaaatgcagtggaacgaaagctcaggaagggctaagagacaatcactatgatcaggttatagattttgacaaagcaagcaaaaaacacgtctccaaaactggtacttcagagcaggcataccctaaaggatgacgccaataagcctttgtttggaaaatggcaagggtattgcaagactggaagtagaaaacctccctggaccctacctgctaccatgtagtagcaaatgaaactgaaagggaaatgcacagtcatcctgtgtgtataggaagcagtccattgttgtggcactacggcagcctgttggccgagaagaagcagtggctaaaataactcatcagcacacaaccctttgtaataagacttaacagtaaatcaggtaaatttttaccaactcacaacatcctgactcctatcccacaaaactgtcctctaaatatctgaatcaagaagtttccacattcagaggaaagtaacaataaaaaggaaccagcacaggatattgtaatatgccatacatgacactacaaagatattataatataaaaggagaaaaaactggaaaatagatggtaaatgcagaacactcactataggtgattccaacagacaaatcaaaagataacattaccatgatcttgacgacttaaagaaaccaccaaagagctcaaaacagaaataaagaggtcaggggtaatatggtgacgtgagaagagaagaaacatacactgatgtagctctccagagaactgaagggggaaatttttttttttttttttgagacggagtctcgccctgttgcccaggctggagtgcagtgacgtgatctcggctcactgcaacctccacctcccgggttcacgccattctcctgcctcagcctcccaagtagctgggactacaggggcacccaccaccatgcccggctaatttttttgtattttttagtagagatggggttttactatggtctcgatctcctgacctcatgatctgcctgcctcagcctcccaaagttctgggattacaggcgtgagccaccgcacccggcctgaagggggaaaatcatcacagatatgaagatgattttgaagcagccaaagtaaaatagacactagacactgccgaacatagaatagaggatatgatgggcaggattatcaaagcaaacaaaacggaaacaacagcttaaaagtattagaaagaaaatagtatatttgggtgacgaggaagatcccagagatacatcacaatatatccctgaagaagagaattaaacaaatgaaacataaacaaagatataattctacgtaactttcaataaataaaagatttgaatttatagattgaaggagtctactatgttacagaaaatttgctaaagaacaatcaatactactctgtattatagatgtattgatagatcttggagataagaatgatttggtcacaccagcaggaatatcaagtaacctatacaagaccacagtttaaaaaaaacctcaggctaacctaagccttccttacagcaacattccaagattgcagagagtaatgcccatgaagccctcagtgaaaaagtatgtggccttagagttttatgcacagccaaactgtcattcaaatgtaaaaacaataaataaaacgtgtccaacatttaagaacccagagaagatgattcccatgagttattctttaaaaaactattggctgggcgtggtggctaacacctgtaatcccaacactttgggagactgaggcaggtggatcacgaggtcgggagatcgagaccatcctggctaacatggtgaaaccacatctctaccaaaaaaattaaaaattagctgggcgtggtggcgggcacctgtagtcccagctacttgggaggctgaggcaggagaatggcgtgaacccgagaggcagagcttgcagtgagcagagatcacaccactacactccagcctgggcaatagagcaagactctgtctcaaaaaaataaataaaattaaaaaataaaaaataaaaaactattaaagactttatctaagagatgaatgaagaaaccatggcaaaaggattttcagtgaacactgagtctgttttgcttttagactgggtctaaataagtgcagaaacttttgttatagaaaaaaaaaactaagctctgaatgttcataaatattttaactaatataaggataaggtggaaggtggtatgtagattcattcatcatctcatttaaacatgataaatcaagtatatttaaatatacttagcatacttactaaagtatattagtaaattaatatatttactgaagtatattagtaaattaatatatttactaaatatactaagtatatttaaatatacaaaaataagtgtaggaatgaacatatatgttagtttgaaatatatatgtaatatataaggtacatgtttaatatgtaaacatataatatatattaaaccaatgtttagtgcctattaaccaaattcaagtgatagaaggaagagaaaataaagaacaatttgtattgcttttagtggaaagtaaaatgtcagtgtttcaagaaacagagaagttaaatagctaaataagggttagttacaaaggtgatcactggaaaaattaaccataatacaaacctgcccaaatagcacaaggaatactcacaaaaagaaaatatagaccaaagagtagaagatttttttaaaaaagcaatagaaacagaaatcaaaatactataaagtaagaccaaacctgtttctcatatcaacaaataaaagtgggctaaactcccatattaaaaaaaaagattctgaaatcgagtaataaagtaaaacttaaccatatgctataccccatatatacctaaagcaaagtgtctcgcaaacttgaaaatagaaggatgagcaaaggaatattatcaaatgccaacaaaaaggaaagtagaggccaataatcttagaataaaacaaggttgaatttagaacaaaaagcattaaacaagaaacataaagacaattgtgtgataagatgtatcattcacaaggaagatctaatagtcattaagtgtttctgtatcaacgtagcctgaaaagttaagcaaaaactaccaaaaagataaggaaaaatagaaagactttaattataggaggcttaacagacaaaatagacccaaaagatgacatagatggcctaaataacataagtaagtagtaaagttacatatatcaatctatccctgaaaactaaaaatatgtcatcctttcagatgtccataaaacgtttcccagaactgactatactttagaccacacagaaaacctaaataaactccccaaatcagaaatcacactgatattgtcctctaatcactatgagtcaaaaaggaatccatgtgaatgtatagaatatttaaaattaatgataatgattataaccacattacatatcctatgggctcaactaaagcatttgctcaaaagaaaatttgtatacgtaagtacttaaattaatgaacaaaaaataaaggaaatcagtgcatatgtcttctactcacgaaattaaatataagaaaaataaagttaacctcaggaaaatataaggtagctatgataataaaagcagaaaataggaaaaaagaataaatctttaagttagctctttatgaaaaatcaataaatcattagtaaacaaaccaaaatggttgccaataagttattttctaggaaaatataaaattaccaggcatgaccccagatggagagaaaacaacaatctaaggaaatgaattagtatagaagaaatacagaatgtggagaaaaagcaaacctcttgaaagaaaacaccagtcctggaatatttcacagattacttctaccaaacctataaggaaaaaataggtccaatattatttaaaccaagtgaaagcatccaggttatttttctgaagctagcatgcatcatgcatattctgataaatagagcacacaaaaaagcaaactaaggaccaatattgcttatgaatatcagtgtaaataatcctaattaaaatattagaaaacaaatctaagagctcacaaagacaagaatttgctatgttcaaatgggatttagtcttaaaaaagtaagactatttcaaaattcacaactgtattaatttaattcataaaatattgtcaaaattaagaatcactttatcatctccataaatacttgaacaggtgtttgataaaattctctaatcttgatgaaaaactcataataaaatgctattttattatacagacagagacatacacacatacatataccaatacatacttagtaacatggtcccaaagctactgatacaactgctgaagaaagtgtcattaatgtcggctacaaggaaagataccttaatcaatagcattaattaacattattgctccagagagcctagctagcctaagtaaacaaaagaaaaaaataagcagagtaattttaaccaggagttaaaattatcatatatgcagatgatatgattatgtactgtaaaacacaaagaatcacatggaaaaaatagtataaacaataaggaaatacacttaggtgattgagtacaaaaatactactcatgttaatctttccacaaacagaaactggttagaaaatataactgaagagatcccatttacaataagaataaatttaacaagaaatgtgcccaaattacacaaataaaatttttaaatgctactgagaaacatgaaaaatgacttaaacaaatggaaaggcatactctgtttaacataaagatgtcttatctaaattaagttatacaggtaatgcaatgcaataaaaaaaaaaacaatagaatctacaggggtagattctaaagttcaagaacaaataaggaagcccaacccaaaagtttctgacaaaggaaaattaagaaagggggattagccctatcaaatattaaaatgtattgtagtccgggtacctgaggtcaggagttcgtgacctgcctggccaatatggtaaaaccctgtctctactaaatatacaaatattagctgggtgtggtagtgggcacctgtaatcccagctacttgggaggcttaggcaggagaattgcttgaacctgggaggcggaggttgcagtgagcccagcggcgccactgcactccagcctgggtgacagagtgagactccatctcaaaaaaaaaaaaaaaaaaaaaaaaaaaaaaaaaaaaaaaaactattgtaaaactacagaagttaaaatatatatgtctccatatctttttttatttttaatttttatggccacatagtaggtgtatatatttatggggtacttgagatattttgatacagacatacaatatgtaatcatcacattagggtaaatagagtatccatcacttcaagcactcattacctctttgtgttacaaacattccaactgtactctctcgttattctaaaatgtattacaaattgtcactgactgcagtcaccctgttgtgctatcaaatactagatattattcatttatatctctatatcctaacaaccaggaagctctatgtaagtgtctagaaatagaccaaactacatatgacaaattttttatttacatatcaataaaaaaatcagtctattcaaaaatgttattgaaacaactgaatacctctttagaaaaaaattaacaagcacaaacaccataaacaaaatcagaaaatgatatactgagaaaaatcatttacaaaggactattcttttttttttaatttaagttctagggtacatgtgcacaacgtgcatgtttgttacatatgtatacatgtgccatgttggtgtgctgcacacattaactcgccatttacattaggtatatctcctaatgctatccctcccccatccccctaccccacaacaggcccagtgtgtgatgttccccaccctgtgtccaagtgtactcattgttcaattcccacctatgagtgagaacatgcggtgtttggttttctgtccttgcgatagtttgctgagaatgatggtttccagcttcatccatgtccctacaaaggacatgaactcatccttttttatggctgcatagtattccatggtgtatatgtgccacattttcttaatccagtctatcatggatggacatttgggttggttccaagtctttgctattgtgaatagtgccgcaataaacatacgtgtgcatgtgtctttatagcagcatgatttataatcctttgggtatatatccagtaatgggatggctgggtcaaatggtatttctagttctagatccttgaggaattaccacactgtcttccacaatggctgaactagtttacagccccacaaacagtgtaaaagtgttcctatttctccacatgctctccagcacctgttgttccctgactttttaatggtcgccattttaactggtgtgagatggtatctcattgtggttttgatttgcatttctctgatggccagtgatgatgagcattttttcatgtgtgttggctgcataaatgtcttctttcgagaagtatctgttcatatccttcacccactttttgatgggttgtttgattttttcttgtaaatttgtttaagttctttgtagattctggatattagccctttgtcagatgggtacattgcaaacgttttctcccattctgtatgttgcctgttcactctgatggtagtttcttttactgtgcagaagctctttagtttaattagatcccatttctcaattttggcttttgttgccgttgcttttggtgttttagtcatgaagtccttgcccatgcctatgtcctgaatggtattgcctaggttttcttctagggtttttttggttttaggtcttacatttaagtctttaatccgtcttgaattaatttttgtataaggtgtgaggaagggatccagtttcagctttctacatatggctagccagttttcccagcaccatctattaaatagagaatcctttccccatttcttatttttgtcagttttgacaaaggactattcttcttaacatgttaaaaatctcttgaataaaattaaaaaacaacccagtggaaatagatagggcaaataatataaataggtacttcccaaaaagaaagaaacatgatgtaaaccattgaaaaaatgcacagtctcactcacaataaatgtatattaagactactgagagatgctgatttaaaaaaaaaagcctgccagatttcacattgacaaggatcaaaaagtttaatcacacattgttggcaacactgtagggaaataaggtaccctcatacatctttggtggacccatgaattggtacaatgttgattaggagcaaattgccagtatttatcatgcaacttgcatgtatctcctgactcagaaatttcacttctaggaattcctcctacattacacttgtgcaattgtgtgtacttgcacttgtgtgaatgatgtatgtacatgaatatgctttgtcatattgtttgtgagaaccaaagattacaaaccaccaaatgctggccaatatacattcattaccacaaaggtctggtcaatttagagaaagaaatcctatgtccacgaaggatataatctctaagaaaacaaagtgctgacagcatcatagagtatgttaccattattgtaaaatggcaatagtaataattattatataaatatatgcttgtgtatgaataaaatgccctgaaagtatactgatagagtttggatatttgtccctgcgcaaatcacatgatgaaatgtaattcccagtgttggaggtgtttgggtcatgggggcagaccccttatgtcttggtgctgtccttgcaatagtgagtgagtgctcacaagatctggttgtttaagtgtgtggtaccacacactcctccttgcttctgctcctaccacatgaaatacctgctacccgtttgccttctgcggtgactgtaagcttcctgaggcctccccagaagcagatgccagcactgtgcttcctgtacagcctgaagaaccatgaaccagttaaacctcttttcttataaatcacccagtctcaggtatttttttctttcttttgagatggagtctcgctctgtcccccagactggagtgcagtgacgtgatcttggttcggctcactgcaagctccacctcccgggctcacgccattgtcctgcctcagcctgccgagtcgctgggactacaggcgcccgccaccatgcccggctaattttttgtatttttaatagagatggggtttcactgtgttagccaggatggtctcaatctcctgacctcgtgatctgcccacctcggcctcccaaagtgctgggattacaggtgtgagccgttgcgcccggccaggtatttctttatagcaatgaaagagtggcctaacacgtatacattagaacctgattacagtagatgcctcttgggaggggacttaaatggccagggttggtgataaaaagtattttttaatgtatccccttttttatctgttaatttttttatgtgtatatgtattacctattcaaaaagttaatcaattttaaattaacttagatcccaattcaaactccacatctgctacctccagctttgtgacctagagcaaactgcaggccagctgccttctctgtggagcagggactgtcagaactcccccatcccagggtgtgatcagagctacatgagataatcatgggaaagtacctggaaattacatgtaattgcttagtaaatgccctccgcttctttccccccagaattaaagtaagctgcatctaactattacaacttaataaggtgcattattgtgctttgctgtgtttttaattttcttgtcatacctgaatggtttaaacatctggcttccttaaggcataattaagtaaaagagagagcagcgtacatcaccagtcaggtgtacttctttccctgttgtaaaagtgatgctttttattcagagccaagtctagatattcaccagtccttggcacgactagaaaaagatttgaaggactaaagctgctagagcataattatgtattggctgtggacttgagatgcctgggttctgtccctcctgactgtgacttagcagccgtttgtcactggagatgttttatgacttctgcaggcttccacagtatcacttgtgaaatgggaataactatttaatagctcacagaggtgctgtattaggttctccagagaaacagaataggatttacgttatatataacaataggatatagcctagatatatagatatatatatataaggatttattgtgggaatttgttcacgtgtttgtagaggctgagaagtgccacatatgccatctccaagctagagaagcaggaaagccagtggtaaaattcagcatgagtccacaggcccaagaaccagcagctctgatgtcccagggcaggagaaaagctggatgtcccaggtcaagggaaggagggaatttacccctcctccttctttttgttctatctgaaccctcaatggattggaagatgcttgcccacaccagtgagggtaatctttactcaatctactgattcaaatgctgttctctttcagaaacacactcacagtcatacccagaaataatgttttaccagctatctgggcaccccataacccagtcaagttgacacataaaattaaccatcacagacactgactagaatgcataaagtccatctagaaaagcacccagtacataataagcactcaacaaatatttttggaaaagtatcaaacactctgtgcaaggagcaagaaatggttcctactttcacggtctacacaaattaatagggagatgaaacaatggcccaaatcactagatcaccaagccatttaggagaagaaactgaagtgaagggggtaggcatgactcataaagagtaatttcctttccctctctaaggccccaccagtgaactggtggccacgttgactaactggagacaggataccaaggaggacagacatcattgtgaggtcccattctacgtaccccaaaccaacagagtcctctggaaggcctgagagctgttaggaacaagacgaaatgggtgtgagattgaagaagtcacaaaatgcagacattttaagctattctcccaaaatacattaaaaatcttactgagaaaaatgtgaaatatatacaatactcacttgcatatactatttcttattttattttatttatttattttttgagacagagtttcactgttgttgcccaggctagagtgcaatggcacgatcttggctcactgcaacctctgccaccctagttcaagcgattctcctgcttcatcctcccaaattgctgggattacaggtgcccaccaccacacctggctaattttttatattttttagtagagatggcgtttcaccatgttggtcaggctggtctcaaactcttgacctcaggtgatccacccacctcagcctcccaaagtgctgggattacaggcgtgagccactgtgcccaaccaacactatttgttattttagatgttgggaagttttcatgaaaattctcttgtccattctcatttacatgcacacacatacatatgcacatgcatgaacacatgcttcacggcgcttcttattaatccttattgggtaaaatcttattgagggacaataaaccagataaaatctccaaccactccctggtgccaagtctcttgggcccctcacactccaggtgggcaaggcagcatgccagtggacacagcatcacctgctcagagggagtggttgtggaaagcacagaggcaggcggcctggtggccaaggtccacaccacatcctcccaggtgggcactgtcctgagtaggcttaaactggcattgtctgtccagtaagtccttttctaaggaaagcaggtatcaactaattagcaacatgcaagtgttttcattttaggaaaagagaagaactctggaattatggggcctggtaaaggttcatttaagcgtcaagatcaagttggctaaacccatagtgtggaagcactctttgcgtagggtgagccaggtggagcagctgtgtgacagatcttggaggcagtctaagggcaatgagcacctggagaacaaagagggaggggctgcccacctgaggaggaagggacatgtgcaactgtctcctagatggggccctgagaactgccgggagacatcacagggcagcccctctccccacctctggctacacagtctcctgcccttctctactcagtgaattctgaggtcaaaggctactgtgccaaactttcaagtagagtgaagcctcctccgtggtgaactataaacttggatggcatcatgtccatttttgtgttcttcacagcacccaacagcaggttcacagtcaacgttagtgagggaccgagattgtagaagcaaatatttctccagcatcaggggtgttgcctcactaggatctaccattgggatcccaacccaggatgatggtttgaaaccttccggtccagttctcccccatttgtcagtctttgtccttgacaattaatgctgtaaatgcatgtactaaatgcccactgagtgtgtgtaacacacaagccggtgatatcagagtggcaccggacagggagcaacacttctgcaaaggagcaggtattccaagtccttctcatctttcctgagcatctgtcatttgggtggacctcactgcacccttcagctattagcagtgactgtaaatggagaagaagttctcgagaaccagcagcaccctgaacactcattaactgagaaaaattggagactcaaggaggcccaataccctcttactgaatacccaccttccttgtgccagggaggtcatagggaggttgaaaaatcaagggttttgccatgtgtctgagtttgattcctccaaaagggcattaacttttcatattacctctgcagagtgggatttaaaatctgtgttagtgacacgatatttcatttcagatccacagggcccacatttaaaattaatattgcatgcttgtcagaatgaattccaaaccctctcacagcaggccccttgtgggacctagagaaggagtggccaattcattatcgtaacactgggatgagggttccatcccagcttttgactgacacctgcagagattttttttttctgagacattttaagtttttggtgtgccccatcttcccagacaagctgcacgtttctgtcactctgtgctgtttccaaagcccagtggtctgcagggtacctttgaggggcctcctctgatccagttaatcagttcctcattgacaacatagacagagcatctggcccaggccagagagggctttcggccgagtccctctggaggatcagtctgtagagggatgtgactaaggcagcagattccgccaggattctgttagacacagaggacacaaggtcacctggccaaaagtggaggtcaggaagactcaagatctgggtccacctgtttcattttctcttagcatctgccctggcctgctgtcgtaaatcatcatcaccgagcttaaaaccaccctgtcgttcaaaaaaaaaaaaaaaaaatgagctatttggtttttgaacactttccttacagtgcgtagcagtttgttagagaggtgggcaggcattaggattttgtttataaccttggaataaactaagccaacagactgtattcttgcagggttaatgtcccctgctttacagtatgggaatgcccaacgaagtttttattatagagggtggaatatggtgcagtattcagtggagacaattgccccgggagtgcagcgcagaaagccacagctgcatctccacttggtgtcggccgggagctgcctcacctggggctccagggtccctttgagaccgcagttccatagcccgtgggtactgtccttgtgtcatcatcctctctctctctctctccattccagtcattcactctctccccctctttttctctgactgcctccaggcactttctttagcacagagctctggtgatacctcccactggccttgggcacccttcttcaaggccactcaccctgcatggaggagaggaagggaaggagtggccaattcattttcgtaacaaacacccaattttgtttttctccgtggactatccagatgcatgcttcttttacagttcatgtctgcgatactttgtcccttagagaaaaaagctgtatacaaatgtgaaattattccaattatctaatctctgttgcattcctcagccctgcaaagagttaaatgatgtgtaaaatcacctgttagcccgcattagacagggctgtatttacacacccagaggtggcctgtgaattatttaaccgaagggactcttggctcagcatctggctagacactgttgagcccaagttccttaggaggtgcagcctgtggccccagagcttcctcttggctggggaaaccgtctgacagacacggtgggctgctgccagaaccaggtctccttgagaacaacttgaactaagctcctcccagctccagatggttcacaaactagagaggagttttgcagagtcctgaacgctttgccaaaaaagagcgttggccatcttccaggccaggcggtaggtttgcctgcatgctgtgaatgccaggattattgttggggttttagagagtccatttcataacacccccagttcccatctgaatttggaaccaatgagagaaaaagggaaagcagtgagatggatggagatcaaaacatcacttttgtcaccaactgacctctcagagaacagggggagagtgacactggatgtcccaactaggaaccccagagtagagacacacttccatgaccagtgctggaaacccatctgcctcatgccaggaggcaggatcttgggtccctgtaccctggtgcagggaacggaaaggagccataccttctgcaagcacccagctcctcacaggaagccagggccaattcttccacctctccttgtctcatctcacttttcaggtgagcttcctttctctcctaccaaggagagggtgggggctgtggcaagagatggaggcatctggggaaaagccttcctcggggaaaacagcattccatatatctcccagggagatgggacctgcatatatttggaggaagaagtcatagagattgcaagagctggagaggattttagaagccactggaatcctctcattttactgaaggaaacagaggcacacgggtgcagcgaaaccctcatggttatatagctagtcaggggcagggctgaatttgtgtggcagtctgcagtttaaagccggtccctcatggtatggagaacacagcagtgggcatttcacacgcataatctcaccacagggggccaggctgcctcttggtctatgggactccaccccactgtgggtttcagggcaggttcccactcctacctcatctatcccttcttgggaatgggagatgcttggaggatgcacagtaattgaaatgctattcctggcaaatgatcatttccgggggaaaatgtgaatatcatgatatcaagtcaaataaagctgttaggttgaggctttgtccttgagctttttagactctgaacaggcagttgggaaggcagtcagctcctgcctgagtcactgggcaggacagccagcccagggaaagatgagggaagtgggggacctgcgttggtatctcactgggaggatgctgtggcctccccattcgatggagatccttgtcaggcctgcttttgcaaatgctcagaactccaggcagctctctggccctcttctttctgtcctctccatgcagctcccactgctgtatttactcggttggcactttccgctgtcagaatcacatttctcccagccactcactgtgttgcagaatctgtgtattgtcttttcttcagctggtgttttgggcttaagccctgaaatgctttgttctgggccccactacagcacccatactgtgtgctagagaaaacaggaaagggccctcaccatcacacccatgaccttggggaggccagcacctttgttgtcatacttcccaaaaccctccatcccctccctgccagaggagctagcacaatctagatgcccactggctgaggtttatttccagcactgcaaggtaacaggtacacacatacgcacaccagatttccattcccattaaatctctgcatccccaaatgagctacctgttggcaaaagctttttatctgtcagaagttctcaagtggaagttgtctctctctctttgctgcacgtgtgttaccacaaatgcggattgtgccggcctttctccatctcacccacaacctccccttaaacctccatctccaacacccccgagtcttcaatgcctcaggagaattctgaagccagcatataattgctgtccagaaagaggccccgtgggaacggaaaggattttgtgtgtgctcacccctacatttaatggggccatccttccccataaggctcagtgctgcaaagccaggagcccacccccaaggctcatgccaaaccccaattatctggagggcaactggccctgggagctgggccaagcacagcccctcctagctgcggaaagagccttcctatatgtctcgtttgacgcctacaaaaacctggggaagctggcagggcagggggtggggaggttaagcccatagggtggacaagccacagggctctgctccctcccttccccctcatttcttcacccctcccccatgaaaccatcaatcaccttgatggcaggagggaggggtgcttggctgaattgacttgaaaacactcagaaacccaaattgcacccacagaggcactcagaattcagggagatgagggatgtccgcctgaaacacttttttgcagtaatgtgttccgtgatggaagtcatctaattcattcatgaggggactgagacctcagaggaaagtggtgtccctgaaactagcaagggtcagaactacttgcagagaagccactaggaaggctttccagatgagactctccccctactcccactaatattagagggactcccctccctccagcatctccccacagggtctggctgcctcaggcttcccttggctctcagagatgcccttccactcaactgctacccacatgcttctacctgctgcacacaccctttctgtctgcagcctctgatatggtttggctgtgtccacacccaaatctcatcttgaattgtacctcctataattcccttgtgtcgtgaaagggacccagtgggaggtaattgaatcatgggggggcaggtctttcctgtactgttctcatgatagtgaataagtcttaggaggtcttctgcacaagctctctcttgcctgccaccatgtgactttgctcctcgttcgccttcctccatgattgtgaggcttccccagccatatggaactgtgagtcaattaaacctctttcttttgtaaattatccagtctcaggtaggtctttcttagcagcgtgagaacagactaatacagcccctcccctaggctttccctccttagagttcatgttgcagaccacttttccttccttctccgctactgactgcccccatccctgtttgtccagggttctcctgttttctgggttccctgatgagagttagttccttttagggactaattcgtcctagggaggactagattaatagactaccaagtcccctttccaaactgacttgcattttaagatggaaaagtgactcccagggacagggcattggctcaacaggtgcttctacagcttggccgtgacagcctgtctctacatagaaagggccaggggctgcagtctttgcttggagctgtgtttgtagaacaagcacactgtttttaacgtggtttatggttttgtttaaatcaggagtgtcgaatcttttgtattccctgggccacaatggaagaagaagaattgtcttgggccacacataaaatatactaacactaatgacagctgatgagcttaatgttttaagaatgtttacaaacttgtattgggccacatgtggcctgtgggccactggctggacaagctcggtttaaattgataagatattcgggaagaagatctaatcactctcctgccagcctctaccctgctgctaaaatgctttcacaggatctaggtcactggctttgataatcaccacagcttgtggatgtcctcctaagtctagtgccggaagggaactcggtattcctcagtgtgaactggaagcagatgaaggaactccacctctcactcaggtcatcatgtttctgttaatgcatcctgagatcaaattcacctttttcttttgctgccatattatattacaatttttcagttgacttaattgcaaagtatcttctatttgggctactgagtcacttatctctcaaattgtgtgttgttctaactatatatctatgccataagtataagggtttacatttattccttactttatgtcatcttaaaacaaatgaaagactactctaatcatgccacttctcactcctgattctagaaaacagtgtctttcttgaccctcctagttttaaatctggactatgaatctggcattcattcttatcccctaacattagacagagtattggctttcagaaagctaagctttgaagtactatatgttgtgtggcttactggagatcagacaatatgcaagaagtcaaattagttagtttggctcatggaaagctgtctaatttggaaataattaggtgtcatctcctgagagagagagagagagagagagcgcgcatagggagaggcagtggggaagaggaagagagagaggacagaaagggaagatgagagaaaatagttttcattacatgttaagcagaaagagttggaaaaaaataatttctatgatctgcaaagtcatttcaggagtacattagcttgctagggctgccatagttaagtatcacaaagtgggtgggctaagtaacagacaattattaactacagttctggagaccagaagtctacgatcaagacagggttggttccttctcggggctgccaggaaaggatctgttcccagcctctctctctggcctgtagatgactttgccccctgtgtttcttcacagtatcttccctctgtgtgtgcctgtctgtgtctaaatttcccctttttataaggacatcagtcattttggattaagatccacactaacaacctcattttaactcgattacctctgtaaaggccctatttccaaatgagatcacattctgaggtactgaaagttaggacttcaatgtctcgatttggagtggggcacaattcagtccataacaaggggattcccaaagagttgtcataggaatatcacccatcaggcaaagctcctggaagcagatggagccaccattaggaaagtttcccatgagactgtggtgcttctgatgtggctcagctctggaactgactcccacccccatcacccatttcaacctctaacccccaccacctaaccaacaccccctcccctgtaaaagcctttcttcttaagtcaggggtaaactttccacattattatggtccgtgtttccaatgcagtggtttctcagatctgcatcgctcctctctacctcctggttccctgcaactccttaacccacaagcagaggaaggagaagagaaggaccctattgtttagagcagaggtgctgggttctccctctacttacaaccttgccctctctcatttctcctgatgaccaggtagggtagacagcaacatccccatccaaacatgagcagtgaggtgacctggccggttcgatgagtggtaggcagcacagccacaggccatctccctcctaaatggggctgggcccaggggttttcctaggccctgcctgactatgctgcaggctctgccttacacttgctcatcctcctgttgcagaagagctacagggagacaagctacaaaaaccttttaatctgtatgattaacagaagcaattggcaaatgaccctgctgctctcccaaggggaataaggggtttattttcagatgctggtatttatcccactgaatttcattgtgcagcctacagtccatcaaatgcttcccagagtcacccagggtttcttcttagattaaaatcagaattaaatcagatagatacatgctttatcaaatctcattttcttggggatgaaaaataagtttctctttcagtctgtgatttcaggaacaggaagcaaagaatttggaagtttaaaaacacctttgcctgagcctgcatagcttattttttctccaggcagatatgggcctccccttgacaaggtgctacctgtaggcaggaaagtcctgctgcttgtcctgccatgtaatggaacttgggccataaggtggataaagataaggctgctctgagaagctgtattagttttcacaatgctgataaagacatacccaagactgggtaatttataaagaaaaagaggtttaacagactcacggttccacgtggttggggaggcctcacaatcatggcagaaggcgaaaggcacatcttacatggtggcaggcaagagaaaatgagagccaagagagtgagagccaagcaaaagaggaaacccctttaaaataatcagatctcaggagacttattcactaccatgagaacagtaggggggaaacccatgattcaattatctctccactaggtcctcccgtaacatgtgggaattaagggagatacacttcaagataagatttgggtggggacacagccaaaccatatcagaagcacagaattagtgcagagttggttaatgaaataatcattttctacataggtaggggagttaaatgatcatattttgccttttaagagtatcatataggaactcttacaaacctatacaaactggggcttgttatgtgagaagtgacgttggtgatacctgcttggaaagcataggtctccaatcccagctgctgtcctctgggagctgcacaaaagaaggtctatcacatgcttctgaagggagctgtagaagcttctgtggttattcatttgctacagatagaagaagaaattaaaaccaattgtgaaggaaagggaaatgaacattattgaggagtgagtaactgtgtggcaggcactgccctgagagattttgcctgcatgctcacctaaattttagaaataggactagctttaaaaaaataaaaaataaatttgagaaataaactattatcctttagaattgataaaaagtagttcatggatattagagatattttggtaaatatcactgtaaagcataaagaaaagaataaaaagtacccatttgctatgatcagaatgttgtgtcccaccaaaattcatatgttgaaacccagcccccaatgtgatactgttaaggggtggggcccttggaggtgattaggtcattagtgttctacctccatgaatgagattagatttgaggaagcctgtttggctctgctggcttatcaggacacatggaaagtgccgtttaagaaagcagaacaagccctcaccagacaccaaatctgtcagtgacttgatcttgaacttaccagcctcctgaactgtgagtaataaatttctattgtttataagttaccccggcaaagatattttgctgatagtagtccaaaagaactaaagaactaaaatgccattgtaccttagcccattctgttgaatcctttggtggctggattgaagagctgggcagtggagagaccagccaatttagaaagactagggggtgcctggtcatgctgccttctatgtaaagagtgggaagtggggcaatgcagaggacattttttggtgcaggaacaccatgaggggaaggactccaagtcttcagatgagatgatggtctctgggcagtcagttacagagcaggaacagcactctgatgtcacttggaaaggcactcatgaaagcagcagagcctgagctggtgtgttcggaggcagcattaaaaatcagcaggaaaggcatgagacatgaaaccaaaaaagggatctttgctgctgggtctcaggcaacacaaggaagaggtttgtcctgggaccccctgtgaggttctaggacctcaggtgctgttgggatcaggcaggaatttcctgaagtcagccttgtggttgcacctccttctttgcggccctcctggggactgttcttcttttttagactcatttaaaatcctcaaggggcccctctgctataagaaagcaccaagggaagggccctgcctttccagtttcccagcacctagcatgcagtgagtgctcaaatataatttatatttggaatgagtgatgattctctctgcttcccctttgggactgaccttgatgctcatttctacctgattttgcttataaattgtgaggagagttctctacactacaatttatctcagtatccctccccagctggtggctctcatgtgctcactggagcagtctgggacatcaaacatgaacaatgacatagtgaaagaagaaaatgcctggggaagataatggcactatctggagcagggagcctgccatctaaggaaatggtaaaaagaaggaggctccttagggcaggtttcaaggggccagaggaagccccaaatgcgtagaatcacagccaggtgctcaggaggggcagcagaagcagccctcaggacgaagggtagtggtcatcgtgcaaggcagacaagggccctagggtgcaggcaggctgggaagatctccagagaatgaggtgggccatctgggggcatcactttgacctgtagacaaagtgaagggagaggggagggtctggtgatgacagcctcagatgcagactctttaagccttctcaaggctttccagtttttgcagctgctgaggaaacttcattctcacccttcttgttccatctgaaaatgcacttctctccagagctctgggagactgtgaaaggctctctcattgccctgaaatatttttttaaggaatgagtatgatcttttctattctctacttctgtcccatgcagagcagatgtagaggaccaggagtgattcagagatgagaactgaatcttccctccagaaagttatgttccagagggaaagaagcggaacttcagtaacagagaatatgaaattggtcctaagtagaggtatgtggctctcgtgactggagcagagggagaaagacttgattcaggttcttgcctcgcagccttggaatgggaaaaaggaataaaaaatatagaacatgggtattagttcattctcacactactataaagacatagctgggaatgtgttatttataaagaaaagaggtttaattgacttgcagttccacaggccgtacaggaagcatggctggggaggcctcaggaaacttacagtcatagtggaaggcaaagaggacgaagtcatgtcttacatatctgcagaaggaggaaaagagcacaaagatggaagtgctacacacttttaaacaaccagatttcatgaaaactgactcactttcatgagaacagcaaaggggaggtctgccttcatgattcactcacctcccacgaggcctctgctctaacactggggattacaattcaacatgagatttgggtggggacacagggccaaaccatagtaacatgtataatacatatgtatgcaagtactggaatatcaagtttcctggaggaagtagcttttgagcagggcctagaagcatgccaaggatttggatgtgtttgttgtgggtggatgaagtccatgaccagcaagcagactcaggagagttttgcagataagtgtgtccagaagcaaaacaggctgggaggagtggtggtgctggaaaggtggcagatgccgaatgatggaggaccttgaattccatagtagggaatttggcatttattttgtagctgtgggaagccatagcagtttttcaccaaagagataatttacatcaattattccaagccctcagattcactccagttgctagttcagttgtttggttcaaggaagcgtcagaaaggaaatgaaccagaaaggatgagtgatcctagagtccagggtgtccttggggtcagagggaggacaaggccttatgttccctgccttttccaggaggaagaaattgtagtaatattccaggacactggatggacttgtttttctttggaaacaaggttattgacctctctgccgcagtaagagaaaaatgatatatatgttagaacttgaatatttttgtagaaacttaatattaaaggccttatgttcaaatatgcagcatttcacagtgctggttgaattatttgggctaggttgccacatggtgttccatgtacaattctccttggtaggctgggttaaaaaatgtggctaggtaaaatgtgagatgagaaataaaaaaggatctttgttttttcatgcttgtgatacttaaataggctactgtgacccaattaagaagctcccagaggccaggtgtggtagcttatgcctgtaatcccagcactttgggaggccaaggcaggcagatcacttgagttcaggagtttgagaccagcctggccatcatggcgaaactccatatctcccaaaaatacaaaacttagtcgggcatggtggcacacacatgtaatcccagctacttggaaagctgaggcaggagaactgcttgaacccaggaggttgcagtgagccaagatcaggccactgtactctagcctgggtgacaaagtgagactgagactctgtcttaaaaaaaaaaaaaaactatccaggcgtggtggtggatgcctgtaatcccagctacttgggatgctgaggtgggagaattgcttgtacatgggaggtgaaagttgcagtgagccgaggtcaggccactgcactctagcctgtgcaacagaggctttgtctcaaaaaaaaaaaaaaaaaaaaaaaaagttcccagaaataacctctaagccacccatctaattggtcccagagagatcaaaaaaaatgcagcattgaaaatggcgtggaggcaatgacttagggtttatagacaggcatcttccctgtcgtcatccctgacatcttccccaagtgggctaccacaggtcctaggtgatgactggttaggccatgaagctgttcagagggacagagagctgcagagtttggggaaatccaccccctgcttccccagaaggagaagatgcatactaatctgttttggagacaatgcagaatactgattagccaaatatttgctggtgatggggatcactgtgtgtattcgttttctattgctgctataacaaattaccatacacttaatggtttagaacaacataaatccattcattatcttatagttctgaaggtcaggaatctgaaaagatctcactgggctaaaatcaagttgctagcaggactgtgtttctttctggaggctctaagggataatcttttttcttgccttttccagcttccaggagctgcctgcattccttggcttgtggccccttcctctattttcaaaatcagtaaagtcccatctatctgaccccttttccatcatcacatctgtctctaaccaactatagctgggaaaggtcttctgctttcaaggacccatgtgattcactgagcatacctggataaccagggtcatctcccatcttaagatccttagccttaatcacatctacaaagtcccttttgccatgtgaagtcacatattcacagattccagggattaggacatggatctcttttgggggaacatttttctgccttctatagtgtgtattaaactttgatgcttatggcatggccccgttttcgtatcttcttccactcagctaaagccttaggtgagcccgggccaccctggcagctgccctggccagctgatgtggtgatccatggagccagctctggttcatgccaataatctcatttatccagcagtctcacttggccttgaacaatttaccgttcccaaatatcagcatgtttttctgtaaaggagtgatggttcccaacaagaagaggttgacacactcaaattcaggtaatttgaggagattagaataaaaggattttaggtcttctgcggttgctagaatatttcattggccagtatctattgtcctcatccgcactgttgctggccatctgcggtcagagattcctcagtccagggcctgaccaaaaggacttgctccacttacattgcaaagcaaacaacagattcttaaacaagaaagatgatgccttctaaagcttggctattccagccaagctcaggggaaagacattttccctaaagtatcaacaagccatttgatctcagacttagaaggtcattcttgtctgcttttttctcccattagatgaaagaaaatgaaatgttttccgtaaaagtaatttatgaagcactccatatggcaatattaaaactgtaaaagtaagcctccaggggacaaaacaaataatgctgtgtcatccgtctgccctggtactgtccctgggtaatgtcaggcacagaacgttggggaactggctccccactcaactggtacttggatgcctttggagcttttccttgaacattgttgctaaggttcatgaaatcttcagatttttgttatggaatccattcgcaaagcaaaatgatcttaagtgtaaatactaaatttactgtaaattgcagacatcactacctccaagacccttttaatatattgagtcccactgaatgctggaatccaagataaagttctttaagaatatagcactcatgtcattcatgtattcattcgttcattgatgcagtcattcaagaaatatttactgagtacctattaggattcagtggtgagcaaaccactctaatgggtgatacaaatgcaaattagagcgatcgttgatatggagaaaagatagagggtttaataagagcttataacaggataagcactgggacaccatggacagattttaggtaggggagttaaatggtcatattttcccttttaagagtatcatataggctgcagtgtgggaaacagatcagagaggcttcagggcctgcccaaccatcctttacgagtgttgtttaacgcaaggtctcgtggtagacagtgttacatggttaaccccatttccattctcctcttgccctgcttccatgtggtatagaggctggaaaagttaaacaccttcttccccacctcctgtgcagctcagtgtagtcatgtgaccctgctctggcctgagacttgagcagtgatctgttgaggtcttctgggaaggaatatgcttttcctgataaaaggaatgagtgcagctgttccccctccccctccttcccacctttcacagagaagggatgactagagctgggcagccatcaggcaaccacaagggaaagaccaagatgttggtgttcatagaatagagcctctgcagcaatgtcagcaccacacacatatggactgcttgttatgtggaaaatatcagcccccatctttggagattggatttttttgttgtggttactttccatgaaaagcattctaaacagatacagtgattcaaacataggcttagccgaaaacaaattaataggcattttgatcattgtcatagttagcgggtggaatccccaaattccacttgtgccattgaaattgcagcctttgaatgggatgataaaagagggttggaaagaagaagggagccgtgatggttttcttccacaggcctgtggtggcattcctcagtgtttcacttccaacctccttggaacccatgcttatcttagcttcagcctccaacacagccttaactgtaagcctagttccctgagtcactctgaaatgtattagtccatgaggaaggagaacagattctgtcttctacctgttttcataactgtagaaatgaacacagtgcatggcacttggtaggtgctcagtgaatgtccactaagccagtacgtacacacaaatacatgcaaaagttgaaaatcgcaatgcattgtgtctttaaaaataaaaaagagaaatagcctgatcttttggaacacatatggggcagagcctgctcaatgaagcatgcacattttggattaagaaatatgattatcatttgtcagctctgatttctgcctctgggctgataagatggtgtccgaggagtcattttcactcctttgcagacaccaaaacagaaggggtctttgctgaaaggtagactctgacgtgacagtcattagtagctagaaacaggcaactgattgcaaagtcaagatgaagtgcttcagtaaaaagaaccttcatgcttgaggcatactctttgcttctttgttgaagttgtggtagatttttttaaaaaacaatcacaatatagtttgctatactttaagtttttaacatctccactggggaaaaattgaaggagctaagtaaattagctcattggatcatgaatttatagaaaaaaaattaatattgccctttgtcgtttctgttaggagtgtcacgggtcaaagcagagacaagaggcatggagaaggagcagtgtgagggcctctccgggtcatttctctgtctggcttctgatgctatctgcccaacacagtttctgaaaacatcagaaactccccagttttgcccaacatgcttcccctaccttgcacctcttagtgcagagacatgttctgtgagaatccacctggtaagacagacaacatggagaggaagatctcagagacctggcttcctttcctgcccttcccttgcagacagagttttactttgtgaagtctccagtttcagaatgagaaacctctgttaagcaaccaggcctatcactgtagggatgagaaaagtgaagtccagataggtgaagcaacttgtcccaggtcaacacagcatgtcagagaagctgaggccagccagtctcctgggttctcccccatgttcttcctactgcccctctgcggcttccatttgtaaagagaggattgcttctcctcactcctctcgcacactcttgaggctatttcagtgaattgtgtctatctttttatatttcccatttaaaagaaaacccactctatggcataatggtttccagtgtcctgctgtttggaagaatgttttacctgcctgtcagtgctgagctttgagctccttgaagaaggacattctcgtggctgtggcccatccaggcagaaccagcctagctggccaagtggtttctctgcatcgtttggctgtcagataagggccacctgcttattgattggcacagtgacgcttaagtccaaacatcctccctaatgacacagaacttcatattaaaggatgtcagggaattgattttgctcttctttaggaacaaaagatgtcagaagttagaaggaactgaacagtcaggaaaacgtaagtctctataccttcccatcaccccatccctgacccacaagccatgatcggccagtggaagataaatctaaccaatcccatgggacaaagggagagagccctgcacagcaagacagcagcagtcattgggcagaaataaatcatgagatggttgagaatctgattctctgggtcaatttctctgcatcctcctctgcccttttaggcctgtgctaaactttccctttgatgcaaatggtattaagtgccttgtgtctgaaaaggttgttggcaggctttggttgagaacataaagatgaatctttgttctcttgtctataaaatggggatataataatctacctcctgtgagaattcaataattttataagataaagctcttagagcagtgcctggcccagagtggatactcaactaatgttaactaagaaaatgaaaatgaaaatccaggaatagtctctgcctgcaaaatgttttgaatgtaaggagggagatgagacgctgtgtatatatgcctctgttctgtatttttaatcaactactaaggccatagagaacaaagagttacccctttttaaggtaaaataaattatactcattgtccagcaaggaagaaatgaattgaaaatcctagaggcagaaaagtgcagagtttggagactaccaggtggcactgagactaaaagctttatttgccatgttcagctcaagatttaatgggttgtatagtgtaaggggctaactccaggatctgctggaactcactctgggatccacagcaaacaaagcactaaccttggcatatggcgctgcgagaagtttcctaggatcagccaggctctgggccactcactgggttcatgcctctgaacattaccttccaggagctgcccccattactgaacctaatacgctactcagaagttttgtaaccaaggttttctaaaagtctgagaaatagaagatgaactttagatttgataaacagggctgtacactggagtcaggtagaggtgagtaggaatcctggccttgccacttactagctgtttgaccttggataaattgcttaacctttctaagcctcaatttcaatgtctttattaaataacttttatgaccgggaaatcaattaaataatttatttaaaatacttagggcagtattgatcatgaaatagatgttctgaaaatacttataatgattttgatcagttcctgagagcccacttgtaattttcattgggtctgtactcttgggacttctccagaaaccatgacaaggaattttagagagtattacccgatattgtagtggactgtgctcaagaatcaaatacaacaatgtcaaaaatttgtctgacacaacaaagaaatggactacctgaaatagtatatatagtccctaagagttttaaaatagatggtggatggtaataaattgaatttctgcgttcttagaaagggtgattcagagataccccaattctaagagtcactgacactgaatgtcaagtattttttgtggcttcagaaatttctgataaatgcattttttcagagtgttgttgtatcataactttgctgtagagcaaaccacttcaaacttagtgatctataaaaataaacatttatggccgggcgtggtggctcacgcctgtaatcccagcactttgggaggccaaggtgggcagatcacaaggtcaggagatcgagaccatcctggctaacatggtgaaaccctgtctctactaaaaatacaaaaaattagccaggcgtggtggcaggcgcctgtagtccccagctactcaggaagctgaggcaggagagtggcatgaacctgggaggtagagcttgcagtgagcctagatcacgccactgcactccagcctgggtgaagagtgagactccgtctcaaaaaatatatataaaataaaaaataaataaacttttattgcttgctcatgagtctataggccagcttaggtttggctgatctagcaatgggttcagtaccatttgctccagatgtctctcatcttccttgaaataacaactattctgaggcgtgttcttctcatggtaagagggcaagagaagggagtaactacagccatgcaggtacatagcaagtccctgttcatatcacattcaataacaccccagtagccaggcaaatcatatggccaaacccgaaagggaaaaggtagacactgctcactatgaggccaaggcaagtattcaggtgtatattaataccatgggggagtcaggaactggggggcaataattccttcttccacacctgtgatgttgcagactgttgctggagtgtagtcttctttctgttagttgaggggattgtttttttgatctagctgtaacccctgatgagtgatgtacctcttagtaaattgtgggcaaacataaggaaaaaggacctctttagtaaatgagccttctaagattcagtcgtgtggtgaaataactaaactgagtggaggacaaagaagtcacagaaccaatccttcaaatccagcccgcagcagcagaggtgtaaacagttactatctaatgtccactccggggtctacctgaattgaattgttggtttccttccaattctcaatgattttctggccattttcatagaaaccatcaatgtaactgatacttctggtttcaaataatatgctagatcaaaagcataaattaccttgaaaatgtgaccatttttctagctctccttggctatcaataaataatactcaaattgctctaaattgttggattgagtttaggagacaaaggccagcagtaactgagatgattaacatgaattgggataaaactccctcttcagttttcatctaacagaatgcaggtcttcagagaatgattgtcttttctagcataatactcatctacctcctgaagggctgggagcttagaattctttctcactctcagtacttcttagagaaacccagaagagtccagtgagaatggtttccctgtttggctgattttctgggaggcagaatggctcaggggttagatgccattctgggatctatggctggattcaaacttggctgcacacctgggtagctgtgtgaccctgcgaaagttgcaaaggttggttaacctctgcagttgtccctgatgttgatcacagatcttcagttcccctttcctcctgtcacccagaggactgagtccctggctcctttgtggttgggtggtgctatgtgaccagttctggccaaggattgtgagcaaacatgctctatgtaacttctggattacactatttaatacccagtgagaaactctccagaattctctcttgtccccctggcacattgaccagcaacatgcaaggtgatgtaactccaatgagtagggttcccttgttgacctacactagacatgtagcatgacagagaaataacctttgtgctaagccactgacatttggggggttatttgctgccataacttaatccaccctaccctgattgatgcacctcactatatctttgtttctttatgtgaaaaaatggagataatagtagaatctatttcatcaagtaattatgaggactaaacaggataatgtgtgtataatacttagaatagtacctagcacataataaatttttaatatattttagctatttatgatgatgatgatgatgttatgccgtgctctaactttgcctctaacaagttatctatttctatcaaacaagttattagtcatgtgtcttcaagaaaatcacttatcatcaagttgcaatcatagtatgttagaataagtgagctgtaagactaatttctagccttatgatgtgagcctctattaagaactcactcagagactccatcctggtgtttcaaagatatttctattggttaggaaaataaaacgtgataatactaaacattattttctccccttcagttgctctcccttccccaaacaaaaagatgtatccttattacagaattctttctgtatcctgttctgaagatttctgctcaggaaattactctggctcgtaaattattaactacaaattggttttccggtttaggcacctacaccctcatcagtccatccccattctctgttctgttttcaccagtaggatgtcaacagtccactatgatcttttttcctgatagcatggtcttaccaaaaggagaagttcctgtccttgaccaccttagtccaggctaaaatagctatccacataccaccactcatgaccactgagacctgttttccaacttcttcagatcagagctttccatatctggtttttctctcatgttactctagatgtatccttctctagtcccaaaggtagccctgtctgcaattcccaatagcagcatgttaatctatgttaacatattatattgaaccataagaaattgcctttgtggaaggggtgggggttgaatatagaaatttcatatggttcaacctatatgtaaacccaatttggaaaagaaggagactgtgatcacatacctattaaattacatgttggatcccatcaagaatcctaatgtatttcttcctccataccttgttgaactgggatcttgttccaggacatgacttatgctctgtatataaccttcagacctccctatacccagcacttggtagatagcagatactgatgctgtatttattgaccaactagatgggagctttttgtgatatctattgttgacatccatgtttatacatttgggctgtttaaaaaggtaccatttataattacattatgggagaaaataacacttcttttctttaacctctttcagattgaagacatcattacaaagatgcaagatgacaagacagggggtgtgcccatcagaacagtcaagagctttctctccaaaatccccagtgtcgtcacaggtaacaccctccttgcaaggtgttggtaacagtcagaactaccaaagagttataagtctagattgcggcctgaggggtgtctgaagatctgtgaatagtaaaaatgaaacattcagtgtgtttcttgactcaggtcccatcctagtcttagtttccaggaagaagctacttgttgcccatcattaagaatgaccttaccatgaccagcccttcaagtgcatgtagattgaggctgctgggaataaataaacccattaataaagtggcgcatcagcaactttgcctgtgggatacacacaagcacagaaatattaaagaaattaaacaggtttttaagaaagtgttatattcaaattctacaaaatgcttttattttcagttttttaactcagtgtacttgacctcctgaaagagaggttttaaactatttttcttcattccttatattgtgctttgtgtgctcatctttcttttaaaatattttattgtgaaatatattaaaacacatgggtagttcaaaaataataaaacacagtacatgtacctaccatcctgccttataaagaacattattatcaatatcttagagcccccttgggtacctactgtattgcatccacttccctaaacactatctgcttgtatactaatcaattcattgtttttcttcatagttttactacctaggtatgtatcttttgctatccaaacaagtaaccaaataaattaagataaaattttagatgattctcttaatctgcctatatgcttttcaaaattcgggaaccaaaggacttagttttcactatataccttttagaatggctaaaaataaaaatattgacagtaccaagtggtggtgagcatgtgaagcaactggaactctcacatattggtgatacgaatggaaaattgtgcagctactttgggaactagtttggcagtttcttacacagttaagcaatgcttaccatatgaaccagcaatcccactcctgggtattcacccaagagcaatgaaaacttgtgtttatacaaaaacttgtatgtaagggtttatagcaacttttattgaagtatactgaagaatatagcaactttattcatcatctccaaagactggaaacaacccaaatgtccttcagtgaacgggtaaatggataaacaaactgtagtctctccacaatcagcaacaaaaaccagggaactattgatactggtagcaacttggattaatctctaggtcatttttctgagtgaaagaagcagtctcaaaggttacatgctatgtgatttcaggtatacagcattgtatacatcacaaaaccgtagtgataaagattagatcagtggtttccagcaactggcatttgcagggcgagtgtgactgcaaaagacaacaggagggagttttatgagatgatgatgatgaacagatgaacagttctgtatactgattatggtgatggtaacatgactctatacataggccaaaattcatggaacaggccaggcatgatggctcatgcctgtaatcccagcactttaggaggctgaggtagggggatcacctgaggtcagggggttgagaccaccttggccaacatggcaaaaccccatctttactaaaaaatacaaaaattagccgggcgtagtggtgcgtgcctgtagtcccagctacttgggagactgaggcaggagaatcacttgaacctgggaggtagaggttgcagtgagctgagatcgtgccactgcactccagcctgggtaacagagcgagactctgtctcagcaacaacaacaacaacaacagaattcatggaacagcacacacacacacgcacacacagggtcaatattactgtatattaacctaaaaaataagtagacccagttgaagtaagtatcccagctcattattgagactgtcactctttgaactcaggtactgtcttactcagctcaggctgctagaacaaagcaccctacactgggtggcttataaagaacagaaattcatgtctcacagttctggaggctggaagtctgagatcaggtaccatcataggttctggtaagagcccattccaggttgtagactgctgacttcttcttgtatccttgtttggtggaaagaaagctagatagggggccgggtgccgtgactcatgcctataatcccagcactttgggaggctgaggtgggtggatcacctgaggtcaggagtttgagagcagcctggccaacatggcaaaaccctgtctctactaaaaatacaaaaaaaaaaaaaaaatagctgggtgtggtggcacgtgcttgtagtcccagctacttgggaggctgaggcaggaaaatcacttgaactgtggaggttgcagtgagcagaggtcacgccactgcactccagcatgggcaacagagtgagactccatctcaaaaaaaaaagtaagctaaatagctctctggcctctctgtaaagggtaataattccatttgtgaggggccctccttcataaactcccccaaaggactcctaatgccatcatgttggggattagatttcaatatatgaatttggaggagacacgttcagtccaaaatagagcccagatagatttgggtaatgaaggatacttgtattgttagtgttctctaattttaaaatttatgtaaatgaaattttactatatatattattcatgtataatatacagtataatatagactatgtatgtaattttactatattatttttcacattcctggattttgttcaataatgtttaagatgtttgtatctatttcacaggccacactgatctgttgtttttcttaccattgttgctggtttgggtatcaaatttatgctagcctcataaatgagccatgaagtatctctcttttcttgatatcctgcttttctttgaaaaataattgtccctttaatccaggttttaagtatgtaatttcaattattttttatttttaaaatttcctctggttctttttttttttttagacagagtcttgctcttgtcacccaggctggagtgcagtggcatgatctcagctcactgaaacccccacctcctgggttcaagcgattctcctgtctcagcctcctgagtagctgggattacaggcatccgccaccacacctggctaattttttgtatttttagtagagacagggtttcaccatgttgcccaggctggtctcgaactcttgaccttaggtgatccgcccaccttggcctcccaaagtactctggttctttttacaatatacttggtcattcatttttttaaatttattcatttagatatttattgagtgttcactattttctaagcattgttaaggacttgagattcagaagtaaatgaaacagataaaaagttctaccctcatggaatttatattctagtagaggaggaaataagtaaggaaaacttgcagaattttagattgtgataaaggccaaggagaaaaataaaatacacaaaaggatgggaagtgttggagtgttgcagctttggaataggtgctcaagaaagagctcctcgagaagatgacatttgagtaaagacggaaaggagatgagggattgaatcatatggatattgagggagagagcatgccagacagccagagctcagtgcccaaggcaagagagttcctggaacattgaggatctgtgaggaggagccagggcagctataatagagtcaagaaaataaggagagtggggatgaagccacgtgagaatggtgagcttgatcacttagcctcttatcactgcaggattttgcacatggcctgacatgctctgacttacctttcaatgagatcactctattatattcagaattccctgggggattgaggggttaggtgccagataggaggctattattaaaatggtgcctcagactaggtgatatggtttcactctgtgtccctacccaaatcgcatctcaaattataatccccacatggcaagggagggacctggtggtaggtgattagctcatggggaaggttctcccgtgctgttctcataatagcgagtgagttctcacaagatctgatggtttaaaagtgtggcacttccccctgctctctctctctcctgccgctatgtaagacatgccttttttcccctttaccttctgccaggattgtaagtttcctgaggcctccgcagccatgtaattaactgtgagtcaattaagcttctttcctttataaattacccagtctcagatcattctttataacagtgtgaaaatggactaatacactaagctatcagcactggagatgtgtgaagtagtcagattcggattcaagtctgaaggtagatgatatggtttggccaagtccccacccaaatctcatcttgaattgtataatagttcccataattcccacatatcatggaagggacctggtgggaggtaattgaatcatgggggcagttacctctatgctgttctcatgatggtgagtgagttctaatgagatctgatgatttcataaggggcttttccctgtctttgctctgcacttctccttgctgcttccatgtgaagacaatgtatttgcttcactttctgccatgattgtaagtttcctcagccgtgctgaactgtgagtcaattaaacatatgtcctttataaattacccaatcttgggtatgtctttattagcagcatgagaatggactaataccgtaaattgttactaggtagtggggcactgctgtaaagatacttgaaaatgtggaagcagccaggcgcggtggctcatgcctgtaatcccagcactttgggaggccatggcaggtggatcatttgaggtcgggagttcaagaccagcctggccaacatggtgaagccctgtctctactaaaagtacaaaaattagctcagtggtagtggcacgcacctgtaatcccagctacttgggaggctgaggcaggagaatcacttgagcccaggcagcagaggttgtggtgagctgagatcacaccactgcattccagtctgtgagaccctgtctcagaaaaaaaaaaaaaatagaaaatatggaagtgactttggaacatgggtgacaggcagaggaaggaacagtttgaagggctcagaagaagacaagaatatgggggaaagtttggaacttcctagagacttggagggcttagaagacaggaagatgtgggaaagtttagaacttcctagagacctgttgaatgactttgaccaaaatactgatagtgatatggacaataaagtccaggctgaggtagtctcagatggagatgagaaacttgttaggaactggagcaaagataaccctcgttatgctgtagcaaagtcaggtggcattttggccctgccctagagatttgtgaaactttgaacttgagagagatgatttaggatatctggcagaaaaacatttctaagtgcagagtgttcaagaggtgacatttgacatctctggacacaagagagcataaaagtttggaaaatttgcagcctgacgaaccagtagaaaagaaaaacacattttctggggagaaattcaagctggctgcagaaatttgcataagtaaggaggaaccaaatgttaattgccaagacagtggggaaaatgtctccagggcatgtcacagaccttcaaggcagcacctcccaccacaggcccagagacctaagaggaaaaaatgtttatttttcctcttaggtccagggccccactgctgtgtgcagcctagggacttaatgccctgtgtcccagctgctccagctatagttaaaaggggtcaaggtacagctcgggccatggcttcagagggtgcaagcctccagccttggcagcttccacatggtgtttgtcttctgggtgtgcagaagacaagaactgaggtttgggaacctccatcttgatttcaaaggatatatagaaacacctggatgtccaggcagaggtgtgctgcaggggcagagccctcatggagagcctctgctagaacagtgcagaagggaaatgtggggttggagtccccacacagagtccccactggggcactgcctagaggagctgtaagaagagggccactgtcctccagactccagaatggtaggtccacccccagcttgcactgtgcaactggaaaagctgcagacactaaacaccagctgtgcaagcagccaggaaggaggctgtaccctgcaaagctaccgggtcagagctgcccaagatagtgggagcccacctcttgcatcagcataacatgggtgtgagacatgaagtaaaaggagattatttcataactttaagatttaattagttacctattggatttcagacttgcatggggcctgtagcccctttgttttggtgaatttctcccatttagaacaggtatatttacccagtgcctgtacccacattgcatttaggaagtaactagcttgcttttgattttacaggctcataggtggaagggacttgcttagtctcagatgagattttggacttggacttttgggttaatgctggaatgaattaagattttgggggactgttgggaaggcatcattgtgttttgaaatgtgaggatatgagatttgggaggggctggggtagaatgatatggtttggacatgtccccacccaaatctcatcttgatttgtaattcccatagtccccatgagtcttgggaaggatgcagtgggaggtaattgaatcatgggttggttacctccatgctttcctcatgatagtgagtgagttctcatgagatctgatagttttataacgggcttttcctctacctcactcttcacatctccttgctgctgccatgtgaagaaggatgtgtttgctttcctttctgccatgattgtaagtttactgaggcctttccagccatgctgtactgtctgtcaattaaacctcttttctttatttcccagtttcatgtatgtctttattagcagcatgagaaccgactaatagagtagaacagatattattagcggatagatcagatatggaatgtgagaggaaaaaaaggaattagccatgatccacactttttggcttcagcaactggaaaaatggagttgctattaatttcaatgaggaatactataataggggtgccaggggttggggtggggggcagttgttagctgaagggtaagaaatcaaaacacaaattttaggtcaagttttagcgacctattagacattcagttggagatgacaagtaagtattccagtatgtggatttggattttaagggagtgtctgtgctgggttcataagccatcagcatgtagacagtatttagagccataggaataatgaggtcaccaagggagtgagtgtagatagaacacacagtccaattcctaaaacacagggtactccaatctatagatgtgagggagagaataagaaaacagcaaaagaaatagaacaagtggctggagacaaggaggaaaaatcaagaggatataatttcttggacaccaatttttctagaaagtgttttaaggaagagtagagtgacctactatagctatgctgagaagctaagggctgagaattgatcattgcctttagcaatgctgaattcattgctgaccttggtaagtgcacattctgtgaaacattgggagcaaaaatccttattgggtgtgtccaacctgagatgaggagagtgattcgaggtgctaagacagttaatcttggaaggagtttcccttgtaaaatgaagaaatgcagtcatatctagaggggtacgttaggtcagaacaggtagatttttaatttaataaaaagataatatgtttgtattatagaaatgactcagtgggggtgggggagatgatgtaggagaatgggaaaacttcaaggagttatatcaaagaataggtaagagaggattgaatttaacatgcatattggtgagtagtttcagctagaaacacatacaatttattcatagaaagaagaaaggaggcagccgggcacagtggctcaggcctctaatcccagcactttgggaggctgaggtaggcagatcacaaggtcaggaaatcaagaccatcctggctaacacggtgaaaccccgtctctactaaaaatacaaaaaaattagctgggtgtggtggcgggcacctgtagtcccagctactcgggaggctgaggcaggagaatggcatgaacccaggaggcagagcttgcagtgagccaagatcacgccactgcactccagcctgggtgacagagtgagactctgtctcaaacaaacaaacaaaacaaaacaaaaaaggaagaaaggaggcataatagatgcacagaggtacaaataagtgggcagatgtgatgggaggtggtggaagcttatagatcttctcattgtctctatgttcctagtaatctggaaaccaaaaatggtagagattttgcaagttcaaggagagatcataagttataaattagtcaactaggaaagtagagattgactggactagggaaatagaactttgattgtgactgatatggtttggctctgtgtccccactctgatttcatctcaaattgtaatccccataatccgcacatgtcgagggagatacctggtaagaggtgattggatcgtgggggtggtttcctccatgctattctcatgatagtgagcaagctctcacgaggtctgatggtttttataagtgtttgacagtttcttcttcacagactctcttgcctgctgccatttaagacatgcgtgcttcccttttcgccatgattgtaagtttcctgaggtctccctagccatacggaactgtgattcaatcaaacctctttttttttttttttttttcataaattacccagtcttgggtatatccttatagcagtgtgagaatgtactaatacagtgaccttcttaggatgattaatatttttgaatttaaagacaggtaatttttttccccatccacatttagctctgtggatttgggcatgcctcaggtagaaagtggacttaattgatgttatagcaagtttgaggttataatagatcaagacagaggcacagtaactaaaatgattgcccattacatttaattgagtaaggatgaaaacaagaacatgagatggatgaggaaccatgaagagtagtaattaccacaaattgtaagtcaagtggcaaagaaattttggagttttcagaggcaagagtaagagagctgaaaatatagtagatggtgattagatggtggcatgtttgaaattgagattctggaaagattgtgattattggcagggacaataatataagatataaccataggaacaaggcattgaaatgggataaagtgtaagatttttggaggagaggaggttaaggaactgagaggccatgatactggaagactgagctgtgtgaatattgaaatcactactgggggagtgttagagaaggtggttgtgagttaaaatctttatggaatgagaagcaaaggaccagggatcagcagatgactttcacaataagaggtacaggtggtttaatcagatggtatgggagtcaaagctgagtgtgttttagagaagagggaggggatgaaggtgatctgaaagcagcagttagtagcaggacagtcacttatctacctgtaaaccccatggtatataaagtgtgggagggaaaatagccaccacgtaagagggctgcagggaagcaggaccactggggaagaatgagaagatgaaaggaatattaactgattttatttatgattcatcatgagtccaagagggcaagtggaagggtttcaggaggagatggtgagtttatgacttgagtaataaatgcctgctgttgctatgtgccaggctctagagtagtcacagacgatataaagatgaacaaagacttgacccctgctcttaaaaagctattaatctagtgagagaaacagacacaggtagatcaatgatttatatgagctatgtgccataatagaagaatggacaaaatgctgtttgagtccaggagagagaatcatgaatttttattgggtatgtctagaatatttctctgagaaggtatatcagttatctatttctgtataacaaacccacaaactataattgcttacaactacagtgatttattgtttcttatgattatgattccatgaaccggcaatctgggcagttctgctggtctcagccatgaggccatagtcatctgatggctcaactgaggctggagggtctacagtggcctcactcatttgtttggccttggtgcttactcttaaactcttaactggggtctcagttcttctccatgtcaccttgtatctgccaataggttagattgggcttcttcacagcctcttggtcttagggttccaagcaggacaggataaaaactgcaagacctcttagggcctaggctccagaactcatacaatgtcaagtgtgccacgtcacgttcttcaaggcaaattacaaggcaaagtctggattgaagaggatggagaaaccaactccacctcctggtgtaggagtggcaacatcatgttgacattgggagacacgattcattggagggcattaccataacaatctaccacagacaataattgagaaccggaccttaaacataagtggaaacccaggaaaagtcattccacgtagagaaaatagaattttcatagcctcaaatacatgacaaacatgccaggtttcagtaagtataagcttgtttgtgtggttggagtttaaaacacatttatgtgtgtatgtatttgagaagaggagcatattggcagaacagccacaggaatgaaaaggatacaagaattacacctaataatatattataaaggaaagctgacttgtagactttgttccaaaggtggggctgcttttatctcaaaggtaacccatctaccctgctcagatggactgccgtcagaggttttaaatatgagggaattcacatccatgaagtggatggaagtttaagcaggaagaaatgaggagtgtggagactagttatggagtctagatgagggaatgtatgtgagaaataaggccatattaacgacaaccacagcatcaactgaaaccatggctgtacagccacgcatcattaaatacttataaaaaccccatgagatagaaaccgttattatctctaccaagtaatggaggaaactgctaattcaagagtaacttttccaaggtcacaccactagtaaatagcaggatctgttcctctgggccacccgtgtaaggatggtagcagtagggttcaaaagatcagaggaaacagtagaaggtatgattgacacaacctgctgacttgaaatagagcagagggtaactcatccaaaatggatacaccttaatatcatggattgaatacattcatttaactttttctcttctgaaaccccacaaaaattatagtaaaagatttttattttaaaagcatgatctaaaagttggaggcctctattacagtgatctaccatgggaaataaacatccttaaaaatcttgaaaagatagtccagtacaaagggcagtcagtgcctcactctcaagatgtgcagatgtgtgaaagactcatggagaatagtcttccaacacaggagacaatagccacaaaactcaagaatctgaaaaacaaatggatgagtggtaactgacaatagccctgaaacaatctaaccatcacttgtcagtggacaaggctaaaaaaaaaaaaaaaaaaaaaaaaaaactctatatttatatgatggagttctcaatgggctcagaaactggtaacatcagcagacttttctatctagttagaatacattttgccaacactctcacctacttaactactgcacagaccaatcactagctagtgtctattgtttagcaatatcagatcctgcacttggccagcacagctcaggctggtgttgaggtggttcctaagaccagtcaagccccaggacagaagacaaatctcatgcttacctctagttgctggcactagagtagagaattacatagagaaaaaacccaggtcactgagacccatgggtaccaaacttaaagttgaaacgcattaatacatggccaccctgttactgtggcaagagaagctgtatctacatgggacagtaatcagcccacacttcagcctttccaccagctcagcagcctccatcagactttctagccatttgagaaatagccagtttcccatcacaaaccagcagataccagcagatactccaacattggagcttccatttcaacagcaacagctgggggaataactttttctcttctctattgggaccccagttctttaataaaaattgaaagtaaagatgaaagaataatggacattataaggctggttaatcagcagtgtctttatttcttgcactgctacataacgtactgtccatacctacatgtgactttgctaaataaacagcaagtgatttcaatggaagaaggcaagaagatggagaccaatggcacgatgatgacagtctgctggtgaaagcttctttccaaagatgatattgatgaggaatgcatgagcatgtcccagtgcatccaagactctgtcactctcagaagctctgggaagctgcttgtcaccactttctcagcaacacagtgaaagtcagagaataatgttgataaaaagtagtatcttgctgcaaggcccgtctctacactgtcaagttaccacattgagttgaaaattttgccaacatatccagatcatcccaaaggcgaaaagagaagcaactgttaatgacctacaccaaataaatcaacaaacacatagcaatatgcggatgtgtacctttgtagtggatcaaatgagcctggacaagaaactctaaatggaaagttttagagcataaagagaacattctagaaaaagaatgtacttgccaaaaaagtcaaaactgagataaaggaaaaattgtagacctggggaatgtgaatttggaaaaataatttatgggtactgaggatagagataacaggggaggtatagctataagcagagcagaaaattgatatccagttttccagaattcacaggtgacatagaagggaaccattgtaccaagtgatacacaaagatcagagttgaagagatgtgatttcgtccacgagtccctttaaagctggctttgtggtgtgtttgtttacaaccttcctaaggtgtcgatgtctaccagttggaacagtgacacaagagatggtaggcatttcttgactttccatctcacaaattaaatttgtttggtgaattcctgaaggatccatacagagcctggactgaaagcacctgtttcgatcttatgtgctgaaagcaaaaccttttctcatcaaatgtttctcttctttgtctttctggctttcatatgtgtgatctaacttcattggttacatctttattaataataaatatctaataaaaatgttaataaatttaaataaatacattgaataaaaataacctatattcatctaacctgttttgggtaaaggaggttcctatacccaagataaggacttgaggaagttatgggtttgggagagaagacacaagatcagtcttgattatgctaagcttgaggttttgaagggttatttgggtagcactgtttaggagaaacttggaagtgaggagccaaagtcctggagaacattttatgtaagagatatgtatggatttgggagtcatcagagtctgagtgacccgggactccagggtcatgactgggaactataattttcacatcttcttctataagccatgtattagtctatctgctacccagccttgagataacatgctcacccaccccacatcttctatgattttgagtttgaaattttcccaccaatatgtaagggaaattatcttccctgctcagatcaggacaaactcataggtgaattcacaggtattgctgggatgaagagggagaaggaatgcctgttggttcacctgtgggttcgaaatgttgggattgggaaggttggcccagggagtaaatgcactgagttaggggatagatatgtttgggagaaggccaaacacaagagataaccattagaatataatctctgtcttagaaagtgaaaaattaagagctgtaaggggtgaggtttagcaaataaatatttctgagcaaaaatagagaattggagagagaaggaaatacggaagaaagaagaacccaacatcagatcaaagtccaaggctcattggctttttgcaggggaagtcacatacaaaccatctcatcttccagaagcttaagatttctgagcaaggtgcccacagaaagggtacttcagagccaccctaccaatcccttttcaggactacagaccaacctcctcagaccctctttgaatagtaagtaggtaacaaagatgatcactggagccaagatggtgagtcttcggagtttccaacctcagcgtgccagctctatccacgccccacctgccctgcaggtgatagacatatcctgggcagaatgcctgccagccccaggaaagcagccagattgtgcagctttgcccagctgtcatagacagtcattccaggataattctccatcacctgaatgtcatgaagaattttccagggactttggagatttatttcttccagaccaccctcagaaacacaaattcctagcatgtaagagccataagatgcatctagtctcacttattcttgcagtcaggaagattgagtaccagagacatgatgtaatgtcctcaaaaatcacagttaaggacagaaccaagactggaatctggattcctcactaccattgcaaactgttcccatgatctcatgcacaaaattatagactcttggattgcagcagtttcttaaaggtgtttgatgcgttctccctgaacatgagaatcacttgtgtaacttgttaaaaatagatttccaggacatccccatgggtctggactcgggatcctctattttcagcagcttctcatatttatctcctacagcctgtatgaatttgggaatgtgtaagacccctacagagtgctctctagcctctgttttaacaatctgcaatgatggatgtcatctctccttccatctttggacaactttgaccttgagaaacttttttttttgtaataaacctaccagcctcctcttgcttcactgcattagtcccaattctacctctgtatcacaaagaatagaggaatggatttgattaaaattatgcccacctagctcttccttatgaaattttcttgcacaaataattttcagaaaatatccaaggtatatacatgcatttttattttacttaacacatttttttatgaatacatttctgtcttttcattatccacaaatttatttttaatagctttatgtttacctaaacatttaaaagtattattcttacagtttcttggcaatacagtttggagtctaggctccaaacagcctatgtgacctgggttggtcactgtgtgaccttgagctagtcaccaacctctttgggcctcagttttctcacctgttaattgataggtttggattaaatgatatttgtagtccattctgactctgatcttctgagattcttcacaggatatgtataaaggcctgtctgaagttaattcttttcactttttctcacgatgttctaactgaatctacctctgagttaatttaggccaccagttttgtcttaagatgtgtgtctcagtctgtcttctgctgttgtaacagaatgccacagactgggcaaagaagagagaaatgtatttctcacagttttagggtctgggaagtccaaaagcatggtgccagcatctaatgagggatatcccatggcagtaggcagaaaatggaaggtgcatgtgtgtgaactggggatggggggtgcaaactcagcctttttattgggaacccactccttggatagctaacccactcctaggataactgcattaattcattctgtagttaatgcttctcactttttctcaagatgttctaactgaatctacctcatggaaccctcatgatctagtcattcattaatgatcccatctcttaatattgttactgtggtaattaaatttcaagatgagttttggaggggacatccaaaccattgcactgtggtacttccagattagaaaaccaaagaacaagaaacagcctctgttttaataacgtgcgatgatggatggcatcatcactcattccatctttggacaactttgacctttagaaactttttttataatgaacttccctgcctccctcttgcttcaattcattcatcccaattctatctctttctcacaaatagagaaatagatttcccaaattagtaattccctgagaattgcccaaagttaatcagtattcttagtctttgttactcttcttctgcttctgtatcactggaaggaagaactttaaaaatgcctcaaaatagagataatttgttggatgcatgtagagggctgaataatggccccccaaaatatcagcttctagttctttacatctgtaaacatttgttgataaagggtctttgaaggtatggttacattaagtatcttcatatgggtaggttattctagatcagggtgtctaatcttttgacttccctgggccacactggaagaagaattctcttgggccacacataaaatgcactaacactaacgatagctgatgaactagaaaaaaaaatcacacacacacacaaaaatctcataatgttttaagaaaattgactaatttgtgttaggctacattcaaagccatcctgagccacatgtggcccatgggccatgggttggacaagcttgtcctagattatctgggtgtgccctaaatacaatgacatgtatccttacaaatgagagtctgaggaaaatttagtatagaaagaagaggagaaggccatatggcctcagaggcagagattagaatgatgtggccagaagccaaggatgccagcagccaccagaagattccttagcacctccagagcaagtatggccctgccatcaccttgattgtggcctggtgaaaccaactgtggacttctggcctccagaactgtgagataataaatttctcttgttttaagccacaaagtttgtggtgatttgttgcagcagccatagaaaactaatacagtgccaaaattacactaagcacattatagtttaaagtagatgacacaatgattttttttagaaaaattgtgattcattaactgaaaaaagaaacaagcaaaaatttagttttcttccaaagttttatttgaaaaaatatagattataatattaattttgaaagcaaattatactaacatgaacttatgtagtagaattatttaataagcattcagcttaaattgcttaataaagttataaattgtatttgtccaggtctaatgtagtttaaaatatcttttggatatcataactaatcatattatttccacgttcgtgatggaattaaatcaattagttataaaataaaatttattcttaattagtatgccaaaatttatacatacataaaataatctcttaaaatattcacttcgaaaagtggtatatttatttcagtaatgcttccattgctttgattttttcagatttttttctccagtaagagcttttagaacttgtttaaatatcctcaacagaagcaaagccatgaattcataaccatatatacatttatataatcaaaattgatttggagattctgctttggagaatggtagactagcctactcagaccaactgtctgaatgagaacaattacaaaatctggtaaaaaaaaaaaaaattcacttgatgtcactggagagttaacaagagaataaagagttactgggccaagattcatgctaacataaacatccatagatatgatggtggccttgggtgctgtttttgccctggggacatttggtaatccaagagagcacctgtcagacgatgcctttattaaggcccatggacattatctcctatgccataggggttgtggatttgctagtttaaagaaaacacatgcaaagatgagagcttatttacctgactctggtattgactattaggttttaccatggtcagcagctgtgggctgtgtcaggtttgggtcagggagatgaggaacaaggaggctacatcttaaccgcacggggaggggacgttttaacaaggccaaaggtgatgaggtacatcagggtaaacatgtgttaggcctaaaaatggatgtcaaggcagcaactatattaaacaaatttatgatgggcagtgattactgtttacctctaaggggcagggagtatattgtgattgggacagtacctgcaagagactaccagagtgttgaaaaaaaaattttttaacatcaatcatggtaacatgattaaaataatgtaaactgttcccacagtatttcttcttagcacttttctgtttgtataatatttcacaataaaaatagctttccttttcctttttccttttgttttacaaaaagtaatttgaagtcagttcggtgaataaagtctgtaattaaagagggaaatgccaattgtggtttaaataaggtgtgactctgggtaaatgaagtcagttttcttgttgtccttaaaagctgtttcataagtttatttccaaagagcatttccaaaaacatttgtagcacagccaatactgatggaaggaagggtgtggcttttttagggccaactctgaaaatgacagtgcttaattaaatattgattatgctgtggttgccttaacaaatgtaacttcactgtaacatgttttatttaaatgtatgaatttttcttcttatgggattcactttagtaacaacctcttaaaatcctgtcaacttataactgtgaaagcaaaggcatatctctgatgctcctggcctttgtgtcattaaaatcttactctaaatgtcgcattaattcatcttttcaacatttttccttgtttgatttttttctcctggaagaaaaaatgctaagtggaatgaaggaaggaaaagacaggcagtttattaaaagtcaaaatataccatacaaacccctaattgtactctaaaatttctttttaaacgtttctattaaaaaattctgggccgggcatggtggctcatgcctataatcgcagcacttttggaggccaaggcgggcggatcacctgaggttgggagttcgagaccagcctgactaacatggagaaaccccgtctctactaaagatacaaaattagccagtcatggtggcgcatgcctgtaatcctagctgctcaggaggctgaagcaggagaattgcttgaacctgggaggcagaggttgcagtgagccgagatcgcaccattgcactccagcctgggcaacaagagtgaaactccatctcaaaagaaattaattaaataaaacattctgtttccaataagataaaatttgagaagagaatgaaatccagatttagtgtagctgacccgggatcactgactcttttttagagaaggaactgggaaactgcagtggacatcatgctctggagcaacagtgactatggatttcactgtatcatcggtcgcagcatggaattctatacactaaaatcgctggatgagatgctggtgggaagaccctaacaaaatcgtgtttctgacagaaagtgtatacacattatgagcaaggagaacattagttttcagcttagctccttgtgcagttgaatttgttactctgttctgaagacattggtgccagataaaagctttaaacacaaaacgttgttactgacatgttaatataattatgccacgtattatatatacaaaactttaaaagctaaatttagaagttattgctgtatcatttatataggctttgttctccttaaacacgttgactttaataaggcatgttttgtacaaataaagtctaattctaccatcagttgcagccacaggaaatttgaagtcatttttatataaaatttaaattccaacacttaattcaggttctatgacaccattttctagatccaagaaggaaatcattggctcaggattttctacagcgatctatcctgtatgttcctcagataatatgcccctagaatattattttttataagaattaatggcagaaacatttgagcttatcactgatggcatttgttgactatcaaaattgtctaaaacctcccacatttatccaggtataaaagtaaacttctaggttgggtgtagggtaggttgggagtcaaaagaggacactctatagagtcacagttcataggttttcctaaagaacactttctaaatctaaatttttcctcccactaagccaaatgaggagggctccagggaaatcactggtgatgattaggggtcctacaagaagcagggtgttaaccttctcactgattggattcttgctgagctgttgaacccatagctcatccttgcttctgctgccagagaggaaaatatggaaaagttcatgggccatttgccagagtttgtggatgtatatgaactgagactcttgaggctaagaggctgcatggggcagcccacaccaaaaggcaaatagggcccatattgtagtgtgatgcttaaggagaaatatatggaacactgacctccccacccccaggatccctgtgactcttggagggtcaagggagcatcatcatggagacagaagacagagaaagagaggaaaagaggaagccgagcccacccttttcctgtctaggtcctctagacaaagctgtgaagggaaaaaaaatagaagataaaatgggatttaaattttaaactggactaaattgcaagtgaccagaaagctaaagggtctgctcaagatgtcataagggaaaagtaaaattatttcccattggtacctcatcgagttcatattgttcaagaaactggatataatacctagtgacaaagagactaggacttctgttttgttcttgtcatacagccaaatattgttctggtcacacagccataacaatacccattggggcagaacactgaactggtaagaaagtaagggaaatttttagaggccttaaaatagaaagtgagaattcaggaaagtagactcgttttagattagtcttttctcagaggacatctgtccatcctgggtagtctagggcatgaattttaaaagcctatatgagtatcaagtaaaaaaattgagtagggtggcagtcagttcagagactcctgaagagcaatacgattattagatgagtagggggagaaggctttagagaaggagatgatggaaataatcgttttgtctttggctattaataggtgaaagacaggagaaaaagtctccctagaaaattcctaattccaaattctaagtctattcttgttggcgtgtctcactaaaccccatgtggcccaaaaattcaagcaaaaatttaaattgtctttttttttcccccactcagtaaagatttaatgatgaaaaaatgcaagttttataatacaaatatataaaattatgaaaacaatttttataacaatcatttgatagtctttttttaaaagactacagaaagtttaaaatataattttgtaattatagatataaacaatgaagttttataaaattaatcatttgatatttttaaaaaggctatccaaaggaatttaaaatcagaatgttgttgaaactgaacaccaactgtatctacatttatttctttttttaaaatactttaagttctagggtacatgtgcacaacatgcaggtttgttacatatgtatacatgtgccatgttggtgtgctgcacccattaactcgtcatttatattaggtatttctcctaatgctatccctcccccctccccccaccccacgacaggccgtggtgtgggatgttccccttcctgtgtccatgtgttctcattgttcaattcctacctatgagtgagaacatgtggtgtttggttttctgtccctgcaatagtttgctgagaatgatggtttccagcttcatccatgtccctacaaaggacggcattattcacaatagcaaagagttggagccaaccctaatgtccatcaatgatagactggattaagaaaatgtggcacatatacaccatggaatactatgcagccataaaaaatttaaactttctctatttcagtactgcccccagctaccaggaagaagcaaacacatctcctctctggagaagcacacattaaatacagaacaaaaaaatttccagataaaaacaaaagtcactggaaacataagaaaacaaaacaacataaggataagtcagcaaagagcacaaatggcagaatccaacacataaagattgcagacattgtaattatattcagattatagaataattattagatcatacgaaattgccatttttataggtcaaagctggtaactatctgcagttccatatgcttaacataatgtttttaaagaaataagagagtactggaagtatgttgaagaaaagaggattaaggattctcaaaaaggactagaagctttgataagtagccaaatggaatctctgcaaatgaaaaatataattgaaattagagacttaatagaaacattaaacagcagatttgacacagctaaacaaagagttgataaactagaagataaagcagataaaagtactcagaatgtatcacggaaaggcagaaacaaataatatgaaagagaggttaaaagacttgaagaagagagtgataaattctaacatctaaccaaattttgagaagtaaataacagagaaaatgggaagagcaattcttccccattgtctttattatttccttccaaatttaaagatctaatagttgacagtttttctgagtggattaaaagcatcgggttccaaaagccaaaaaaattccaagcaggataaaatgaaaacaaatctatatctagctacattgatgtcaaatttcagaacactaaacacaaaaagaatcttcaaaatgactagagagggccagctgaggagacttcacctgtgttccaagcctgagaaacagcaccatgggccacccctggcagacacgtccctaggctggctgagcagctgtgcacccatgtcctgggcctgagaaagagccccacagactgctcctggcaagcatgcccccaggccagctgagaaaccatgtgcccctagacagagtaacagccctgtggtcccaaccccagtgagccagaccccaagaaagctgacccactgtgtgcagacatatgcctccaatctgagcaacagctcagcaagcccacctctggaaaagttgcaccgctaccagcacaaactgtctaagcctaggccactgagacattcataaatatcgctagtatggattacagcttaagaaactactggagactatactactgtgtctacccagaagcaaagccaatgcactgcattgagcccacaccccaacacccacataaatgaataaatcttttcctattaaacctactccataaaattggaagaggtgactgtttcatcagatgtgtagaaatcaatgtagggacacaataaacatgaaaaagcaaggaaacagacctccaaaggaacacaataattccctagtaataaaccccaatcataaggaaataaatgaaatgacagaaaaagaattcaaaataataattctaaacaaattcagtgaaatataagaaaatatattcaatgaaatcatgaaaacaataagtcattattttaatgagaaattcaacagagatagatatcatttaaaatgaaccaaattctatggctgaagaactcaatgagtgaaataaaaaatacaattgagaacttcaacaccagactagaccaagcagaatttgttcttacttgaagacaggtattttgaaataatacaggcaaacaaatagatgaaattaaataaataataaaaaggaattaagtcaaaggatttatgggatatcattaagtgaacaaatatttgcattgtggacattctggaagaagagaagggaaaaggtgcagaaaacatatttaatgaaataatacgtgaaaactttccaagtcttgggagaaagatccaggaagctcaaagaaccccaaatagatataatccccacaggtcctctctgaggcacattttagtcaaattgtcaaaagtcaaagacaaacagcaaaagaaaagcttcaagtcacatataaggtaatctccatcagattgatagcagatttctcatcagaaaccatgtaggccaggaaagaatagaatgataaagtcaaagtagtgaaagaaaaaaaataaaacttgccattcaatattatgcccagcaaagccattctttagaaatgaaggagaaataaaaattttcgcagacaagcaaaaattaagaaaattcatcaccactagaccaaccttacaagaaacgcttaagagagtcttacatctagaagcgaaaagacaataaccactgtcatgaaagcatgcagaactataaaacttattgatggagccaatacacaaaggagaaagaaaaagaatcagaccatatcactacagaaaaacacccaactgcaaaaataagagaggaagtaaggaacaaaggatatacaaaacaagtaaaaagaaatcgataggatgataaaagtcctcaccgatcaataataaccttgaatgtaaatagattaaaatctccatttagatgtagactgactgaacagattaaaaatacaagatacaatatacagcccacaagaaactcatctcacctataaagacacaaatagactgaaagtgaagtgatggaaaaagatactccatgcaaacagaaaccaaaagcaagcagagtagctgtacttatatcagacaaaacacacttcaagacaaaagctacaaaaagagacaagggcattatatgatgacgaagagattaattcagcaagagaatataacaattgtaaacatatacacttaacactagggcacctagatatataaagcaaatattattagatctaaagggagagatagactacaatacaataatagttggggactttaacaccccactctcagccttcgacagatcatctacacagaaaatcaacaaagaaacatcagatttaaactgcactatagaccaaataatataaacctaacgacatttacagaatatttcacccaatagctgcagaatatgcattttttttcatcagcacgtggaacattctccaggcttgaccgtatattaggacacaaaacaaatctcaaaaagcttttcaaaatcaaaattatggccaggcatggtgtaatcccagcactataatcccagcactttgggaagacaatgcaggaggattgtttgagcccaagagtttgagaccagcctggacaacatagtgaggctttgtctctacaaaagattaaaaaattaaccacccgtggtgctgcacacctgtggtcccagctactcaggcggctgaggtgggaggctctcttgagcccaagagggttgcagtaaggatgcagtgagccatgatcatgcctctgcactccatcctgggcaatagagtgagactctatctccaaaaaaatattgaaattttatcaagtatttaatctgaccgcaatggaataaaactggatatcagtaacaagagggacatttgaaactatacaaatacacaaaaagtaacctgctcctgagtgaccagtgagtgaaggaaaaaatttaaagtgaaatttaaaaattccttgaaacaaatgtaaatagaaacacaacataccaaaacgtacgggacacagcaaaagctatattacaggcaagtttatagcaataaattcctaggttgaaaaactaaaaagatttcaaatcatcaacttgagatgcatctccagaaaccagaaaactgagaacaaaccaatccaaagttagtaggaaagaaatgataaagatcagagcagaaatgaacaatattgaaactgaaggaaaaaatacaaaagatcaatgaaataaaaagttggttttggaaaagaaaaacaaaattttaaaaacctttagctacacaatgaaaaaaagagaagactcaaataaatcagaaatgaaaaaggaaacatcacaatgaataccacagaaatacaaaggatcgttagagactataatgaacaactccatgccagtaaatttaaaaacctagaggaaataaattcctgaacacatacaacctatcaagattgaaccaagaagaaatagaaaacctgaataggtcaataacaagtaataagattaaatcagtaataaaaagtttcccaaaaaagaaaagcccagaattggatggcttcactgctgaaatctaccaaacccttgaagaaaattaatgctaatttttcttaaactattccaaaaatttgaagtagaggaaatttttcctaactcattctatgagaccagtgtaactaactagataaggatgcaaccaaaaaatgaaaaaggttatacaggttaatatccttaatgaacatagacacaaaaatcctcaacaaaatacaaaccaaatccaacaacacatcaaaaagataatacaccatgatcaagtaggatttatctcatgaatgcaaggatgattcaacatatgcaaatcaataaatataatacatcacatccatagaatgaaacacaaaagttatgtgattgtctccaaagatggagaaaaagcattcaatacaattcaacatcccatcatgataaaaactctcaattaagatggtatagaaggaaagtaccttaacataataaaggccacatatgataaacccacagctaacatggtactgaatggggaaatctttaaagctttttcactaagaactggaaaaagacaaggatgcccactcttaccattcttattcaacatagtaatggaagccctagccagagcaattggcaaaaaaataaataaagggcatccaaattggaaaggaggaaatcaaattgtctctgtttgcaggcacatgaacttatatgtagaaaaacctaaaggctatatcaaaaaactcttagaactgataagtgaattcagtaaagttgcaggttacaaaatcaacatacaaagatcagtagtgtttctgtacttgaacaatgaactaatgaaaaagaaatcaaaaaggcaatcctacttacaatagttacatttaaaaaaaacctaggaataaacttaaccacagaaatgaaagacctttgtaaggaaaactacaaaacactgatgaaagaagttgaagaggatacaaatggaaagacatctcatgctcatggataagaagaattaacattgttaaaatgaccatactacccaaaacaaactatggattcaatgcaatctctaccaaaataatgatattcttcacagaaatagaaagaatcataaaaatgtacatggaaccacaaaagaccatgaatagccaaggcaatcctcagcgaaaagaacatagttagaggtatcacactgctagacttcaaaatatactacaaagctgtagtaaccaaaacagcatggtactgttataagaatagacacagagaccaatagagcagaagagaacccagaaattaatccacatatctatagccaactgatttttgacaaagatgtgaagaacactcactgaggcaaaacaaaacagtatcttaaataaatggtccccaaaaaatcagatatccatatacagaagaatgaaactagacgctcatctctcatcctatactaaagccaactcaaaatggatcaaagacctaaatgcaaaatctgaaaatataaaactagtacaagaaaacataggagaaatgcttcaggacattggcctgggaaaagattttatgaataagaccccactggcacagactacaaaagcaaaaataaacaaatgggattatatcaaactaaaaagcttctgtacagtaaaggaaacaagaatgagaagacatcttacagaatgagagaaaatatattcaaacttttcatctgacaggaggtcaatatccagaatatgcaaggaactcaaatatcttgacagcaaaaaaaaaaaaccgaacaatccaattttaaaatgggcaaataatctaaacaggcatttctcaaaagaagacatacaagtgaccaaaaaatacatgaaacaagtgttcaacatcatgaatcatcagggaaatgccaatcaaaaccacaatgaggtatcattttaccccagtcaggatggctattatcataaagacaaaaataacaaatgctggcaagaatgcagagaaaagggaacttatgcactgttgatggggatgtaaactagtagagccactatggagaacagtatggaggttcctcaaaacactaaaaatagaactactatagcatccagcaattccactactggacatttatgcaaagggaaggaaatcagtatatcaaagggacatctacacccccatgcttattgcagcactattatatagccaagatatggaatcaacctagggtgtccaacaatagatggatgaacaaagaaaatgtggtatgaatatataggtatatgtgacggaatactattaggctaaggaaaagaataaaatcctgtcatttgtggcaacatggatggaactggaggatattatgctaagtgaaataaggcagataccacatgttgtcactcatatgtggaagctaaaaaatattgatctcatagaagtagaaagtagagcagaggatactagaggttgagaagggtagagagggggagagagttgttaaaggatacaaaattacagatagaagtaagttctagtgctctatagcactgtagaataactctaattaacaataatatatagtttcaaatagctagatggagaatattgaatgttttcaacacaaaaaaagataaatgtttgagatgatagactatgctaattactccaatctgatcactatgcattatatgtatcaaaacatcactatgtaccccataaatatgtacaatttttacatcaattttttaaataaaataaaacaactagaaataaaagacagattgcctatcaaaaaacgactgacagctaacttctatgtaaaaatggacgctacaaggcagtagaagaccatctttcatgtgctctgataaaataacaattagaattctacatgtaatgaaactatctttcaacaagagcaaaattatcatgcaaaagaagtgaaaggaatgtatcactaccctatctttaccaaagaaatgtctacaaaatatattttaggaagaagaaaaattatctcaggatgaaagtttgagatatcaaaaggaatgataaatactgtggtaagtggggcttaatctaaacaatcatggactgtataaagaaaaagcaataatatccactatgaggagttaataagaacccaagtgacttctaactactggaaaataagagcatgcaaattgggaaaggatataaacgtcctctattgttcggaaaaatggtaaagctacttagtagttttagactggtaagaacactcactggggcaaaaaaacagtgtcttaaaataaatgttgctgggaaaactggatatccagatgcagaagaatggcttcttaaaaagccattcttctgcatagctttttaagttgaaattaattaaagtcatgtagaatattaaaatttagtcacctgcattaataaaatttaaaacttatgctcatcaaaagatctattaaagtaaaaagaagccacaattggaagaagatatttgcagcacacaccaacaaagcattagaatcatgaatatataaaagacttctaaaaattgagaaaacaacaaacaatgccatagaaaaatgagcaaaaccatgaacaaacatttcatagaagagaaaatatacatgaccaataagcatacaacagttgctcaatgtcattaataatcatgaaaatgcaaattaattaaaactacagtgagatatcattttaattcactaaactggaaaaaattagactctgaccatgccaggtatgcacaagtgtgtggaacaaagggaatgctaatcgaatgctggtggaagtgtgcattcgcaaaccacattggaaaacgttgtggtgatgcctatggaagttgaactcttacatatttatgacttggcatctccactccaaggaatatattatagactagagaaacaattgtgcaagtgattgaagacactcatcttagcagcattgttcgtagcagcaaaattctggaataatccaggcatgacgtttggctctagaatggaaagagaaagcacattatagtcatatggtagaattatacaaatgaattagctataggctttaacaaggatacaattcaaaaacaatattcctgagaataagcacaggatatctcatgatcccaattatgtaaagtttaaaatcaggcaaaagtaagcattgtattatttagtgattcatgcatatttggttaaatggtaaaaatacatacttgaaaaggaggactaacttttgtggggaaagtagacaacaagaaatgtttaggtgtggaggtactcggtatcaatctcaaagtatactcataatgttttcttctttttactgggtggtgggtacctttattattttagaatacatctttatacttttacatatatgcttatgttgcattttgcaattaaaattttttcaagagtttacagttatataaacatatatactatatttacagccatgaaaaaattgtacatatatatatatatatatatatatatatatatatatacacacaaacacactagtatgtgtgtggatgggagagggagaaagattgattttaaaggaatataaaataaaggtgtatcacgaggtgggactaaatgaacacatttacttgcagaagatgaatttgactttactgtgcttttttggattgtgccgactcataaatctaactgggcttttagtagacaggagacgattgaacattattccatcttatgtattttcaaacagactgtattattttgggtgttgtgtgtctcacccacactgtcaagattctgtaaacctgcaacgtgatccattcggctgcgctctagttattatccaattatcatccattctgcttattaacaggcataaacagacagtatttctgcatggagctgataccctccattatgggtcaccggtcccgttcttaagtaggattgtgaaggaaaaaagcagagaacttcatcttcagtactaatttctctcacttaattccttctgttttactctttctcaagaatgggcatttatcctctactggtgaagaaagggcagagttgtaggagccatctacggtaaatgcaggctttcaaagggtggggggggacggtagagattttaaacgtaataataaaactgaacaaaatttgatctgctgtatgttatcactatgcaattctaaacagtgttagcatgaaaatattcctcccctagaaattattttgttgatctaagagtactgaattgctacagttacttttgcattgtaataatatatctgtaagcttcaaatcagcatattatattctacatggacgttaactcagagaaccaagagttgcacagggactgccagcacactcagtgacacacacacgttttgatcgtataataagtgcctaacagggtggaactgggcacagggcatgtctcagacctgtatggtacttttaaaaaaataagttaaaataaacactggggcatggtgatggaaaagatgaaaaaacagaacgtaagttatttcaatgttgtcactcggtgtggccacttggagtttatatttgcattttactgttgcatttgaaaattgttaaagtgaaagtgacaagtgcaagacacactctttttgtttggtaaatatacatttcagtccacacatgagaatagttattgaatgttagaagtatcttttaaaatgaaatgtatgttttttcctatcttttggttttaaaagtgaaagaaaaagaaattttagaaaatttaaccttatgttacttactagtataatttagtggttgcctaaattgtactgtttgcatacgtttcagttttattaaagatcacttattggctgttgtcagtaaagagaggatgttaaaaatgatgtgttctgagtgtcaaatccataggtgtactctgtgatcctcttttccgatcagttccccgagtgtcagtaggaaatctaaacagctaaggaccaagcacaggaggagatataaccaatggacttttaactgaggggacacggtttgcatattttttttatttttattttttattttttgagacagagtctcactctgtcacccaggctggagtgcagtggtgcaatcttgtctcactgcaatctccgcctcccggattcaagtaattctcctgcctcagcctcctgactagctgggattacaggcttccgccaccacacccagctaatttttgtattttttagtagagatggggtttcaccatcttggccaggctggtctcgaactcctgacctcctgatccacccatctcagcctcccaaagtgctgggattacaggcgtgagccatggtgcctggccggtttgcatatttgtaacggtgtctttagcacctgcccgtcatctttcctaaacttggtctgcttgagaacacaccttgcttgccatgtcgtttataggataattttccatgaatggaattatttgaatctcaaagattttgtcaaaaaatatattcaaagcttgggtgtaatagacattacacctgaaattacatcctttgcggttatctcaatgtactttaaaatgtttagacattatgctaaaaatatgttaaaagggggcgtcattttttcaatttctcttagggatcacacaaggaagaaaagtttttcaagactgctgatgtaaaatagtgttatcagacagtgttcacatttggagggattgttggtagccaagtctccttggtgtttcttgtgaaagaattcttgagaaagaaatatcaggcaattggggtatattccttaaacatatagtagggaatggggctggtgaatcagttctgaatgcctgttttcttctttaaaattccagccaatgatatgaagcccaggtatgtgggggccttttgatgacagtgagggtgagactaaggaagctgacctgccctgcccagggacacaaggctggctagcaacagagccaggacattagtcagtgtgtctggctctgaagcccccatgggggacactgtctcccatctcctttctcctgtgtttagccttgactttcaccttcaatgtcatgccagacaaagagttgctatggggcaagtgggaaaggcaaaactttttctgaactgctctttaatttgtcaatatagcccaaatctagttgcaatctggtacacttttagtcatgaacgagggtggaagaaagctaatatcacatgttgacctttcattttgccaccaagaagctctccttgaatattctgaaggagaacacgttcttgctgggggctggataaaccttaaaaatttcatgcccctgaatgagcatttcccctcatcacggacttgtccctggggctttcttaggcatgggcaggatgtggattgaaggaagaaacccagtgtcatgggcagcaaaggttgaatgtcttctgtgtctagtcctaacactgacttggagcccattcctcatcattttatcttactttctcccatctgaaaatatttacaaaatcatgtttgatgtcaaaatactaaatactatttggggggccgggtgtggtggctcacatctgtaatcctagcaatttgggaggctgaggcgggcagactgccagagctcaggagttcgagaccagcctggacaacacggtgaaaccctctctctactaaaatacaaaaaattagccaggcatggttttgcatgcttgtagtcccagttactcaggaggctgaggcaggagaatcacttgaaccctgaaggcggatgttgcagtgagccaagattgtgccactgcactccagcctgagcgacagagcgagactccatctcaaaataataataatagtatttggaggattttcccagagcatttgggaagcatttgtacacaaatgagtctgtgagcaaagggccaaggcaaggggcaggagctcagatgcaggctgtgttgatggggctcaaatccagagccccatgatccctatcccgtgctccactgcaccatcctattatcctattttgcattttatttttacattcctataaataaaaagtgcaatcaaataacttgaaatatggtattgcttttgtgcttaaaaataatctcagaaatacagcaaacatgccattcacttgaaattctaaaaaagggcaaaactatgttgacagaaaacagatcaatgatttcctggggtgctgggggtagcagtgggtaggaagagaattagctgtgaaagggcacttggaaactttttcagatgagagaactgctgtatcctgatggtgagggtggtttacacagctgtatacggttaccaacactcatcaaactgtgtgcttaaaacactgactatgcaatacctttatgcttatgtctttttataatttaaatagggagaaaaaatatgtattttgtaatatacatattaatacacattataagatatatataaatatcaataaataataccttatttggaaatagggtttttgcagatgtatataattaggcccaccctaaatccaatggctggtttccttataaaaaaaagggagagggggctgggcgcggtggctggcgcgcctaatcccagcactttgggaggccaaggtgggcggatcaccaggtcaggagatggagaccatcctggctaacacagcaaaaccccatctctactaaaaatacaaaaaattagccaggtatggtggcgggcgcctgtagtcccagctacctgggaggctgaggcaggagaatggcgtgaacccaggaggcagagcttgcagtgagccgagatcgcaccactggactccagcctgggtgacagagcgagactccatctcaaacaaaaaaaaaaaaggagagggatatttgagatacacagacacagagttatatattgtacattttacaaagaaaaaaatgtacatatatatgtatacctatatacgtatgacatccctttctattctgtcttccacaaatgtgagtataagtcttcacagtgggaagtaggaatgatcagagatggagtattagtttgccagcactgccgtaacaaggtcccacagaccagatggtttaaacaacaggaatttattatctcacagttctggaggctcagaatccaagatcatggtgggggcagggttggtttcttcggagacttctctccttggcttgtagatggccgccttctcactgagtctccacatcctcttccttctgtgtgtgtctgcatccaaacttcctcttcttgtggggacaccagtcatactggattcaggcataccctgatgacctcattttaacttattttcttctttgaggaccctatctctaaatccagtcacattctgaggtacatgggattaggactccacatatgaatttttggggggacacaattccacccataacagatggagaatagtgcttgaggtctttactaatttactcaccttggctctatttgaggttttctgccaggagcaggtattttataatttaaagtatacatatgggaaaacacacacacatacacatatatatatacacatatacacatatatatacacatatgtgtgtgcatatttcaaacaaggcagagatcatctgtgacccaaatatgtgctgatgagatcaatggactgtgctacttattggtcccataacatatcacttgtaacctctatctatgaccttccacgtcagtgcaataactaatacagccatcatacacagctgtgcaagagttaacattttattcttctgtgactgaacttctgtttcgagtcccccttttctcagagttgcatctcagttggtggggctgggggtgtctgtggtctcaggcagggaaggcaggcagctcttctggacctggccagagtacatggtcatttctccaggatggtctcccttagacagcctcattccctacctggccactcacatgtgttattgctgcaccctctgtcctgaccctcaggcttcttaagtttgactctgaagccgcactctctgggtttgaatcccagctctactcactatgggctctgtaccttggccacttcactttactttacttctttgtgctttgattacctcatctataaattagagctattcataatagtatctacttcatgtggctgttgggaggattaaatgagttagtatgtgaaaacatttgaaagcgtgtctgccccatagtaaaagctgtatactgtaagtgattcccattattagtagtagtagtagtattgttactgtgatgtcacatgcctcattggtgttttattttggggagcacataaagtactccatttgcctctcttagctgcaagagagaaattctcctgggttgtctcgggtccatgtgctggacccatatttctgctcctgcatcatgctgggaatacagattgtggagctggggtgcagggaggtgtatgactttgccagcttcctgtatttcccttgagaagtggagcggtgctaattgtccctgtcccggatgttccatcaactgtgtggtcccataccaacccctcaggggtgtctgcccaacccccaccccagctttctttccttctttacttagcatctactcctcaggagactgctttgcccagtatgccctaagataataaatgaccttctgagagtcaaatgccaggactcactcttggtctgtttgtcctcacccggctgctcccttgggggtaggccaggacacacactgggtgagaagcgtggtggaggaaaattatctgagttaatttatcaaaatacattattccccagtgacactagggaaaccttacagaggccccgccagcatcaaagagcaaggttctgtttcccatgttccgttacccgatccccagggcctgaaacagagtccagggaatatttggaaactaatcgtcatgagtggtagcatcctaagcagtaccattgtttacctcctaagatcccccaataattgtggttggctatttgttttctagtcatttagacacacacacaaaaattgtttttcaaatgagaaggggaatccacaacaaaaaactgtggctagcttattttcgagtttgaatgctttgtgtaaattaataaagttgaagtctatcccatgtgtataaaaatcttggagttatgttcattaatgagtctattgaattagttttcataaattcttctgattcaattgcatattcttaaattaacaacaaaagtccaacttgtatcattaaagactcaaaacagatggtgggaacagtaaagtgtaggaaagtgggaaaaatccttaaaaaataaacggttctttaaaataaatgaataccaaataaaacagaaaagtataaagagctatagttctttttttttttttttttttttaactgagacagagtctcgctctgtcacccaggatggagtgcagtggtgcgatctcagctcactgcaacctccgcttcccgggttgaagcgattttcctgtctcagcctcctgagtagctgggattacagatgcatgccaccacgcccagttaatttttgtatttttagtagagacggggttttgccatgttggccaggctggtcttgaactcctgacctcaggtgatctgcccacctcggcctcccaaagtgctgggattacaggcatgagccactgcacccggccgggagccatagttcttggtggaaagcaaagcttttcacatcagctagtgtagtgtctgaaaaagtcctcattatagatgggacaaaaagatttagtgggaagaagaaagagaacattgagacagttatgaaaagttttaattgtaaattttaattctcatgtgaaatgaaaattttgggatactttcacacacacacacacaaatgttatcctcagattaaaatatttatgtgggaaatgtttagaggtaaaatgtttagaggggaaaaaaccacttaccatgattgctgccagaaagggtaaaccttagaatcataatactgcagaatttaatgatcctttgtgagcttctggttcaacactcgttttacaagcaaagaaatggaggctcagagagattggttaggtgagccctgcaaggactcatggctaaatagtggtgaaatcagaagctaaagccaggttttctggcttttattccaggactgagatgtagtgacctgactctcgtaagtttctggcttcttccttttggagccacaggtaagcaccagtctagaaccttccactcagacttcatgctccagggttgtgaccagagcttacaagggtgttgtcctgggctggaagcagagactgtgaaactcaaatatacttaggcaaatgcaagcatatgaataaatcaccgaaatcaggacaaacagcttttcttagataaattgcccttggaaagaaaggtgaaaactaagccataatgcatgaatgtgttaattgtttttctcttctacagacactaatttattctgaagggaatgcttcatttccaaattctccttctactttaaagaaattcaaacttcaagaaaaaaattcaacaccatattgtgattgcttcaatagttaagaatttcggctgtcacgactgaaaaaaatcattagcaaaaactggccgtggaaaagggaagtctgtctagttcatgacaagcatccatcatcgtatgtgagttagtaatttctcacctctcatttgagagaggcaaggtacctgtgtgccattggggtgggctttccccgcagtgacagatccggatagatcaccagcctggctaagctccaagccttaaattcctttacttctcacccctgggccatttccgccacttttcctccatctcctttatccatttaacatctgttacatatatgtatatacacacacactttaagttctagggtacacatgcacaacgtgcaggtttgttacataggtttatatgtgccatgttggtttgctgcacccatcaactcgtcatttacattagttatttctcttaatactatctctcccctaggcctccaccccctgacaggccctggtgtgtgatgttcccctctctgtgtccttctgttctcattgttcaactcccacttatgagtgagaacatgcggtgtttcgttttctgtccttgtgatagtttgctgagaatgttagtttccagcttcatccatgtccctgcaaagggaatgaactcatccttttttatggctgcatagtattccatggtgtatatgtgccacattttctttatccagtctattattgacgtttaacatcttttatttatttttatgttttactttttgagacagggtctctgtcacccagactggagtacagtggtgcaatctcggctcactgtagcctctgtctcctaggttcaagtgattcttgtgcctcagcctctccagaggagactttgacaaatatatatatacacatacatacacaaatatatatatatatatttgtcacaaggatttgaccttatgcaattatgtttgctggttaagcagcctctgtgaggctgttgtctttacatctgaccatgagatgttggagcttgaagtccaagaggcaggtggtcagcagaggaagatggatatgaagtcgggagagcagggatgggctgggacccacaggcacacacagaacccatgaagacccaccggaactcaggtcagttatcgctgcctctctgggtgctatagttgtcctacaggatatgccggctcccatcatcacagacatacacacgcacctggcccaagagtcacagaagctgaaggaaaattcagggaaggtagagcagttgtgacttggctactgccccacccagcaacatgagccacagataaaacaggtgtgagctacagaatggctgccgcttccctgcctcctctgaatctcacatgtaagcatctcttgtggcccactctaacaagaaacattcaggaaaggagatctgggggagggggagcctctccaagctgacactttgcaagccacccagtctacaatgtggagaatggttgcaaagccttccacacttcttcctgccaatcctcaccctggtctccagggtcaagtgtgcactttctggggatgcagcctctccaccccacacacaagttgtaccgggaaaaactgagatttccagcaggcagagattgagaagcagcagctaataacattacaaggccatttggcagcagcgcaaaccttcaccattacaattagagcaagtggaggtaaaagagactctcttaatggccaaatcaaataaaaagtgacaggcttctgaagattatgttgaaccctgtatggcatgttaatgaaacaaagggtcagataccatttcatctgtggcttatctgcttagatagaagggatgtttttctgcctagtcctacctgaggatttccaagccacccctatgcatgaagatctgacacatttttgtccgcacttttctcagagtgttggggaaccaggactgagccagcagcgaaatattctgtgatgtaaggtggaatttagaataaaggtattttggtgatcaagcagctcaatggtccttaaccttgactgtaaccttgactgaatcacatgcaaagctttatagcctttctgatgtccaagctgcccagagatttttagggtgcacccaaggcatcaccagttagtaacgcatcccaggtgattccaaggtacaaccagagtctagaaccagggatctagtctaatccttttttcagataatgaagctaagtcatagagaagttaggtgtgttggccagtagtaaatacaaacagtagaacccaagtctcccaactcttaaacttatcaccttccactatatgccctgccatatctgctattgagaagagtgagaaacacacattaaaactgcatactctactgtgttccaagaatgggatgactttgaaatgcatgctatttgtagaatataggtagtgagactgatgcctggtcattcgcctacagccttaacacctcctggaagtctgattctttcagtttaccttgcccatagtgtgagacagagaaggaaaatagacgagtctcagaatgcattgttcagtggaatgcattttggaatgatcctacaaattacaggaaagctttaatcgccaataattaggtgtcttaaaaatggagttgtcttctggcgtatgctgacattatcagtccaagatagacttgagccaggagcctctgtgacagtatgctttagaaagagtgagagagggagcatgtgtaagctaagaaaacctttgtaaataagcaaagtcttattcaacctacagtctgtcctcagagctatcatttatcaggggaacccacccctgataattcaacatgagtccttttctattttccgtaagcgtcggccggtctgagaaacaaagggaaagagtacaaagagataaatttttaaagctgggtgtccgggggagacatcacatgtcggcaggttctgtgatgccccctaagccacaaaaccagcaggtttttactagtgattttcaaaaggggagggagtgtacaaatatggtgtgggtcacagagatcacatgcttcacaaggtaataaaatatgacaaggcaaatggaggtggggcgagatcacaggcccggggcgaaattaaaattgctaatgaagtttcaggcacgctttgtcattgataacatcttatcaaccgtaaaagacagacattcctagagcggccattttagagacctcccactaagaatgcactctctttctcagggatgttccttgctgagaaaaagacttcagcaatatttctcctatttgctcttgaaagaagagaaagatggctctgttccgcctggctctcaggctaccagacctaatggttatctcccttgttccttgaacattgctgttatcctgttcttttttcaaggtgcccagatttcctattgtttaaacaatttgtgcagttaacgcaatcattacagggtcctgaggtgacatacatcctcagcttacgaagatgacaggattaagagattaaagtaaagacaggcgtaagaaatcacaagaatattgattggggaagtgataagtgtccatgaaatcttcacagtttatgttcagagattgcagtaaagacaggcataagaaattataaaagtattaatttggggaactaattagcgtccatgaaatcttcacaatttatgttctgccatggcttcaaccggtccctccgtttggggtccctgacttcctgcaacaataattatttattttaaaagaaacaaaatcaaattattagacatttcaatctgtggtagtaacatgatattctggcatctactttcattatcacctttattaaaataaatttaaagaaaaatggcagtatgtttctgtgaagaccacgagtactcattttaaaggactcaagagttgcagaaaagtaaaaagaaaagagtaaaatcattttctaaatctcaccttccagaaataacgatgttgagcattaagtggacttcatttcatactctttcaaagattatgtaggcatatatatgtgtgtgtatatacatatatatggatacatccttagagaagttggctggctagatagacacactataaaaatggaatcatactctaatgccatttttaatttaaaaaatacatattcagatccactgtacttatatacagaagtaaatgaaactaaagtaacacgagaggaattctgaccctcatataattttttttactatccaacataattattttttttattatactttaagttttagggtacatgtgcacaacatgcaggtttgttacatatgtatacatgtgccatgttggtgtgctgcacccattaactcgtcatttaacattaggtatatctcctaatgctatccctccccttccccccaccccacaacaggccccggtgtgtgatgttccccgtcctgtgtccatgtgttctcattgttcaattcccacctatgagtgagaacatgtggtgtttggtttttttcccttgcgatagtttgctgagaatgatggtttccagcttcatccatgtccctacaaaggacatgaactcatccttttttatggctgcatagtattccatggtgtatatgtgccacattttcttaatccagtctatcattgttggacatttggcttggttccaagtctttgctattgtgaatagtgccgcaataaacatacgtgagcatgtgtctttatggcagcatgatttataatcctttgggtatatacccagtaatgggatggctgggtcaaatgatatttccagttctagatccctgaggaatcgccacaccaacttccacaatggttgaactagtttacagtcccaccaacagtgtaaaagcattcctatttctccacatcctctccagcacctgttgtttcctgactttttaatgattttcattctaactggtgtgagatggatggtatctcattgtggttttgatttgcatttctctgatggccagtgatgatgagcatttttcccatgtgttttttggctgcataaatgtcttcttttgagaagtgtctgttcatatccttcacccactttttgatggggttgtttgtttttttcctgtaaatttgttggagttcattgtagattctggatattagccctagccctttgtcagatgagtaggttgcaaaaattttcttccattctgtaggttgcctgttcactctgatggtggtttcttttgctgtgcagaagctctttagtctgattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaggaagggatccagtttcagctttctacatatgtctagccagttttcccaacaccatttattaaatagggaatcctttccccatttcttctttttgtcaggtttgtcaaagatcagatagttgtagatgtgcggcattatttctaagagctctgtccttttccattggtctatatctctgttttggtaccagtaccatgctgttttggttactgtggccttgtagtatagttagaagtcaggtagcatgatgcctccagctttgttcttttggcttaggattgacttggcaatgcgggctctttttttggttccatatgaaccttaaagtagttttttccaattctgtgaagaaagtcattggtagcttgatggggatggcattgaatctataaattaccttgggcataaattaccttggccattttcacgatatcgattcttcctagccttgagcatggaatgttcttccatttgtatcctcttttatttcatttagtagtggtttgtagttctccttggagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgcccgtttccaaagggaatgcttccagtttttgtccattcagtatgatattggctgtgggtttgtcatacatagctcttattattttgagatacatcccatcaatacctaatttattgagagttttttagcatgaagcgttgttgaattttgtcaaaggccttttctacatcttttgagataatcatgtggtttttgtctttggttctgtttatatgctggattacgtttattgattttcgtatgttgaaccagccttgcatcccagggatgaagcccacttgattatggtggataagctttttgatgtgctgctggattcggtttgccagtattttaccgagaatttttgcatcggtgttcatcaaggatattggtctaatattctctttttatgtggtgtctctgccaggctttggtatcaggatgacgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagagtgtatgtgttgaggaatttatccatttcttcttgattttctagtttatttgcatagaggtgtttatagtattctctgatggtagtttgtatttctgtgggatcagtggtgatatcccctttatcattttttattacatctatttgattcttctctcttttcttctttattagtcttgctagtggtctatcaattttgttgatcttttcaaaaaaccagctcctggattcattgattttttgaagagttttttgtgtctctatttccttcagttctgttctgatcttagtcatttcttgccttctgctagcttttgaatgtgtttgctcttgcttctctagttcttttaattgtgatgttagggtgtcaattttagacctttcatgctttctcttgtgggcatttagtgctataaatttccctctacacactgctttgaatgtgtcccagagattctggtatgttgtgtttttgttcttgttggtttcaaaaaacatctttatttctcccttcatttcgttatgtacccagtagccattcagcagcaggttgttcagtttccatgtagttgagcggttttgagtgaatttcttaatcctgagttctagtttgattgcactgtggtgtgagagacagtttgttataatttctattcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccaagtctctttgtaggtcactaagggcttgctttatgaatctgggtgctcctgtattgggtgcatatatatttaggatagttagttcttcttgttgtattgatcccctttaccattatgtaatggccttctttgtctcttttgatctttgttgatttaaagtctgttttatctgagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattagagcatttggcccatttacatttaaggttagtattgttatgtgtgaatttgatcctgtccttatgatgttagctggttattttgctcgttagttgatgcagtttcttcctagcatcaatggtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttgaaatgaatgaaatgaagcatgaagagaagtttagagaaaaaagaataaaaagaaacaaacaaagcctccaagaaatatgggactatgtgtaaagcccaaatctacatctaattgatgtacctgaaagtgactgggagaatggaaccaagttggaaaacactctgcaggatattatccaagagaacttccccaatctagcaaggcaggccaacattcaaattcaggcaatacagagaatgccacaaagatactcctcaagaagagcaactccaagacacatcattgtctgattcaccgaagttgaaatgaaggaaaaaatgttaaggcagccagagagaaaggtcgggttacccacaaagggaagcccatcagactaacagctgatctcttggcagaaactctctaagccagaagagagtgggggccaatattcaacattcttaaagaaaagaattttcaacatactgattttttacagatgccttatcaaaagagattatgaaagctattggaattgtaatacttttattaattaatggttcacttttatatagtatcagtgaacttcgagcaatgaaagaagatgattttaatgcttccttcatttctctatcacccacctcctgatttttatagatcattatcattcattcattcaaccagtgtttatttagagaatactttgtgtaaggcaccttcaaggtgctgagcctagagctataagctatcgatggaacagacaagattctcacacataatggggcttgcattttaatagaaagaaaaaataaatcactattttgacattgcgctgattctgttcagtaaccataagcctcataattgttcagtattgtttctatatttgaattctttctatgcatatacataagtagaagtctggcagactagagagatagccagactcacttttataaaaatgggatgatactataaattcacttccgtcgctgacagcccatcctccacctaccttcttatctctgatcctccctagcagccctatccaggtttccctggttagaaggagaagctcggtcttttccagattcacagggaaaggttcccaagcaggaggagtgaggaggagccaggtggcagggccaggccaggccaagcctttctccactgcttctctgcagaatttccttggctgctggttttggaagtgtgtgacattaggttatgtccatttccttggttggtggctgctgataaaaattttgactggtttcactattttgatgctataattcttcatttttttttaggcattgctaagttagataaatcttatgttcagtcttttctatcttatctttaccccaagtctacctccttaaaatacttttatgagcacaaatccctgatgtaaaatcaagccataatgtgtttcctggagtaggggcggacaaatatgttaactaaattctttttgcgtgcttcatgttggatcaattcttaaggaataattttgactgagcctcttttaagcttttccaggcctggcttgttttcctgaaaagcttcaaagcagagaggagaatctttgtcagttagctgggtgagtggttcacaagcctcactgttgtgacacactccgtcatttgtgagggcatcacagccattttgttaatagaaatacagagccaaaagtcaaacatgattttatatgtgtgagatgttgcccgagggaaagggcaaagaatgagaagagctggactgggcaactctcatgtgaccccaggtccctttcaaagttgagtttctctagcaagtttgggatttccaaatgtttctactgagaaaaaaaaaaaaaggaaacgtgcaattaaattagaaaactacacagctcttactgaagagctgaaattttaaaaagatgcttaaaataaagcaaggaagataaggagaaagaaacataaagcatccaaacctgaaagaataacattcagataggctaacactcagaaaagattggagtcttgccaaacatcctgaggtcagccgccaccacagcaaaaagactgtttgatttggagtgacaagaaagatgatgtgatctcagaggaaacagatggctcactaaagatatttgaggatattttaataaaaagaagattttaaaaggtgtgagtaggatacagggaaagtgacaaaagatggagcaagttggaacctgatgggagtaatctggggggaaggaacccatagcagaagtggtggctctcaatggtggagcccagccaatccgtgggatcgggcaggaagggagctgacccactgtctgctccacgacctcctggtgctgcctccccttggctgaacccagccagaaggcaaagagagacccattggtccattccgtccaagatctctctcagggctcagagcagcgtacagaaaggtagtgtttctggaggaacaaatagaagatatccagcagtaagggcaaggaggcacagaagtacttcctgcttcaaggggttgagtggctatggtagttgatgttgagaaggcagatgaagtaaaagcaacttcgcatatatctttcctatcaaagacaatggtctaactggaaagaaaacaataaacagggttgtgactaaaaactgggcaaatgatctaaacagacatttctcaaaagtaaacatacaaatggccaagaggtatatgaaaaaaatgttcaacatcaccatcatcagggaaatgcaaataaaaaccacagtgagatattatctcaccccagttagaacggctatgatcaaaaagacaaaaaataacaaatgctgacaaggatgcaaaaaaaacccacttatactgtgttggtaggaacgtaagttagtacagccactatggagaatagtatggcggttcctccaaaaaactaaaatagaactaccatacaacccagcaatcctactactaggtttctgtattgttttgttttatattttttgtttttttggttttttttttttttttttttttttgagaaggagtcttgctctgttgcctagtctagagtgcaatggcatgatcttggctcactgcaacctccatctcctgggttcaagtgattctcctgcctcaacctccccagtagctgggattacaggtgtgtgccaccacacccagctaatctttttagttgagatggggtttcgccatgttagccaggctggtcttgaacccctgatctcaagtcatctgcccactttggcctcccaaagtgctaggattacagataagagctaccatgcccagccccattactaggcatttatccaaaggaaaggaaaccagcatatcagaggaatacctgcaccccatgtttatcacagcactattcacaatcgctaagatattgaatcaacctaagtgtccatcgacagatgaatggataaagaaagtgtggtatatttatacaatggaatactattcagccatttaaaaataaaactctgtcattcatggcaacatggatgagcctggaggacattacgttaagtgaagtaacccaggcacagaaagacaaataccatatgatctcattcacatacagaagctgaaaaacagttgatctcatagaagtagagagtacaattgtagttattagaaactgagaagggtaggaggggaggagatggagaggttggttcaaggttacaaaattatagccagatcagaggaatatgttctagtgttctatagcactgttgggtgactacagttaaaaatttttgtatattttcaaatagctagaatagaagattttgaatgttcccaacgtaaagaattgaaaactctttgaggtgatggatgtgttaattaccgtgatttatcattacacattgtatctatcaaaataccactctataccctataaagatgtataattattatgttcaattaaaaataatgtaaggaataaacaatattgaaagcaaaagaaaaaatcccaaagtggtcaaagcaataagccaatacttaactcctttaagcccatctgcaggcctaaatgaatcttacctgagagtgctgaaagaaaattatgtttaatttccagaaagggtcaaaagagtacattattgaacctgtaataaagttactgaaattaaaaggaatgttaaagatctcaggtttcttgatttcaggaagctatttgatggagcctttcaaagtttggttggtaatgaatatgctggagaaacaccggccatacaagaaggtttccctgacctgggatggacagtcatgcacagtgtttactagtgttgctcgcatggcatgaggaggaaagggcacaggacccttctttttgacccactcctattcaagtttctatgaaggtcttgaatgaagataggaggtgtaggtcaaagtcgtggttatgactgtttcaaagtcagaaaggagaatcggttctgtggatcttacaagctcctttaagatgcctcaggctatgaagctgtgggagagctggaaattctggatggatgggataatatttcctgaagcttgagggaaggtgtttgctgaagtttgtccaatgtgctctgtatgaagccagaacccaatgtcccatctgccttgttccagcactgcctcggattccagatcctgagaaccaccctttaccccagggaaacccctgatgccaccttctctgctgccaaccattatgtggtgtgagctgtccccaggttgcaagtctctgccagcagccctgcatgcttcaagactctctgtgtggccccacagggcaagcacaacaaagaggtcaaatgacagaatttcaaaagatttcaactgatgaaccaaattaaaggacatgttaggtattggaattttccaatttacagagctagtttgtcctagcattggccagaatgaaggctgaaagagtggcagggctgccaccatggttactgcagcaggtggaattcgagtgcctgaattgagggaagtgggggtcctcctgcatcccgagatagcgagagcacctcagaagtgctggcttaggtggtggcacccactgtaagagaacgatgacaaatctcagtttctccctaggagagtgcccagcagggtgatgagccaggaagatctgtcaggatgaagagtagtgagaggaagggggaaccctggagaagagaagaacttaaagggattcacaagaagttgaggagggcagagctgaatgagacaaggttgcagggaaacagactttttaagatcagtgtaagggaaaaaaaaatccttgacaatcagaattgtttcaaaacagagtcagcagcttcttgagactgggtcgctgtgctaagaacgtaaagggggagctgggtggcaccagcaaagtggcaggaatgtgtccctgcagggtctttgctgccttccgaatcctctcctttgtgatcctgtaatttgtgagagagcctggagggtagcatggaaaagagagaggagaggacctgacagcagtatttccatcttgtcccctaacaattgcctaggcagtctcctctcagcagggaagcaaactggtcaccaaataataataattatccccctacatttccttaattatttaaacttctgaaaggacatcaaacacagcaaagagtcaatgacttgctttcagaagtgattcagactgtagctccacccataacagtgtcaccttgagcagtcacatatgccttaacatccttctttctaaagcaattccatcttcccaggttgattgttgagcgtttagacatgatgacatatataatctttatatatgtatatttacaagtatatgtttatggataaattttgactgcctgtaacccatgtggccttgtgtcatcacacataagttcactgaagctcccaacaaccagacttttggggaagtacaaacctccacattagcactaggtctccttgcctgcccctctgctggaagaatccctggcaggggccttctttggtgatgggattgaattttctatttcctgaaatgtaatcagctttcagtttcaatggtggtcacccccttgtaccttcttttaaagattggaacgctgtattggtttctcagggctgctgtggtcttcatagaagatgacccgcgtatttccaaggtttcctccaggattgctggggctgtctgcgtccagatgttaaggttactgtagacaataaatgggagagggtgaaggaaggaggatgtttagagaaaattatccagtcacctggaggaaaggctcttagctgcaaaagaggaaataagggccaggcacagtggctcatgcctgtaatcccagcactttgggaggccgaggcaggcagatcatgaggtcaggagatcaagaccatcctggccaacatagtgaaacccatctctactaaaaatacaaaaatcagccgggcgcagtggcacacgcctgtagtcccagctacttgggaggctgaggcaggagaattgcttgaacccgggaggcagaggttgcagtgagatgagatcgtgccactgcactgcagcctggtgacagagtgagactccatctcaaaaaaaaaaataagaaactgctatttagcacaacatcaaataagcagtttgttgcttatgtctgaacacttctgtgaaaacaggcaaaggcagtcgtgtgtaggttctggtgaccaggaactggagctgcacagaggtgtagaggctcccaaagctcgtcaattgtttatgaagggagtaaaggctggaagtcagggggtgggtgtcagtttctgccactagctaccagatttctcctaaagatgggaaagctccctttatagagctggagtgcaattttgtgttttctttgtgtttggcaatgtctgttactgacttgcaatagatatgcaacagtataggtatgttcatcttagtattttggggacaaaactcccaaaccagccaccacacaaatgtatttataggtaccagtaggcacctttggactcggagggaagtcagcctccttaaagccgtattcagtaaggagaatgaagggtaggcatggctgcagcttgggttgtgcccaccatgtggatatccagccatgatctcaatagtcaggttggtccacattgtccagatatctccatgtaacattaactcagactttatgaaaataaccggtgagaataaccaaagccacattgggtaatgaaaactgtatgtacaattttctttagttacattgatgttgttacatactgttcataattaattacattggtttgtaatgtatcatgtcctattgtattgtaggttctaataccaagaccctaggtgttcctctcttaaaagctggtgaccacctttaactcatgtggtaaaagaatgatagttctgggaggatctgcattctctctgtgtccatgcagcattgccccacactgcctgtgctgagctgcatgatcctcatagctacatcatagtctttgcttgtaggcttgtcgtttggagaaccgtcttggagtctttattggttgatgtcaatggaaagctctgcttccctctggatgtcctatggtattgctgttcctaatgtctttctaatgagtgctacgtgtctgtatgtgtgtataaagagatttatgtaaagaattggctcatgtgattacggaggctgagaaaccccaagatctgcatttgccactaagtactcagatatttggtcaaacatgattgtgagtgctgttgagtgctgtattttttaactgccacgtaatcccctcaaggtccgtgttattctagacagtaaaccgggagaggcttctaaagccccctttgtcaggaaatgttactttagaatctgaccttgtgtgaaacacagatgacagaacctctctagtgcaatgacattaaaatcctcccccagtacttgaagtgcaagggaaatagctcattgctattatggctggatcatctcatggcctctcaacagatcaagagcaccattactactgttgctttcttgacttgtgttttacttttattctaacatttgttgcagtctgtgttaaatagggaggtagaccaaactatgagaaggagccctatattggaaactgtatagccaactatgaaacctccaggcttactttgctttctcattacaggcggccttcccctctgctccactggagagagtcagagtaattggctcttgctttatatgaaggatatgctcccaaaaaagttgtatttaaatcaagttttaacaaaccgactcatgcttgtttatccacttataacacttactatttaaaggaaatgataaagagtccttttctgttgttacagcgtagttggcaaagctgtatcttctgaagactgacttgcactcagcagttttagatcaactcgagtctgtttatactaagatccacagacccctggtggttctcagatgacttgcaaattctactagtttttccaattgtgtgttttttgatgataacttaaaaattttttatgataatcttttcattgtttagtataataatgtacagataaaccctagatgatcaccttataactgagtgctgtcatgagatttcagtgcctttgttctcagtcctgtaggtaaccaagacttcatctaaaatcacatcacttgactttaaatgtttgcaagacacatctgactgtcattgggttgataaaatctgtcttgtcctcattttgtgttgtgtgggactctatcatcaggtacaaaagcaaaactcctttgccatgagcgttcacagttgaatgacttttttatagaccaagagtttagtttcttagagtatatattgaatcaatttggcatcatggaaatggcatagtacattagaggcacatactatgttaactgtcacaatctaatgataaagaacagaaaaggacatattacataatcggtgcatttctgttaaagtcatggcaagcttattgaactagttttatagcaatttggcaggataaaaatgatgggaggatggagtcatcatagggtgcctgccctgtagcatggacacctgggacacaccttgctggatgatgtcttctttgggttccatcttaatacatgacaactggaaataattctgtagcagaaagtagagtgtaaaatagaaaatgactcttattctgatgaatcaaagtttttaagccatatatgtcggagtacacttgaattacttctgtaaaaactagcacattatataaaaatcataataaaaacagagattccagtgaggggtccctcttgttcagagtcgaaagattcaagtcaacaaaaatggaacctgtaagttagtctttttgccactgttaaaagaaaaacactggacacaatacttttaacagagtttatgtgagcattagaggattcatgaattgggcagcacccagaaccagaaaaggttcagagagctctacccagcagcatgggtagtgagctttaataggcggaacgtggaagtaagacaaagaaaacatatttgatttgttagagtagaaagtccctagttagaggttagttggaggtttctgatggtaacttctctagtttcattttactgttcacattgggctttggtttgcttacctaggaacttaaagtgctgggaatgcttcggcttaatgacctcccaattaaaatttttttaacatcacttttatttatgatctacaaagtggcaactgcctatttttttttaattttattattattatactttaagttttagggtacatgtgcacaatgtgcaggtttgttacatatgtatacatggccatgttggtgtgctgcacccattaactcatcatttagcattaggtatatctctcagtgctatccctcccctctcccccaaccccacaacagtcctcggtgtgtgatgttccccttcctgtgtccatgtgttctcattgttcagttcccacctgtgagtgagaacatgcagcgtttggttttttgttcttgcaatagtttgctgagaatgatggtttccagcttcatccatgtccctacaaagcacatgaactcatccttttttatggctgcatagtattccatgttgtatatgtgccacattttcttaatccagtctatcattgttggacatttggcttggttccaagtctttgctattgtgaatagtgccgcaataaacatacatgtgcatgtgtctttatagcagcatgatttataatcctttgagtatatacccagtaatgggatggctgggtcaaatggtatttctagttctacatccctgaggaatcgccacaccaacttccacaatggttgaactagtttacagtcccaccaacagtgtaaaagtgttcctatttctccacatcctctccagcacctgttgtttcctgactttttaatgattgccattctaactggtgtgggatggatggtatctcattgtggttttgatttgcatttctctgatggccagtgatgatgagcattttttcatgtgttctttggctgcataaatgtcttcttttgagaagtgtctgttcatatcctttgcccacttgttgatggggttgtttgtttttttcttgtaaatttgttggagttcattgtagattctggatattagccctttgtcagatgaataggttgcaaacattttctcccattctgtaggttgcctgttcactctgatggtggtttcttttgctgtgcagaagctctttagtttaattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaaggagggatccagtttcagctttctacatatggctagccagttttcccagcaccatttattaaatagggaatcctttccccatttcttctttttgtcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggtaatgcgggctcttttttggttccatatgaactttaaagtagtttttttccaattctgtgaagaaagtcattggtagcttgatggggttggcattgaatctataaatcaccttgggcggtatggccattttcacgatattgattcttcctacccatgagcatggaatgttcttgcatttgtttgtatcctcttttatttcattgagtagtggtttgtagttctccttgaagaggtcattcatatcccttgtcagttggattcctaggtattttattctctttgaagcaattgtgaatgggagttcactcatgatttggctgtttgtctgttattggtgtataagaatgcttgtgatttttgcacattgagtttgtatcctgagactttgctgaagttgcttatcagcttaaggagatttggagctgagatgatggggttttctagatatacaatcatgtcatctgcaaacagggacaatttgacttcctcttttcctaaatgaataccctttatttccttctcctgcctgattgccctggccagaacttccaacactatgttgaataggagtggtgagagagggcatccctgtcttgtgccagttttcaaaggtaatgcttccagtttttgtccattcagtatgatattggctgtgggtttgtcatagatagctcttattattttgagatacatcccatcaatacctaatttattgaaagtttttagcatgaagcgttgttgaattttgtcaaaggccttttctgcatctattgagattatcatgcggtttttgtctttggttctgtttatatgctggattacgtttattgattttcgtatgttgaaccagccttgcctcccagggatgaagcccacctgatcatggtggataagctttttgatgtgttgctggattcggtttgccagtattttaccgagaatttttgcatcagtgttcatcaaggatattggtctaaaattctctttttatgtggtgtctctgccaggctttggtatcaggatgacgctggcctcataaaatgagttaggaaggattccgtctttttctattgactggaatggtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagggtgtatgtgtccaggaatttatccatttcttctagattttctatttatttgcatagaggcgtttatagtattctctgatggtagtttgtatttctgtgggatcagtggtgatatcccctttgtcattttttattgcgtctatttgattcttctctcttttcttctttattagtcttggtagcagtctatccattttgttgatcttttcaaaaaaccagctcctggattcatttatttttttgaagggttttttgtgtctctatctccttcagttctcctctgatcttagttatttcttgccttctgctagcttttgaatgtgtttgctcttgcttctctagttcttttaattgtgatgttagggtgtcaattttagacctttcgtgctttctcttgtgggcatttagtgctataaatttccctctacacactgctttgaatgtgtcccagagattctggtatgttgtgtctttgttctctttggtttcaaagaacatctttatgtctgccttcattttgttatgtacccagtagtcattcaggagcaggttgttcagtttccatgtagttgagcagttttgagtgagtttcttaatcctgagttctagtttgattgcactgtggtgtgagagacagtttgttataatttctattcttttacatttgctgaggagtgctttacttccaactatgtggtcaattttgaaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccattattattgtgtgggagtctaagtctctttgtaggtcactaagggcttgctttatgaatctgggtgctcctgtattaggtgcatatatatttaggatagttagttcttcttgttgaattgatccctttagcattatgtaatagccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattggagcatttagcccatttacatttaaggttaatattgttatgtgtgaatttgatcctgttattatgatgttagctggttgttttgctcattggttgatgcagtttcttcctagccttgatggtctttacaatttggcatgtttttgcagtggctggtactgcggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggtccccactctcttctggcttgtagagtttctgctgagagatcagctgttagtctgatgggctttcctttgtgggtaacccgacctttctctctggctgctcttaacattttttccttcatttcaactttggtgaatctgacaattatgtgtcttggagttgctcttctcaaggagtatctttgtggcgttctctgtatttcctgaatttgaatgttggcctgccttgctagattggggaagttctcctggataatatcctgcagagtgttttccaacttggttccattctccctgtcactttcaggtacaccaatcagacgtagatttgggcttttcacatactcccgtatttcttggagactttgtttgtttttattcttttttctctaaacttctcttctcgcttcatttcattcatttcgtctttcattgatgatatcctttcttccagttgatcacatcgactactgaggcttgtgcattcgtcacatagttctcgtgccgtggttttcagctccatcaggtcctttaaggacttctctgcattggttattctagttagtcattcttttaatttcttttcaaggtttttaacttctttgccattggttcgaacttcctcctttagctggtagtttgatcttctgaagcctccttctctcaactcgtcaaagtcattctccgtccagctgtgttccgttgctggtgaggagctgcattcctttggaggaggagaggtgctctgatttttagagtttccattttttctgctctttttttcccccatctttgtggttttatctacctttggtctttgatgatggtgatgtttttggtgtggatgtcctttctgtttgttagtttttcttctatcagtcaggaccctcagctgcaggtctgttggagtttgctggaggtccactccagagcctgtttacctgcgtatcagcagtggtggctgcagaacagcagatattggtgaaccgcaagtgctgctgcctgatcgttcctctggaagttttgtctcaggggagtacctggttgtgtgaggtgtcagtctgcccctactgggggggtgcctcccagttaggctactcgggggtcagggacccacttgaggaggcagtctgcccagactgcgtgctgagagaaccactgctctcttcaaagctgtcagacagggacatttaagtctgcagaggttactgctgccttttgtttgtctgtgccctgcccgcagaggtggaggctgcagaggcaggcaggcctccttgagctgtggtgggttccacccagtttgagcttcctggccactttgtttacctcctaaagcctgggcaatggcgggtgcccctcctccagcctcactgccgccttgcagtttgatctcagactgctgtgctagcaatgagcgaagctccgtgggcataggactctccaagccaggtgcaggatataatctcctggtgtgccatttgttaagcccgttggaaaagggcagtattagggtggaagtgacccaattttctgggttccgtctgtcacccctttctttgactaggaagggaatttcctgaccccttgcgcttcctggatgaggcgatgcctcgccctgctttggctcacgcacggtgcgctgcacccactgtcctgcacccactgtccagcactacccagtgagatgaacccggtacctcagttggaaatgcacaaatcacccatcttctgcgctggtcatgctgggagctgtagactggagctgttcctattcggccatcttggctccacccccccggcaactgcctattgttttacctgatatgcacaacattggccattagtgttaccaaagcaacatccatcacaagaattaatgcttcttgatttgaattttactcctctctgtctctgtttatgtgcattcatttgattgtacacttgtataagaactaaaagcataaaaagtttattcctacatctggcacagctcacgtctgtaatcccagcacttcgggaggccaaggcgggcagatcatgaggtcaggagttcaagaccagcctgaccaacgtggtgaaaccccaactctactaaaaatacaaaaattagccaggtggggtgttgcgtgcctgtaatcccagcttctcaggaggctgaggcaagagaattgcttgaacccgggaggcggaggttgcagtgagccaagatcgcactgcaccccagcctgggtgacagaatgagactctgtctcaaaaaaaaaaaaaaaaaagtttattcctagttttacatttgtagcattgaaattaaaagaatctaaataaataacagagcactgtgagaatttgttgtttaacagagctctatatgcattacacaatttcaaggaacattgatctgaatgttcctatccctcatggaccttgagccctgacaaaagttaataaagatgggtctccttttcttcttgtcccctgctttcagctctgaatgagaaaagttttgcaaatatgtcggtactttgtattaagcctaaaacttataaagtatcagatttgtaagttgactgtattaactttaatttctcaaagtgttctcagttaattaggttaacctaaaactaaaactataaagtgattcctcccctaccaagaaaaaaaaaattaagctgaaatcctctgtttagagtttcaggcctttgggctggactccacaacccttctcaggaagtagcagtagacacctgaccttaggctgtagtgctaatataacctgtgtcagtagctgccccattgcaaacaaggaaatgatcctctgaagtcaaactcaggaaggaacaagaacctgtctctctgagctctctaaagagtgtggttaagagtatgagcattgacaacagactgcctaggttcagataccacctctgatgccagttatgtgattttgggccagtttcttaatctctcaatgtctcaacaacatgagtctaataatagcatatatacccctataaccatggcatgaggattagacaggttgattggtgtgtataaaacacttggaacagggcctggcacagggtatgccttagtagatgttagcactgcatcacgactgctactatgattaccgtccctgtcactgttgctgctgccaccacaggcaggtcagtggaacgtcacccttcagggatttatcagcgccactccctaagcatgccacctgcatgaagggcagacatgaaattgtgccgccagcgttctggtttcttcagcgctccctgccagctgagctgtgtgaaaagcactcagctatgaaaaaatgagaaagattgattgaaatgttggtgaggtcattgtcaaatattctctgtcaactgaatgactgcaaatagggagatgactgcccccccaccaagtcagcctaggagggttcagtccttcatttattcattcacacatcactccttcactgtgccagccagccatgacaattaagtgcatttgggaggaggtggcagctgagctggaaagggggtttggcattatgctgggaaggtgtaaaaagccaggctgaagatttgggccgtctttttttttcccccagatagtggggagctggatttggagacaagaaacctttgtagaccctctggcactctctattgacagatcactgctaggaggcagtgtgactcggagaaccgcatgggctccgccaccagctctgggttccgcactcattagccagatgaccttgggctcattatttagcaagcctgcacttctgtttcctcacctacaaaatatgcataaaatagcagtacatacctcacggagttgttctggggcttaaatgagttcatctgtgcaaacatttagacgaagtgcttgacataatcagagctatgtaggtgctgttaattcttctttgccccactggtccccaggttccatatctgtaacaagaagcaactggaccacataatttcacatccttttatacccaagtttttgatcaagagagctcaggctgtactttaagcttaatgtgacagtgatttatagcatagcttgggggcgatctgaacacttgggggcagaaaaacaagttaggctttccctgtttccatcattctcccacctttcctccatctgcctgtccccacctggacatacatgccaaaagccacggcccattttactagatctaggtagtatgggaaaagaccatgaagcggacacatcatctgtactgccagtgtctctcttcaaaataaactttttttttttttgagcctgaatctcactctgttgcccaggttggagtacaatggcatgatctcaactcactgcaacctccacctcccgggttcaagcaattctcctgcctcagcttcccaagtagctgggataacaggcacctgccactacagccggctaatttttgtatttttagtagagatggggtttcaccatgctagccagactggtctcaaactcctgacctcaagcaatccacttaccttggcctcccaaagtgctaggattacaggcatgagccaccgcgcccggcccgcttcaaaataaacttctttaccaggaaataggattaagaggaggtagaaggaaattagagtaggatcagaaagatagaaaaaggagttttctctgaaacaataggacagccagatacaggctgagcaggcccaatgatggatagagaggcacatccactgctgagctctaacctagagagagaatgtctcaaaactccttgcatggaaggtgcctggaaatgtatttattctcctgttgtttattctcacctctcttcattcctttttctttcttctgtccttgaatcgcagcagataaaaagacaaatctgctgagaggatgcatgtcacaagtggtcagatgaattacagccatagcaccatatagataagaggcaaggctggcgcctgggcaggtctgagagggtccaggaggacacacaccatatcaaattgtgcaatttagcaaatggctggtggcagactgaaatgatagttaatctgttttccatgcactaaaggcttttgccaaactaagatttgctgtgaagacccaaagctggagcccacccagggagcgggctgccttggatgcgtttcccagccttctacagtggatgccagtaaaactaactagagacatgaatgggcaccaggataaacacaaggggatattttgttcttaccattagagaaggatactgctaactggcaagaagtcccatggttgttatcttttgattagtagtagtaaaaatactatttaaagctagtagcattttttgagagcttgctttacactgggtactttttcaagtgtcttacaagtattcgctcattttatctgcacggcagctgtatgaagagaatactgtcattatcttcactgcataggtgagcaatggaggcacagagaagttcagcaacttgtccaagctctcatagctgggaagtggcagagccaggctttgaactcaggcagtctgactcagagtccaagactgccggcctgaattgtaggagagagacagtgcgggtataccaggaaccaaatcctatcggctgaacatcagtgtttaagtcgagcccagatgctctgcacaaaatacaatgtgtctgtgcacatgtgactgttaatcagccatttccttggttcctgctttgtgctggccactgagctggaccctgtgggatggataaatcaatgtcagtcatgcccctggagacctggctgttgcaaaaaggctcctgaaatcatcataacccaaaagagaaaagggcaggtgctgaagagaagtataggtaaagagcagcaaaatcataaaggaggggagactctttgcctctgtggtatcagggaatgcttctcagagcgggtggcgtttgccctgagacttgaagtaggaatttaaaaacatagaaatgcagtggaacgggaagaaggacattctaggtggagagaagtagagcaaaatggtccaatctgcccccctaagggtgtgagacagagaagtggatgggaaggccaggaaggctgtcgccatgtgggccgaacatggggagggaggtgtttgtcagaatcagaatggactcagagggaagctgagctaaaagcttcaatttacagatgaaagaagaaagaatttggatatgtgactcactcagtgtaccaagttcgtggcagaagtaagtctcaaaccccaggcttgcctccaattttctttgcactgatctcctggcataaacatgtggctaacaagggtctcacaatgccaggagggtgttacgtttttataacctgttctatttgagggtctccaaaattacatatttgaagttaatattagccagatgctaactgtctgcaggcaagaataagcacccactttacattgggagaagctagagatttgggaatcaggatttgctgcagatactttgaggaatctaggcctctaatccacagtctcctaaattctggaacttctggcttaattacactttttaataaccagtcatcattgctgcataatttgtgaggtctggtatagtatgattcctgttcccttcagctaaccctgcccccacccccatcctttaataaacgtaaaacttttctttcctgtgaattcatttttttcccttttatcttttggacctttgcaattaacatattaatatttaattcatattacctgaaggtccaagaacacttttaaactcatgaaaaaccttcactagtaatttagctgctaccaaggtatccctgagccctcattatttgcctctggaaaatgccgtaaacgacatctaacaggcttcagctctgtacctctacaaataagaaattaagcagtattcagaacgccattgattattaatttaaaagaaatcaaaaatcaatatcacattcctgtaacctggcagtttttcttaactgaaggcagttgcctgcagaagccttgtggctttccagagcaacggcgccccttcgtggtgataatgtgaactgcaccccaggcgtgattgaaaataaggcagaaaggaatgccggcctcgagcaaggacaccggttcatgcccaaatcacttctgctttcagccaacagactgtttctgccaaaagatggacgcagctagattttttttttttttgtaccgataatctgtcttaaaacttggagaggatctcttttcccctgtgaagtcaggaaaatgacagcaagcagcatggattggttcgaataattttcaccagaaatgtggggtgaggggaagggatgggactggagtcagagcagtgatctggcgggatggggtgatgagccatacggagatgaggtgtggcgccacgggctgggagtcagggattatagagtgagggtggggtaggatcttcctggtcatcaaaactatgagaaatgtaattatttacattttaaactaagccaaagactgtattgaaatgtcttacacccagaacagagaagtggtatcaccaaagttcagaattcccagctctaacgtgatgcctttggggactgcctccccaccccaggctgacctaacacacccctttgagaaaagaggatttagtttctcctgactgtgaattgaatatgtgggatgtgcccctccaggagcttctaaaatcacctctgctttgaccttgaggggccgtggtagaggggagacagcaccggcttagaaaccccacggctcggctctagtcccagcatcagtggagcaccaaggggagaaagtattcatcactgaggtattttatgatatgtatattgttcctgggcagttgcaccccttatcgcctgcaccctgtgtacagctccccattcctcctcccttggaggccactgtgctatgtaacttgctgtgggctgcaagaaagactgggctcccgtttcctcttctgaaaggcaggaatcatgctcccggctgacctcacagaatcattccacagattaaatggcgatatggcttgtctgtgttcacactcaaatccacatgttgtgggagggacctggtgggtggtaattgaatcatgcgggcaggtctttcccatgctgttcttgtgatacagaacaaacctcatgagatatgatggtatcataatggggggaggttcccctgcacaagctctccctttgcctgctgccatctatgtaagacatgacttgcacctccttgccttctgccatgattgtgaggcctccccagccacgtggaactgtaagtccattaaacctctttcttttgtaaattgcccagtcttaggtatgtctttatcagcagcatgaaaatggactaatacaaatgggatgtaaaaataaaattcttatatacttagaacggcaatatgagctttacatctgagttatgctataatatcaatcaacatatataataatataaagtagtatatttattataagttataataacagagtgagatagcttagtaatttcttgttagtatctgcaatcttggggaaaacaaatctagagaaataagtccaaactggagctgcagagtcaagtgggcgagagaaagaagtctcgctttttttgttttccaggaaagctcaggtccagttcagcaggccagcccaagagactgggagagccctatgtactcaggagagcagcctcacccctcgtccttgtccaagattggggagtgggtgcccacagcttgtatgtgtccccatgagagtgggtgtcattatgaggagcatcaaagggccaagcacagtggtgacagatgtgggggaatttgccattctgagggcagaggaggtcaaacacaagtggactcgcttattaagcccagaaagagaactgggagaggaaggccaagtgaggatggaggcggagatccagggcccatctgcaagtcaaggagcaccgaggatgctcagcagcagagccaggagagggcatggagcggactcgcttgcagagcctgtagaaagaaccaactctgccgacactttgatttttaacttctggccttcagaactgggagagaataaatttccattgttttaacccacaaaggaagaaaaagactatcaagagtagaagggcctgacaggtggccacacggcaggtgagtcagagagttgagtcacgtgggaggtagtttagaaaaggatttgtgaagagggccatcccctagcagcgtgttgaatatagtgaggaatatgagatggaaaagaatctttttagagaacatgggtgccagacatagccacagacaaagtcgtgaaatagacagaaatttgtcccatttatggagactgtggttttccacccatatgtccccccaccccatgtcatgtttacctggccctcaggctcacgctgatggccctgggctgcttttttcccctcaaaagctgatgtctggtctctaattataagatacaagatgagatggaaataattgttaacaatgtattcattcaacaatggattgtgtaaaaaaaaatgtggtacacatacaccatggaatactacacagccatgaaaaggataaagtcgtattcttcacagcaacaggaatggagctggaggccattatcctaagcaaattaaagcagaggcacaaaactcaatactatgtgttctcacttataagtgggagctaaacattgggtcctcatggacacgaagataatagtaactgacactgaagactactagagggggtagggtgggagggggacgaggggtgaaaaacaaccagcaggtcctttgctcagtacttgagtgacgggatcatttgtctatcaaacctcagcgacatgcaatttatacatataacaaacctgcacatgtacccccgagcctaaaataaaagtcaaaacaaaatattcattcccaaatcatttactacatacaaatcgttaagtcaggatccctgctgtgacactagggattatagaagtgttgaaagcttcattctcatccagtcattcattcagtgcctggctggggttgtgataagcaaaagcaaacccatccctctccacatgtagcttccagtctcgtggtggcatttcctcagaggatgaagccatccaggtagcatagcaggcatgaggtggttccagtaaatggaggtgggacagtctccttgggctgccaccctgcttggggctattcctggtagggcctggagctctgcctagagaagcccacatgccctctcctggagtcacaagggcaggccaagtattctgtcctattccagtctttgctagaatgtgtcaagtgctgtgggcttgagtccttggcaatttttgcatgggacttagtttgggggtaagttttctggaaacttgaaatgtttcacttaaaaagaaaaatgcaggattcaaagaagtaaagagtaacaaataaatagaggcttttttagttcaggggtcagcaaactgagggcattgcagctgttctggaattaatgcgtgtccgggcaagggtcagtaattctgagatgccgttctgttgctttcaggccttttttggtgaaaactcttaaaggaggtataattcttcccttgctgggagtctttgtttcagaggggttgtaaaaaaagattcccagaggataaatcatatctgtattaacttcctaatgaaatgaaaaattatatcattgctgattattcctccttggctgatatggaaaaaaatactattaatactttttagtgtgattttaatcctttgcattcacggatatttgcattagtattttctggacatcatcttgtttatatggattttattcattgtaagatgccatcagatccaggcatctgagttctgggggggcaatgctataatccctgcccagaaccaaaactttccctgtgcagatggtctttcaatagagtggaatgtgtttggggtttctgcatatttcagtttacaaacccttcagtgatggttgtcttcatcctgagtttggctccatgcttcagaagatgcaacagtgctgagaacggtgcctgacatgcaggaaacattcagtaagtgtttgctgaatgaatgaataaattaattcaacaacagctaatgaaagcacatcccttaaaaagtctcggcaatattgcgagcataataccaaaggcagaaaccataaaagaaagaattgatggattggaaggggaaaatctttttttttgagacagagtctcactgtgtcacccaggctagagtgtagtggtacaatcttgactcactgcaacctccacctcccgagttcaggcaattctcatgcctcagcctcccaagtagctgggactacagatacacattgccacacccagctaatttttgtaattttagtagagacggggtttcaccatgttgcccaggctggtctcaaattcctgacctcaaatgacccacccacctcagcctcccaaagtgctgggattataggcgtgagccaccgcagccggccagaaggggaaaatcttataacatgaatttcagataaactgttacatccttaatacttaacgaattcctgttaatcagtatacaaatattagtacccaaatagaataaataccgatggccaataaatgtattagaaacatttgaatctcacttataaaaacatagttattttcctaaatggggtatcattttttcccaatcagattggcaaaaataaacaagaatacaaatccagcctagcacatgtacgtactttcaaagggaggataatttggttcaacatgttttgaaagctggttgtatggtatgttttgaaaccttgaaaatgacccagaaattttccttctagagatttatcttaaggaaattataggaggcataaaaagtttcacctgcttattgctttgtggcttatcattgcaaaaagaaaatggaaaactacttcttcagctaaaggaagtgatacgctatcgtactagaatattaaaaatgaagaaggtagggaaaagagaaagagaatctaagcggtaaaattgtttgacctttattttcttctttttgcttagctatattttctaaagtttttgttaaaataaactcttttaacaaaaaaattctaaaaactcatagctgcttagatgataatataattataatatttatgttaatttttgttgcgaacgtatgtttatgttgaacttaccaagtgatctaagctatattactaagttcttttcataagcctctgagttcatgtatattaagcccttaacataattcttagagttaagcagagcaggtggcgttattcttccatgaccgcactgagactcagaaaagttacatgacttattcaatatcacataattaataaagagtaagactggccacaaagtccaggatgccacacacatagctgagtgcttcttcctctatcatagaaacaaaaatctggatgaccattaggccgttgttggcctgcaaaggtgtagagcaaactattttatggtattgagagcacttatcttggcattactccatctgattgtttgtgtcaagtaggaaagatacatttattattcccattttgtagatggagaagctgaggctcagagaggttgagtgacattcccaaggttgtacacagtaagtggtaaagttaggatttaaacagttttagtccgaatcccttgctctgtctacttcagtttggcataataaattcttaacttccttaacagtttgtcccatcatattcctaaagttttatgatttgatgaagtctctcttaagctccttttccacatgggtggcatgggttagcaagattttgagggctgatcttgtgtgacagattgtatttccaaagatgtctggaataatatcttgtgtcccacatactgttgtggaactatcacctctccatcccaaaaggtggaacagaagcaacactatgaaactgccaaggctaaatcataaacattcaatgcacttctgccttgctctcttgggatgtttgtgcttagaatccagctgccctgctgtgaggaagcccaagcaactctgtggaaaggaccacatggaaaggaacagaagtgcccagctcacatccctggctgagctcctggccatcagcctaatttgctggccatgtgagtcatcttgaaagtactgtaggttcaaggtttactttctgaggtttcagttatccatggtcaaccgtggcccaaaaataggtgaatatagcacaataagatattgtaagagagagactatataacttttatttacataacttttcttacagtatattgctatgatttttctcttattagttgttgttaatctcttatgactaagttataaataaaactttatcataggtatgtatgtatagaaaaaacatagtatatgtaggattcagtactatccgctgttgtaggtatccactgggagtcttggaacatatcccttgtggataaacagagactactgtagatcctcctgctcctaattagcctaccctaactgatgttgcattgagcaaagtgaggtgagccgaccaacctctgcccaaattgcagatttctgtgtaagataagtgattattctgttgggggtagtttgttatactcattttccctcctaaccccaaattaggtggcagggatggaggagtcttgcttatcatctctctatttttgttaactcctcctcgttcagggtagactttggcacctggatcacaaccttattctccaccccaaacctgccattatccttggtgacaccattatccatgaaggggacccatttgatatgttagcttctcagttccctgtcttctaccccaaagtccttcaaattcaaagtatcttactctttttgttttaaaattgcttggagtagtagagaggactctagtggaatatacaagccaaaataatcaggaatttttacatgagagaaaggaggaatgtcgtgaagggcatcaaaaagcaagaaagatgctcattttcccttccaaccccaatttaggtggcagaggtgggagcaggtgaaaagaacaaagggcattggaaaagaccacctggaagtcagtgaagaccaagcggtaaagggatccttagcttaggcaaaggctagatggggacttatctcaccaatggagccagagaacagatgttccagatgtgtgtgtggaagtgggaagaggactgattaaggaaagaagaagctcaaagcaatatagagatgagacagagaaataacaggattccagaggcacttggattttactcaccaaggatgagggggaattagttggtctcaacatttctaacggcaaagttacaggtcacctaatacatatttatgtattagttggatcagaggatggatggatggatgagtgggtgggtggatggtagatggcagtggatgaacagatgaatgaatggacagatgtgaggatttctctgtgggagattcagttcgcccaggagtgatggtgtttctgagagagccctagcagcatttgttatctcctaggctctctctgaatgttcgaagcagtgagtggcaaagaggaggctcagccctctctggattgatctgttactggggtgtacaggcattcagtgcagagttctcttcatcaatggtcaaataacttctgttacccacttgtgatggctcctgtagcctctggttcgactccatgtaacaactgaagagcagccttgctgcaacagataggaagcaggtcttatctctgatttgagaatagaaggcccggtgggtacaacctgtagcactttcaatcctgtagaaatatagatagtgatgctgttggtaaaaaggaatccaccctttccaaactttttcctaagtcagtggttgtcaactggatgaggtcttgctcaagcacaagtgtctggacccctcctctagaaggagtgattctgcaaggctgagcaagcctgagaatgtgcatttctcacctgtaatcctagcactttgggaggccaaggcgggtggattgtctgagctcaggagttcaagaccagcctaggcaacatggtgaaaccctgtctctactaaaatacaaaaaaagtttccaggtgtagtggcacacacttatagtcccagctactcaggaggctgaggcacaagaattgcttgaacccaggaggcagaggttgtagtgagccaagatcatgccactgcactcaagcctgggtggcagagcaagactctgtctcagataaaaaaagggatgtgcatttctaataaattcccaagtgatattgatactgctctaggaccacactttgggaatcacttccatcctgcatggctaggtttaaattaggcattcttaacttcatatgtggcagggtgagtggatgttgagggccccaggtatattcttgaaaaacaaaaagaagtcagtgatcagttaattcattctagtctcctgctgagactgttgtctggcttatgaaggccaggatttttgccacctgaggcatttggagaagcctatgaaggagagtagaggagaggttggggacaacagaatgaagccagccagaaaaagagactgggcatagggggaatgggaatttgaggagaaacatatcattcatcagaacttaaatctgcatttttagagaagatattataatgtgcttacgtggcctccagatgtgcacaggtgccataggatagaagtagcccagggaagccttgtcatagatgggctacataaataggaaggcttgcagcagtgttaaaagacagctgatatgattaggctttgtgtccccacccaaatctcatcttggcttataatccctgtaatcccgttgtgacaagggagagaccaggaggtaactgaatcatgggagcggtttcctccatgctgttctcatgatagtgagttctcatgagatctgatggttttacaaagggctcttccccactttgctctgcacttctccttcctgccgccttgtgaagaaggtaccttgcttctctttcaccttctgccacgattgtaagtttcctgaggcctccgcagccatgctgaactgtgagtcaattaaacctttttcctttataaattaaccagtctctggcagttctttacagcagtatgaaaatggactaatacaacaccctccatgcaacctggagaaaatgcaaagtacatatagctctcaaacttcaggaaggggatccatatatgcagacagccattctttaaaataacctttccattctcccatccacttcgctcacacgtgatagatagtctgtattatctcttctctaacatctccacccaaaactaaacaaaacattaaaaccctccagtcattatttaacttgcctctttcttcacctcacttccagtttctccccgattcacattcacaaaagcccaagaatgttatggctgatcaaggactctcctttgagggtgggaagaaactgcaggggtcaggccagaattctcttctgcagacagaggagggggaaagacaggaaataagcatgcacaacgttcacctttgttggctgcacaacagcttgggatgtgcacccagccctaggtctccagctgagatgtcctcagttgtactcagcaaaattgccaccttttctgagttatgaaagccttctctcctagagccccagtatgttcctggcacctgcaggcttttgggttttggttttggggtttttttctgtgtggtgttgttgttgtgtttcttcaccagggcatgagtagacagatcctatgcaggcactttctttgtgatcttcaggatcatttgttttatcttgcctcccaaatgctgatcacccatgggcatgcttcttgagggttgcaaccatggctttaaaacccagaacagctggtgtctgtggtctgcagggcccagaaaatattatttaatccaggaaacattcctttgttctgctctgcttcattcagacctctcctgggtcttttccttcccctgctggctatcgatttccatccaactgaaggggtgaagttcagaagcccaggagacagcctgaataatgggtatgcaagtgttgcatcacacatgcagcaaacatttattaagcatgtatactatacagggctgcaaaagtccatatgtactaggatcttacagtacacttggaaacaacaaggaatctgggtatgaggattctttaggtggaccagatgcctgctctgtgtagcagcagaactcttcaatatggactgtaaccacctgctccaaaatcaccctggggaattgtgaataaaatgcagacttcaaggctcatcctatacttgatgagatagggccctgaaatctgctatcttaacaagcacccagttggtttggctcttcatttttctttttgagacagagtctcattccattgtccaggctggaatgcagtggtgcgatcttggctcactgcaacctctgcctcctatattcaagtgattctcatgcctcagcctcccaagtagctgggattacatgcatgcaccaccacactttattttgttttatttattttattttattttattttattttattttattttagtagacacgggatttcaccatgtttcccaggctggtctcatctcttggcctcaagtgaagtgcccacctcagggacatatattgtatggtactgtagagtgctttatacttatctttctcctaaccagatgttagctcttagaatctcatcctcctactttccaaggtccctgcacccatcaccaggcccccaagggatatggacagggagagccctctggccaaattctcgctggatctcccagtggccgttcagcttggaccgccttttctcctcttattccagtgatagtccaggatatctttttgccttttttcccttaagacttccctggtcttggtatttgggattttctcattttgaatctgggggtgaagaggggaatttaggggatattggtcacttgtcttctgtgtccaaatgtgagtgtcttgctttggattaggaaacccctaactaatgaatgttgttaggggctaagaccactccaacagtagaagctagaaatcttagatactaccttgcccatctctgggtgcagccaggacactgaatgtgattcaggctctgctgattagatgtgtccctgttagacattgacatagaccccaggagccagggttataagggacaggagtcctttgtcctctggcaagggtaatttcctcctcagaaccagtcctgggctatgttgatgggcgtggcccagttgccttgtaccaagtcagttttctagtcctgactagaaattgttagttctggcagctaacaattctacatgatccaaaaaagtgagggatatcatttaaggagggagggagacagcctctgccttggtgtctcaccttccaggagtaaagacgtgtcccaagtaatgggtagctccatgcacaagagaagagacagtggagaagataagacatgcaagaggaaggatcatggaagagagacccagaacatttgcttaaccagatctatttataagttttagtccttaatcagaaagcaatgtatctttcttagaacagtaacctcataatgcattcctgaggagcccagttagtccttgctcctgtccatcccacctccttcaggcggtagaacagaagaagggtcttcatctcaccccagctaaagcatctctgcttccagaaagtgtggatgagtgggagccataaacctgggaaataagccacatgctacccttttggttgttgtttattttaacaaaattctatgaccccaggaccatgtttctaagagtagccacttgaagcagaaggaaatatttagtcaaattctacaatcacagccaaatacagtctaatggcagccagcagacactgtggaaagagagtgtcacacaccattctaatgtggggagtaaggatgatgaagaatcagtcataggtccgtgttgtagctccgtctggggagtggaactcatagggtataagtgattatttcctattcatttccttagccctgaaccgtccaatgaccacacgcaacttgactggcaagaggtgtttagaatgttgagacacggtcagaaatgattggtggtttcatgtgatgcaaagaatttcccatactccgcctgttttctggatcacctgtccccagaaattgcctgaaaacaaatcacaggttgaaactagaaataacttccctctcctaggcagcttggagactggccaccctgtttcttggtttggtaagaatgttccagacacaaggaggggagcaacacacactggggcctgtcgggggttggggtatggggagggagagcattaggaaaaataactaatgcatgctgggcttaatacctaggtgatgggttgataggtgcagcaaaccaccatggcacacatttacctaagtaacgaaactgcacatcctgcacatgttaccccagaacttaaaatgaaaataaaaattaaaaaaaaaagaataatccagaaagtcaagaaaagcctaactaaaaaagtctttttaggcaagagagcatcgtaagtaggatgtagaggaagctcccctgcttaaaacctgttaatggtcttctgtagctttcaaattctagctcctcttgcctccacgactcaactccccagccctccttccgagtgtacaagatgactcaccctgagtccagagccaaactctcggtttgcatcccagctctttgccacttactacagaccatgtgaccttgggcaagtcacctaacctctctctgcctcactttcttaatctgaaaagggggggatgatgaccacccgtttcatcaggttgctgtgcatacaaatgggcgaatatgtgtaaactgctgagaacagtgcctagcaaatagtaagccctatgtaaatgtttgctgatgttgtgttccatgattccgtggctttgaagatgctgctctctcatcctgcaatgccaccttaccttacctagcaaattccaacgtgtccgttaacattcagctcaaggctgggcacagtgactgacatctgtcatccccaaactttgggaaactgaggcaggaggatctcttgagcccaggagtttgagatcagcctgggcaaggtagcaagctctcatctccacaaaaaaattaaaaaattatccagaggtggtggcatgcacctatagtctcagctactccaaacactgaggcaggaggatcgcttgacaccaggaatttgaggctacggtgagctctgctctcacctctgcactacagcctgggtgacagagcgagaccctgtctctaaaaagttttcatttttaattttttaaaaaatgtttttaatgtatctcaagccctacctccttcagcaaagtgttctgagcacccaggtctgatgtagggccttgtccatgcttcctgaaaatatatcttctgtagcattcaatgcactggaatgcctatgttagctgaaagttactgatcacaattccggtggcctggaggattggtgagcccagctgtgaagtttagaggcttgctatcttgcccaggctgatctcaacaagtaaacattagtttattcatctgtcttctccctggtttcaagcccctggagtgtagggccacatcttacttggcattgtatccagcagtcaacatagtcctagaatatagaaggccctcatgttgaatgaatagtaaaaccctcctgaaatccattaaattcatatgtttatttactcactcattctcttcctttgttcaaaaaacatctcttgagcctctgtgatgtaaaccaagtgctttttaaccagcagcttctctctgatgatctatctgcaatctctgtgtcagtcctcacatttaactaggacaaaaagagaacatagattcttagtagctttgctcatgacctgactttaacaagaaaaattttagagaccaaaagtctgactgatagctgagtgagttctttctttcaaactcaaagccctgtttgagcctctaaacttcacagctgggcttgcaaatcctccaggccaccgcatttgtgatcagtatctttcagctaacataggcattccagaagatgttctgccctaaacgtaattggaatcctttttgaatcagttgccacagtacttctgaagttttttatgctaacttcttgggtatatttcctcaagatggattcaagatgtggccagttctcttgtgagaagaatacatttctgttgtcctaagtgtagagaccctctagttcatgtaatagccctgcaaagcaatctgctattaccagtcccagcatccatttctccttccttccttagtaataaaaccctgctttggctgagcaccttgttgcccagaattaaacactgttttaccagcttccctgatgggtgtggtcaggttactaagatctggccaaagatgtgtgtatgagttttctatgctgctgcaaattactacaaacttagtggcttaaaacaacacacatttatcttataggtctggaggccagaaatctgagatggatcttagagactaaaatccaggtattggcaacagaggtgtattcctcctggaagttattgctttttctagcttctcgaggtcgcctgcatttcttgtctcgtggccctttcctctgtcttcaaagccagcagctctctggcatgtttgtgcttctcattctcattctctctctctctcccaccccgcccccgcccctgctgtgttatcacatctcctctctctgatccttctacctctctttcataagaacccttttgattagatagaacccacatggataatctctccatcttgaggtccttaatcacatctgtaaagtcccttttgccatgtaaggtatcatattcacagttctggggatcaggacatggacatcggggggacattattctattgtcatgtataagtagagtaagtaagtagagtatggcattttcagaaatgtgctcaaagggaggtgtctcaactgggaaggaccctctttgacccttctgcctttcctttctaaagctgagatatgatggctgatgctttagcagccattgtgaaccatgaggtggccttgcggatggaagtcaagcactaggatggtagaagagaaacattaagatataaattcctgatgatgccatggagccaccttttaccaaatacacttctatcttgtttaagctactgccatcttatttgtttttttttttctggaacatacagctggacctaatctcaatcccttaaaactatacatgactctcttcttaataaactgcaaggctggttctctcagcctactaccctgcctaaggaacagataggtagtaagcatggatatgaccattgctcagaaaatgtgttccaaaaacagacagtatgtttatcatttattgatcagttcagcctctggctctgcctatacactgagccatacaacctcaatattaatctgggctgttaacattcttccagagctttgatcatggtctacatcttactccccggagaatcaggtgggcagaaatgggctactgacctatcaatttctagtcctgattagctcaaaatgtggtcatttcctcttaacataaatgtatttaacaacctgaaatagcaaatagcaaggtaactttccactgacctgtcttactattaatatcagaagtcagaggtggacctaaaaagtaaccaaacaatcaaaaccaatgtctgtaaggaaaaccagcatcgttattagtgacaccaagattcaaatcattgatttagcaacactccttagtgtattcatcagatgtttattggaaatctatggtgtggcctctgcagtgagtcagagtgcagagttgaagagatgagggtccctcaccttaagaaccctcactgcattaatggagagacagaccaagaaatgcctttgtggtttcaagaagtgcctttgttctgtttcatttttttattgtcaacaatcatggccaggcatggtggctcatgcctgtaatcccagcactttgggaggccaaggtggggggaatcacctgaggtcaggagttccagaccagcttggccatcatggtgaaaccccgtctttactaaaaatacaaaaaaaaaaaaaaaaaaaaaaaattagccaggcatggtggcgggtgcctgtaatcccatctactcgggaggctgagacaggagaatcgcttgaacccaggaggcgggggttgcagtgagccgagatcatgccactgcactccagcctggactacagagtgagactccatctcaaaaaaaaaaaaaaaaaaaaaaggaaaaaaaaaatcacaacctagattctgtaagcacctacagcagctatcctttgctggggtttcctcattcagctctctcctcattcattatctgggtcctattgtattccctttattagttttagcaatgtttaaaattatttgctgcttgaaatctaatccattttgcaagtaaccagcacctgggggcaggggtagtgatgagaaaacagggctaaaaggaataaattcacaatgagttttatatttacaccatccttttcccattcacagggttttcccatttgggaacattcttagcgtgttctctgaacagaagaccgtttctcttggtctgaagttgatcaatgtgagaggaagatggcacattagaaagatgcctggctctgatgacattccaccccgcagtcttccagcacactgggatctggggcttgaagtcacttgtctggctgtgtgactgtatccacttggaagcagcgtcccctgctcctaagttgcacaagatacttcagggagtctgctgtgatttagtgatagacaagtcagaaaacaagtttaaacttgttattaatcagaagagaacacagacatttttagctgtctatctgacttggtcatagggcagagccatcagatgccatcagtggtggtcggtgtagatttttttgtgaatcaagacaggagcaggaaaaaggggggtggaaataacagacaggttccaggagggcctggtggagggttcagctgttggagctcatttttcttgctttttcccgagagaggggaatggactgccattgtcacaggttaagtcacagaagagtgaagctcaggtgacaggagacattccaaattgagaacagacatgccaggggtccctgttgccacctgctcacaagccaaggccttggttccgagcccctcttctctctctgcattttctccttgggtgacctcatccagcctcgctgcctgaagtgcattcctacacaccagtgactctcaaatactatctccagccagctctctccccacaaatccagattcaacagccactccatgtccctactcagatggctcctacagacctcaggcgaaacatggctagcacgcaagcccaggtgtcctccccatcctgttttctcatctcagttgatgtaagctccaccgtgcacccaactagttaagctagaaacctggagtcactcgagactcctctttttctcatgggcaagccccatccatcagagaggaccaggagccttgcctccaaacccatttgcttctcttgatttcaccatatcacctgtgcccaaccagccttccatttctctaacccagtggacacagttccaaactggtctccttgcttctactcctctccctttacaatccattctgcactcagcagctaacatcttttaaaaacataaactggaccccttaccacttgaagccttccaggactttctatttcttttaaaacctgacacagcccctgccttcctggtctcctctccactgtgttctgtgtggccaacctccaggcgtacgagcctgcctcttgccctctggacagatcaagcttgcttcctgccttggagatctggccttggctgttcctctgatggggaggctcttcctccaaagagtcacacgaccatctccttcttgttcctgagttctttattctcaatgaatgaagtttattgcactcccctccccaatctcagtagtccccagtgatcctctctcccaactcccattctagcttcattattgcgctgtttttccttggtttcatgcagtttccttgttcattgactcctccattacagagtaagcttagagaggtcagggaccacatctgtttctgtctcattccccacttcagcacagagaacgatatggggcacagtaggagctcgataaatgctttagtgaatgcataaacaaagtaagaaaccatgaggtgacccaaacctcggtttcttcagttataaaatgggcacatgggtgcaaaggctcaggtgtattgtaagggtgaaacgagaggtgatgcgtgtgaggcctttgtgagctctagatctctttgtagatgcaaagtatcagtgtagattgcagtaaccaggacatcagaagaaaaccctgctctttggaagcaaagtgtgccaaataacaaagcttagctctacaaggctatcgctaagcctatgcaataaatactttctctcctccacatctgagctggacattctccacttgtccctccagagccactctccacccttcttacctgcctctgtgcctcacgggctgtcactacagctgcctcagtaagctcccttgccctctgggtacaaggcttcaactgatgggtgacaccaacaggagatcagaggggaggagagggagaccaggtaacttattccctggcagaccttcatcagagagtagctgtgttctgctgaaggctgtggcttctgtctgtccaccttctcctagaaagaccacatcctgtgggttcctgtaactgttcctccttgctaccccattcgacctgaggttggaaacttcctctagttgttgctctagccgcaggctgctccacaatccctaacccacccaaacctttgtctaaagcaccttccttacaccctccccagctgtggcatttcggggccctgttagcatccacgtgatgctgctttctacaaatgtgtctatttgtggtgacagcacttgcgctttgctttcttccctttcttatcctacctgatatcccagccttctgcccctcagctacaagaccactccataaccatagaggaccaaaatcacctaggagcttgagagagaaaatgtatttgacatcttgaaaataatgcagtttgctcaggggatttatttctccctcccctgggctctgcgctcagaccctctttgcttctgtccgactactgcaagcaggcagttaagattatttctagcaaatggacttagagaagctgagcatatgagtgatgttgaaatttgacctacacttcttttttttttttttttttgagatggagtctcgctctgttgcccaggttggagtgcagtggcatgatctcggctcactgcagtctgcctcccgggttcaagcgattctcctgcctcagcctcccatgtagctgggattacaggtacatgccaccatgcccggctaatttttgtatttttagtatagacggggtttcaccatgttggccaggctggtctcaaactcctgacctcaggtgatctgcctgcctcggcctcccaaagtgctgggattataaacgtgaaccaccgcgcctggtgagctatgcttattacttagatttctagcagataacatatagttatttcctaaaactctgttcttaacctgagctgtttttgtcatttttcagggttttagggggtgggaacatattacaggagctattaggtgcatgagtgtgagttgcgggcatatgtgagggttgtgtgtcttgtgtctatgcacatgcgcaggtgtgtaagtgggtgtgaatatgtgtgagcgttgcatgcatgcatgagttgtatgtgtgttgcatctgtgcgtgtgtgcaggtgggtatgagttagtgtgagtgttgcctgcatgcgagttgggtgtctgttgcatctatgcatgtgtgcaggtatgtatgactgtgtgagtgtgtgcaggtacagcttctgtattaataagagacgggcaatcactgtgcactgatattgaggggtagggattagagggcaccttgtctatttgggaggtgaaggagggctggaatgagaggctgaaggggtacagaagaggaaggcagacccctgcaggcctcagggacctagcctccctcccttcagtgtcccttcctctccctgcaggaaccagaaaaagtgtggaggtctgaattgcagtctctaaaatctctcctcagtctcacatgactggcttcagttttctcaccagtcctgcaaagccaggccttgaccccttatctaaatatccaaagaaaaaaatggaattagggatcttagaaggaaagagtggggcaggaaatgcaccaccagggcagtgcagcttggtcactgccagctcccctcatgggcagagggctggcctcttgcagccgaccaggcactgagcgccatcccagggccctcgccagccctcagcagggccaggacacacaagcctttgacttcctcctgtcactgctgctgccattcctgttttgtggtcatcactccttccctgtcctcagactgcccagcactcaaggatgtcctgtggtggcatcagaccagaggcccctgaagaggagtgagttgggtgttttttgccgcgcccaaagcagctggctgtcccctgaaagatggcaagtggggaatgatgatggtgcaccatcgttctgcacaccaagcccttctggataggaggcccccagcagtggagggatgggggctgccaactggcattgcccagaggcccagctcctggtcacatagactgacctagcagtgcaccagctacccgaggcagcctgcaggaaaggtgcactcatagcgatgctggaatgccatgaggcccagccatggggttgagaactggaatggagggaaatgtttgcatcctgatgctgggaaacaggagatcagtcctcaccaacgctgagatgatttccctctggttcttaagctcggttctctttctgcttgatgcttgaatctctggtgtctggcagagagtctggtgtctggcatagtgctttgtatgtaggtcatgccagagcatgctggtgactttgcccttctaggactcttttccatttcatagggacttgctgtgaaaccccgtttgacctggatataaatgttagatgtcatggagtcctgttagcatggtgagctgcaggctgttctgcatgagtcctccttgagcctgcatctaatacccactgctcaatcaatctcttttcactgtttcccattgatcccaagtgtgtcctctgtgagccttttcttgacactgggtcacccagaattactcccctgtctgtgtccccatagcaccccacaaatagttcaatcatagcccttgtaacattctggtgcaccagtttaaggacagagccctgtcttattcatcattgctggtggatgaataaaaatgttcaagtcgtaataacggcaatgacaacaatgataaactcaccacttactgaccattggctgtgtgccacaggacataggactgaacatcttacaggtgttatcctcatgtccactctctcagactgcacttctatcgtattctacagaaactgaaggatggaaggtcacagagctggtgggaggggagcctggattcatacccaagccgtgtgcctcctggccactcctatgggtgaaggaaagcaaagggcttagctgtagctgggatggagaaagaggaatctcaggcttctcgtcatattttgcctcaagaactggaaattgatctgggagtagatcccacactgagggagaaggccccagaccaagaaaggatgggctcatctatttgattgaaaacagagaagcttggaagacccaaggtagggcaattcctgaaccgtccagggctggaaaacctgtagcaaaggcctggggagatggggcagaaaggctaaattataacttaggaatctccaccaggagatcagctccaagacagcttccagtttcggcagatggaagggatacttgatggaaaaggagggagggtaagtgtcagagactgctaaatgtctttacctacatttcctcatttcaaactctcacagaacagagtctgaggtagactctagggctggccccattttgcagatgggtaaactgaggttcagagcactatacccgtaagatctttgctcaagaacttgtatgtcccagaccatgcttgaaacctggtttactcacacaccctgctgtgcagacctcctccgttccaaagtggtggcagacttcagtgtgctttgcagactttcaatctcagcacatgctgtggaagtgctagcagtgttgctgtgctaaccctgtggttaggctgatcacagtcctggtgagtaactatggcctgcagccctggcatctgaaagatgaccccttgcctctcctgctgtcctcaagaaagccttagccccctagattattttcaatataaaatgttcatacactacttttcagattcaaatttgcacaaatgaagtgaccgttagacaccactggaaggtaataaaacccccaagcctgccagccatcaggtccctcccagccatcccagaaatatgctcagctgccctcgaaacatctgtcatgctctctggtgggtgctactgggcacctgacattagatcacttctctcccaaagctgcagctctgcttattcgattcttatttctgcctttggattgagtggaaggcagtcatcagtgacagccaccctcggggaacagaaacgatgtccacagtggcaacgatcctccatcttcctgcactgaggcctaatcaatgtagcccatacccagcctccatttaataagctgattgttgagctaaatcccgcacactctccccttgccctggacgcttttgattgacaaaactaatctctcctccacccccacgtctgctgctgcccacatcctcttgcaaatcatgtactcggctgctgacaattagatataagacttgggattcggatgtgggagggttatgaggttatgaatcaattgtgggggctcaggtgagataacaaaccaggggaacccatttcagacacctcgccacagccctcagagcctcctggttgatttatgagttggtaataacctcgctgggtctcctggcccctattatttttcataatgcacaggaaagctttaaatatcagagaatggggaagtgcacagtctgagtgggagggaggtgaggggggatggggcttgggggagaacagtggccaagggcttccccgcagctgattgtctctcctgccccatctccccaggccttcgctgcaggtcttctagtcctggacgtttcaggaattgctttatcttggctttttcaagcttctctgtttcattcaaatagatgagcccatcctttctcggtctggggtcttctccctcagcgtgggatctactcccagatcagtttccagttcttgaggcaaaatatcaggagaaacctgagattcctccttctccatcccagctacagctaagtccttcgctttccttctgtgggtcaccacggggtgccgttgtcatatacccatggaggccagcaagctgatctggccaacctgggagaagaccccaggttgatgacccctggtttaggagtgcatatggcaggatgcttgagggatcactgggcccaaaatcgtatttgctgtgtctggatgtaatgcctcccacctgttcaagaccacgtcagaatgactcagagacctgcctgttaagaagggaaaattatccgctggacaaaagccagtcaaaaagcaggctcaccctgcagtctggaagccagttgagcagcgaggacaggccaaaaaggtgggagggggccagtgagtgtctctcagcctggaggtaaagagctgaagactttacctttccttctgcctgctgtcctcttcccagtgacagccagtttttaataaggaaaaggaggaggctttgaattgctacctaatatttgtttaagtagtaatttgttgagatttctctgttttgttttgttttgttttgttttttgagacggagtctcatgctgtcgcccaggctggagtgtagtggtgcagtcggcttactacaacctccgcctcccaggttcaagcacttctcctgccttagtcatccaagtagctgggactacaggcacctgccaccatgcccagctaatttttgtatttttagtaaagacagggtttcaccatgttggccaggctggtctcgaactcctgacctcaggcaatccacctgccttggcctcccaaagtgctgggattacaggcaaaaagatgtgattttttttttttttttaacagtatcagtgggtgaaagaccctgaacctttcctctaaggcagtgtttgtaaactgcctatatgatgtctggtactagattgtgatgatgttttcaagggccacaaaacaattgaggaaaaatttaaaacatactgaatatacatgtgtgggtgtttatgtattatgatgtgtatttgaatacaactatcaacgaataagcattcattagaccccaactctgtaccagatgtttgtttactccatgccagggacagaactaacagggtccctgctctcttggagctacagtttagtgggcattatgggttgaattatgttctctcaaaaattcatatattgaagttctaaacactagaactccaaaatgtgaccttatttggaaatagagtcattgcagatgtaattagttaaggtgagataattagggtgggccctaatctggtatgactggtagtcttattaaagggaaatttgggccagtcatcgtggttcacacctgtaatcccagcactttgggaggccaaggcaggaggatcacttcagcccagaagttagagaccagcctgagtaacataaggagaccctgtctctacaaaaaatttaaaaattagccagcatggtggtacatgcctgtggtcccagccacttgggaagatcgggagaggcctgggacagattctccctcacagccctcaggaagaaccaacccgttcgacacctggatcttagctgtctggcctccagaaccatagacaataaattgctgttgtctaagccacccagtttgtgataccttgtcatggaagtcatagcaaactaatatagaagaggaaacagacatcgatcaaataattacattgtggctaattccaaactgagataaatgcttcaaggagaaagaaccttgttctcttgacgttgaaagccaaaggaccttgagccagtctggagggcaatgaaggccttcccgagggagttagggctgaaggatgtgtcagagtcagctagagctgtgttccccagcctttttggcaccagggaccagtttcatggaagacagtttttccacggaccagggttgtgggggatggtttcaggatgattcaagtgcattacatttattgtgtactttatttctattattacattataacatataaggaaataattatacaactcaccacaatgtagaattagtgggagccctgagcttgttttcctgtaactagacagtcgcacctggggggtgatgggagacaggaacagaacatcaggcattagattctcataaggagcgtgcaacctacctggcatgcacagttcacaatagggttcatgctcctgtgagaatctaatgccactgctgatctgacaggaggcagagctcaggcagtaatgtgagtgatggggaggggctgtaaatacagatgaagcttcacttgctcacccgccactcacctcctgttgtgaggcctggttcctaacaggccagggaccattacctgttgggaggctgaggacccctgagctagaggaagaggtgggaggaggaagggaaggcacgacaggcccagggagtagcagatgcaaagatcctgtggtgcaatggagactgttgcattctgggaagggaaaggcagtcccaaggcaggagaggtgggggaagaagaagagggtgttgggatggatgcaaccagagcaccccaaaccagaaagatgtttactccattaccttcaactgaattacagtggggtgagggcacctattttgctttctgccctcacttccgggaaatgcgcatcctggatcacagaaaagctgctgggcagaggtcccagtctctcagtgaggcctcaccagactagtagagttgtccagccacaatgccctcctcatttccccttctgtccaacaagctgtctatcggaagatcccagtctaaaagcaccagaagacattttgagtttctctaaggcctaaaatttaaaagctgataagtaacacaaggattccaagttactgctgtctctcccagccacgcagatgactgggttagacacttggctggtatgaggtccctgaaacatgggctctgtgagtagccaatgtgtattaatattaatgcttatgatatgtcaggcactctgcatgggttcattacccctcacagtcaagatgatgggtcccattattactgtcctgttttctttatttttgagacggagtttcgctcttgtttcccaggctgcagtgcagtggcacgatctcggctcactacaacctccacctcgcgggttgaagcaattctccctgcctcagcctcccaagtagctgggattacaagtgcccgccaccacaccaagctaatttttgtgtttttagtagagtcagggtttcaccatgttggccaggctggtctcaaaatcatgacctcaggtgatccacccacctcggcctcccgcagtgtactgttctcttttcatatgaggaaataaacgcacagggccagcagatgacttgctaacaaccagatcatttcagcaaaaccatgaaccaggcattgtgaagagagttttgtatacctggccttattcttaactagacagcacttcaccctagttgacgtatgaagaaatggagatcagggcaggtggtgggtaagggacctgcccaggttcccaccgtttgtaagtgatgtaccatgagttgctctcaagtgtgtctgactttataaatgctgcaccttatcatttcctatgcttggtaagcaagtgagtgtgaaatttgccacgcttttccttggaaaaactcaagcccattgaccaaacaatactacttgaaaatgacactgaacttttcatcactgtgtttctccacctgtgttcccttctgtcttactgccacctactcattgtgctcaccctccaaagcccagtttaacatttcctcttagttaagctttctctgctagctgatcattgcattttttttcaattaaggcataaaagaaaaaaaaaagacggtaaagattgtcctacttagaatatccttccattcatttgcaaaatggagataataatatgctatttacaacataggattagtatagcaggattattccagagcctggaatatagaaagtactcagtaaattattagttcaacagctaataatagtaccaattattattatcactaaattaatgcctctgtttcaggaaaaaaactgaatacatacagaatatcggttttctaattgttttttctttatactacttggaaagttatacagagttaagagacacagaatagtatagtggaaataatatttggcatgaaattgcctggattccatcagtagtagcctgtggtcttgagcctctctgggcctaatctttaaaatggatataataattatcatattggacacaattattgtcaagataacatgcgataacagggtcaagtgcccagctctggcctggtacaccatgggcactcaggaaatgtcactccgccttcataagcattggcctgtgcatgacatctatgtgataaggtggcctgaagctgtcctccccacccagaggtgcagcagaggcctggcaggaatgtgaaaatccaatggatcaagtcataaccttgactgaagagtatggtgagttcactcatggcaggaaccatctgatcattcatacggctccagaaacattttactcaaaagaaagtgtctttccccaacagtcaagattgataattagtttatgaattgcttcatttatcagtactatgatgtactgtataatccaccaggtttcaagttactggaattttgcaggtgatgggaaccagtctttttatcaactttgcataatctgatctgggctcagattgatagaatgctttgggaagaatcaggggagtgttttatactaggatctcctgcggttctgatgcgttaatgggaggaagctatccctgtcaaattctacaattttggaggagcttaaaacacctgaagacaaagccctgaattttatgagtgtctgcctgaaaccagaaacagaaaccccttacagcttactcaacagcgttaattcagcatggaaaggcaccaggaaaagatcactgcgtcttactcccaccaagtaaacaagctaacaaacacagaggagaggtgcaggttggcacccttaggccggactctgggtggacagccctgtcagagtctataaagggtcgctctgaggctccaggagtggcagatggccagagagtggccaactggaggcacactattgagcctcgggattgagcctcccactgtttacccctcaggaaaaagagagctttgagtctcctggccctttccccagagagcaggaaatggccagggcttgaggatagccagaggccgtccaaagttacccataccatctccactttggcctcagaggccagctctttcttctctctgtgctttttaaaataaaaacttatttttctagtgtaaaagtattatatgaatgttctatgaacttcaaataatacagaaatgtaaagaatagaaatttcccattatttgatgcctcccgctccccaaaataacctaaagttaacaatttaaatatatatccagaatttttcctctccatatttatatatatctatacatatataattaatagaacataaatattttacagtaaccctgttctcaagatgcttttccactgtagatgtttaataaatatttattgcatgaatgagccataatttatttattcagtcctctattagaggcctttggtttgttcccagtcatctaataaacatgattttagatataaaagacataattgaaatacatataacacatacagaaacataacccataactgcatatcataaatatatccttaaatatactaataaaacacgcatgcaatggagaggtgttttgggtgccgtctggtgtatatcctggatatccctggaatatatattgataaatcagcctcaaaaagaatgctttcagacagtgttttaggatctgtgggaacaaagggtggccatcctgcatttgttatgttgtttcaacatagcatttgttatgttgttttattaactttaagtccttggcaaagcagcttgactaagataagatccagaaaccagtcgtggtaacaaggcaacaattaatcttagatagaacagaaaaggaatccgcttcaaattctctttagaacaggaaggaaagggtgatcgtgggttagcaggaaggaaggaaagaggcaagaaaggaaagtgaaaaaagaatggaaatgctttctcctgctggtgatttggatgtttggactactcttgtcagatgctacagcgtaatcactgtaaatgttttaaaggacgcgatattatgacagatttccctttctgacttgttcctggggctgcacacacaatgatttactccctgccacgggctggaggcttggccactcctgggttggtccaaggaagcctggaatacccaatgcctgtgagagtgagcacgtccccctgtctctaggtgttgttgcttgtgctgaaatggagtctaccaagcattgccatggcatggaagggatggtggcggagtagatgccactgcagattgagtgcagtgtcccaggcagccaggggcagccgctcagcccttgcctggacctgaggactgttgcatcagtctccagatgagacagcagctgtcatggtggctgaaccagggaaaagaaactccactctgtggtctccatggggctagggaaaaaaggaaatgggtttttgtgattttcccttctttagaaacaaaagtgcttaaatgtgattctttagctctgtaaatgcaaaccacggcctggtggactggggagaacaattaggccaaaggctgagcacaggaagccaaaagcgggtggaaacccagacaacggtgctgagccgggggttggggtggttggggggagcggatatgatagcaaggaaggagtttcaatgtgaatgaatactaattagtgacatggatattaatgatgacagtaattaacaggggaaaggaagggctgtcattgtcccagggtgagtaatcaatcttggcaggtgataaataatggttcagcaagctcagcagaaagataatccgcaggcctgggggagaactcagctaatgcaggaaacctcacagtttctaggcaacccacagaaaagaactattttttttttcttttttgagacagcgtctcactctgtggccaggctggagtgtagtggcgcgatctcggctcactgcaacctccacctcccgtgttcaagcaattcccctgcctgagcctcccgagtagctgggactcaggcatgtggcaccacgcctggctaatgttttgtattttaatagagacggggtttcaccatgttggccaggatggtctcaaactcctgacctcgtgatccaccctcctcggtctccaaaagtgttgggattataggcatgagccactgcgcctggccagaactatttttcttttgaggaaaaaacagattagagtatctctcccacccccagcttgggactacagttcttatttgatttctgctttgttcttcatttcctgggacaaatgttgaacttgtataacttggaggaaagggacacacaggcacatgtacacacacacatattcattctctctctctctctctctctctctctctccaagaatacgaatgaatacgagtgtttttgatctaaagtttgactcacagatgctgtccaggagtagcaagagtgaggagaagcctagaagtgctgcctttgaggttggcgcggggaaactgcaaaattgcaaggctgtgtcggcagaactggggcacacaggaggatgaggatggccctgggggtcccactgtgcagggttacttcacctgccatggacccagagagaaacaaaatgtctaggctttctgtcctgtaccagtcccacttctggccaccagtcacatatctaagaaaactgatttctgggaagagggcaatcctcatgaagcccctctgctggatccccaggccttcagccaggaatccagcccaggagagttcttggcacatcccctccctctcaccaaagcctcagacccacggtaggactctgatatctaaaatgtctccccttgcaggctgtgttccatcaaacaatttagaggtgacaaagccacaccttcaatggtctgcactggtttaaagtgagatctttgggtggcaaaggtagattgaccagaaattcagaaccttccagaaaactgaactcctctactgccatgtacacagtgctgctctcagaacattgtttgcgggtcacattttcaaagagaggcagacagaagggaacttattcagaggattgggaacatatggtgaggaactccaggccacaccctgcaaggaagcagctgagggacccaggcctgttgcacttggagggaggacgtcgctggtatgccgcaggactgtctgaatagctgaagggctgtcgcacagagtggttaggttggggtttgtttttctatcatcaaatggcaaaactgaggccaaagggaggaagtcagagaggggcaagtttctgttcagataaatcaaggctgatttaactgggtcaggctgggtaggggggagtttgtgagtttccaggtactagggattctaaacacaggttacagcacctcttgtccagggtgttgtgaatgggacatgtattggctggggttggagtagacaagctttaaaagttccttcagggccgggcgcggtggctcatgcctgtaatcccagcactttgggaggccgaggcgggcggatcacgaggtcaggagatcgagaccatcccggctaaaacggtgaaaccccgtctctactaaaaatacaaaaaaattagccgggcgtagtggcaggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaaaaaaaaaaaaaaagttccttcagactcttaagatttatattcgttaaggtaatactagataccaaaacagctaagtcccaaatttcaggggcttaacacaacaaagttcagtcctttcagtcctcaatcaagtcagagccccacatgggcgtaatgtccatggttggaaccgtggctccctgcctattgtggctctgcattcccccaggtctttggagtcccccacatccagccagtagatgggattgaaaggggcagagctaaggagagccatgtaggagtttttatggtccaggtctggaagtggcatatgccatttctacccatattctattggcagaactcagtccatatctaagtgcaggggaggctggaaatgtaatctagctatggcacagtgaggagaggaaagaggtcttggtgaatacatagacgtttctgccacaaatgcagggacacattcattcaggataggcctgtgccggaagagatgagagttttgcaagaacctatgaggtcacctgtgttggtcagcccttgtaattgatggtagggagctgatgaggcctccttcttcaagaaatggtctgggggccaggcatgataaagcttcacctagcacgtctcagggaagtcctctatagacacttcctagaaacatgaatataagctcatcctgcatcatcagaagtgagtgttttttggacaagaatggaattgtaactatggaagtgtactgaagaatggaaagggttggttaggacaaaaaaaagtgcccatattatcctgctctacagtgtggactgtttggaattaggattctcttaggtaaacatgtttcttctgccacagtgttaaacacccaggaggtcttcagctgaaattgctttatcgttgcaggtactgacattgtgcagtggcttatgaagaacctttccattgaggacccaggtacttgacctttgaccccacccttatctcccctggtatcagtaaacatcccataaccaagttccaaactagattcccctgccctcctgagaactggtcttgtaaatgtgaattccaagacgtggaatcactctatttacaaataaaattaatttattttctccactgaatatttgtctttaaatttaaatcatgctttgaggaaatgagcaactttttagaatgccaaagagcccaatacaataatgtgtgaaatgagttgaattctcattagctgcagcaattaaagataagttgtagcactgtcactgaacagccttctagagccagctcttaaaattagattgcctgatccacaattaagatgtttaattatttgctaagactccctctgttttctgcttctgcaagaagtgaaggaatgattttttttcaactttaattgcgcatttcaattaggaagaccttaccaggaaaacaacaacagaaccctggccaataaaacaatttcccagtctgttctcccaccagaaaataggcagtaaaatttattttcacagtgtaattaggaaatggggggggtgttccagaaaaataaaaattcaagataagtaaagcttattcccatgtgctgtcagttaatacttttccgaatttattacatactcctttgccttgattaactgagtattcttgatgcctgaaggtcacatttataaagatccactaatacactctgatgttcttaatggacattggcgtgattagacttacctgccccaaattaaatggccctgaaccacaatgctttttgaagatttttttgaagtgcccattctgcatccgtgaccttcagctgtgagtccctgctggaatcggtgtgtcagcttggcactcctgtattttaacccaacatttctaatctgttgactgcaaaacaatacagtttctatgcagttcaattatatacagttgttagaactctgagtgccagaaaagcagatcattcatagaagtggcccgagtcttttcacccccttgattagtggctactctcacaactagtgaaaattcttaattctagtcaagttcttgattcacagggaaaaaactataaatgctaaccctttgtaaaggatagaacccaaagcaactcactatgtgttgtccctgatgcagcctgtacttctgagtgtccgcttggaaagcctggactgaatcagcatctacctgtttagttacatttatctaaagtcagtatttcttgtgattataatgctaaactaaggaacgtgtttcctcatggccaccttttctcttccaagagcactggtttctttgcctcctaaaataatcgttgtatttctgacatatattttattattactattatgagaaccctaaattggcgagcagtatgtgagaatgagcttcaggaatcctccagccctggcgtgagaagcttctgtgaagggtcctgaatgatgagagttatttctatgaaaatctgttatactctgatgcccttgggaagacatcatggtataggggcctgtttgggcttctgagaagtggctgaggagaagctaagaaccatttgtcagctgggaatagtctaaggggggagatgaggcaaaccgaggccttgggaaacagtcagatccagcatctgcccctctctcccttctttttcccatcagtcgatttcctgtggttattttttggtttttgaggcaaggtctcactctgtcacccaggctagagtgcagtggcacgagcatagctcactgcagccttgacctccctggcccaagccatcttccacctcagtctcccgagtagctgggactataggctcctagcaccacatccagctaattttttgttttattttttgtagagatggggatctcactgtgttatccaggctggtcttgaactcctgacctcaaacaattcttctgctttggcctcccacagtgcttggattacaggtgtgagacactgcacctggccccattggccaacgtctaagcaaaaacatttttgctcagagaatgaagttagagtcttagctccaagactggtggcatgaaagtcaccttcctacaggattttgttctttcttctctggggaaggagcaactgctgatgatgaaacttctgttctagctggactcatggttcttgaagcatatggactttaaaaagcaaaccggccagacatggtagctcatgcctgtaatcgcagctctttgggaggctcagctgggaggactgcttgagcccaggagttcaagaccagcctgagcaagatggcaaaaccctacctctaccaaaaaaaataaaaaaaaaattagacagacgtggtggcatgtgcctgtggttccagctacttgggaggctggggcagaagtatcacttgagcccaggagttcaagtctgcaatgagctgtgatcatgccactgcactccagcctgggtgacaagagtcagacctgtctctaaaaaaaaaaaaaaaaaaaaaaaaatagcaaattggtcatcactaagcaagtaaaataaaactctattcattccaattccaccagttacatgtatgtttctttcaaaggagaataggtggttcttgatacgcaaaacattgcattgtattcaacttcttgaaaagtttgcaagtaaagccaaaacaaactactttaaaaagtcagagctcgtgaaattaataattgctagaggctccctgagcacattaacaatttccatgtccaaaaattagttttaacctgtaacagtacttttggatttgtgaaagattgtgtgtggtagaagcattgaggtttgttattttttcttagctctgctcaggataaatctaaattcttaacttttttttttttaattgagacagggtctcgctgtgttgctcaggcttgtctcaaactcctgagctcaagcaatccgcctgcctctggattacaggcgtgagccaccatgcccgacctatattctcaactttctatgtgcatctatttatggctggtgccaaaggaacgaaggaacagattgactgtggcaaaaatataagtatttctatcaggttagcctctctctgtcactgcccacttcagtgtccttcctctaattttcaaaggaagtgaggttttcctctctgtccataagagaagggtgacacccttctcattcctgatgggactgtcatattggggaacgcactgggagtcctacgtctctatgggcagcgaggctgcattcttactgctggggatgatgaaactggtatgaatcagagctgctagcacttacggagtatttgacctgtaccagacaatcacttcatgtgaaatatctcacttagttaaatacaggttcttctatgccagaacttatgcccttgaccctgaagccagactttcttctgaaggtcagggtgaggaggggttaagccatgtcagactctcagaggtgggattcagacaagtcccagacacatagttgccctttccagccattggcatctcccctcctcacccccacactgagcaagggcaattgtatcatcaacacagacatctgggggtgatgacagttgacttctggtctcccagcttaattttcagccaaataacctgctttctaattccttctctctctatgcactgttcttacagttgaagcaatacacttggggagccttatcgctgcccagggctacatctttccaatctcagaccatgttctcaccatgaaggatgatggcaccttttatcgtttccaggtaagcctgctggctcctcctcctgaagaaccttttcttcacaacatcatctgatcttaggttagaactacaaagaaaacctagggatatctgagggagtagccctcactcctcatcagcactgggaaagccaagagaacttttctctgggccactgggtgacccacttagagaatagtaaaaggctgtcattgagagcctaccatgccctgggcactgccttagtcccttgggctgctacaacaaaatacctaaactgggtatcttataaacaaacaaacaaaaaatttacttctcatggttgtggaggctggcaagtccaagaccaaggtgccagcagattcggtgtctggtgagggcctgctctctggctcatagatggcaccttctagctatatccccacatggcagacaggacctggggcttatatcagacctcttttataaaggcactaatctcacctgtgagggcttcaaaggccccacctcccaataccatcaccttggggattaggatttcaacatgtgaatttgaggaggatgcagacattcagaccatggtagacactttgtacagatttcctcatttattctgaagagcacactttagggggtaaatattacccattttacagaggagaaaactgaattgctcaaagaattaaagtgtcatttagtaaatcctggagcagccttcatctgaacctaagtgagcctgatagcacagaccttgatctttctactgtctcatgttgccttctcggagtgaagtttctatttgcgacctaatcaccctccccacccatttcacactccttctcccagatccttccgtagagggaatgagggcagaggatatgggcttgaatcaaggtctaaccaaagggtgtgggagaagagttcttcagactaggttaaagggaggaaaggaacatgggcttaggtgcccagtaagttatgccagcctgacttttgtacttagacctctattgtctcaggataagaatatattgccctgtgaacaaaacttaacatttttgcatttgttttgcttacttacattttgcttctcaatgcctaggttaaaatgttgactcaccttagctgaattagagaagaggagagaattgtggggtagcatcagcaagaaggagatgggggagagcctgccatcagggaggctcctccctgggtgtgggagggaagcgcaggcatggcgcgcccctgagcactaacacccatgctcctttgcaggctccgtacttctggccttcgaactgctgggaacctgaaaacactgactatggtgagaactgaagccactgggaactctcaacttcaacactgtgtgtcacttctgggggtgcagaagacaaatgcttggtgtgggccatggtggtacatggggaggagggtcctttctgcttagtcctttctcatattgttgctatataacaaatctcctgttccacataacagaggaaggcccagcttactgaaagatgtagtccttggaggggaagcaggagagggaagaaaaatcttatcaagggtggtcagtatgttcatcttggggccatggagaaccaggatcccacagcaacactatcagatggtgacttttaattgttctttccagggatagggcttcagggagggctggatcaaggggctacctcctcctggccctttctgttctcatagacttgtcaaaacttactaagaaccttttggtgttcttgacagttgcaatttagaaaagagacagagaccagggaggagtatacagaagtcactctggactaggaaaatagagtgggtgaagttgagagttctgtctctctagacagggacctacaagacttctgccagatattctcagtggagattatttaatattcctatatgccaattctctgaagaagttttattatcgctatgcttaagagaaagaacctgaggcccagaggggccacaccctcacactaccacattgtctgaatgctcccttgattataagcctcttgagggcagaggctggtccagcttatgcattctcatatctccagggcatagcctatgtctgaggcagaattagtgctcagtaaatatccactgacagttctggttctttattgaaggtgaccaacagacactcactagagggagcagaacttgaactcagatctgagtggctccaaaacccatacttctttcacggtcccatgtgtgacatgcctgaaggttgtagctgcagcactgcccctttgcatgcatccttgctgctgactcagctgctgtggcagtctcatctgtggctctccttgggactgggacactcaatgagacctgcagcttctttgcagaattgtttaagacaagaaggcagatgcagctgtggtgagtgggagggagatgtgcagctgggtggtgatcaggggagcctgtctgggagacccatgggataagatacaaccttggagtcacacgtttgagcaagaggaaaccaacaacagggagccaagctgaggatggaatacaagcgagttgtacctactaaggctggagttgttccatggtcaagtgtggaggacgtcagtcatgcagaagggcaggctctggggctgtctgcttggctatccacaggcaccactgtgggccctctgacactgtgctgcaccctaaccaatgtgataagtggatccaggaagacttccgactgcaagtgagagctgcatttgaccgctcataaaactagtgcttctggggctgaaaagactgctcatgaaagcccaactcagaatttgaataattatagctcagttccatgcagcaacgtgtgcccttgtgaatgtgaaaaccagtatttttccaggcagtggagagggtgggaggatggtaagaccagatacctgggcccaagtaagattaaaatatttacttccgtaaagcttagggcatcttatgctgcatactaaagggcatcatctccctgttctacaggtgttcttcattttataattttaattgtgcatcatgaacagggagagaaataatagtttgtttcaggctctcattaaacaaaaattattttaaattcctgtgcctcaatttatggcaaatcagagggagaaatcaaggttcaggatgcacaagtgttcaccagggaccaggcatggtggtgcatacctgtaatcccagtgactcgggaggctgagatgggaggatcacttgagcccaggagttcaaagctgcagtgagctatgattgtgccactgccctccagcctgggtgatagaggaagaccctgtctctaaaacaaagaaaaaccagtactccccagggtttccaaagcagtttagttagaaaatcaggatgtatttatgaagagagaatccagcacaatgagcccccaggatcaacccgttccactagctgggtgatcttggcaaattacttaacctctctgtgcctcagagacctcatattaaaattagagtagtaatggcacttgtctcctagtgttttgttaggattaaatgaaatgcatgtaaggttctctgagttaatacggagtggtggttggtatcactactggggtggggtcggtattattgccactgggatgttggttgatattattatgactgaggtgaccgtctcaccaggaagcatgtgaaactgaagctaagaattcaatatagtatgatttggactgatgaagtaccagaaactttcattcaattgacaaacgtttactggtccctactctgtcaaattctatgtcagagatttgaataagtcacagcctttccccgcaagcattccaggctgggagaggcagcatgatgcagggaagaaaggcatggtgaggatctggcttgagtattcaaaggttttatgtgatgaatgactgagaaggctgaatagcttgggaggggcaggtttataaaaaggccttggcagtcaagtagagacatttagaatggattcagcagtttggggaagctattgtgggtccccaacaatgaacacactttcccaagttttttccctacttgggaaaaaattggttcatctataagatgggggtaataacagaacccacctagtagggttattatgaggattaagtggactgtggaagattaagtaagggctgtgacttagtcaaatagttcctgatattcagtgggctcaatggaagcagtagctgctacgatggtgatttttccagcacctaaaacggtacttggcccataggagacactcagtacatttttgaatgagtgactgaatgaataaatggatcggtgaatgtcatagaggaaactctgcactggtcctcgattctaattccatctccatcactaactagcccttgggtccatcacttcatttctctgggcctttagtttccccatctgtaaatgaggggcctgtacttgatggttgccaaggttacctccagtctaaaattctttggttctaaaaagtcatcagaaagtatgaggaaaatagagaaataagtgagttataggttccctagtttaggagattgaggtacataatgatgttgctagtaaaggcagaaagtaaagaaaggggtcagtttcttcagtacattgaaactcgataagctcaatattttttaagaaatttaattgcacatataatacatgaatgtgttccctttatacaatttttaaatatgtcccagttttgtgtggtgacacatggtgaacttgagatggcagtggatttctctgagtgagatgtgagatataggtaagggtggaatgccagatgtaaggacaaggaaatagaaatttttcggtaagaaattaaatatccaagagaaaccaatatctgagcttaagacagttcttccagatgccctcttgtagggctggctattgtcaccagtagtcactagagtcggttggaagttagagcaagccctagtgagggcactctgggatgcagacaagccccagggagttctgtgccaagaacagccacatcccaccttcctcattgtggtgaaaagattccttgtgtgactttaggcacagggacattagctagtagcatgtgaccctgtgactcatggccatcaggagtggccccagctctgcattccatgcatgataactcacttcacaaccccgctgtcccattttgaccccgcttacccatttggacatttcttgggatgactctgcctgcataaaacccacagtcaaatccaggttagccttttctgagttttacatttggccagtgcaaaatcctgtccagggcagcattgtcaaagcagctgccacctccactgacctgcactgctcaaaggtaatcatgacctggcccagtcgagctggtgacatgtcaagcttcctgcctgaggttgtccctaattctgccaggggtccaagagactgaaggaggtactttgtgatagatcggacacccctttatcagacacagtgaagcactatagctgcttggttcattggaaaagttggtaagtagaaaatcatttttaaaacgacatatgcacaccttaagcacctcatgtaaaggtaagatatacaaaggaacactcatttgacagccttgtgaagtaggaccaaagtgttctctttgattatgagctgaataattttagtttcttaaatcaaccgcactcaaaataaactaccctgttttggtatctttaaagtgcatcaagaatgtaaagacatttttgtagtcttttgtatattggcccctcctagatttttattatttttcttactttttcctgttatctcacctgtatcaaattcaccagcaattgccttagctaactctccttcattaaattgttccaaaccattcaactgagttttcatagaagcaacactctctctcttttcacattaatttcattgagacgtgtgatatttagtgaacttgtgtgattaaaataacagatgtgcctgatataagcagatttgggaacaaccacaactgactcctatgagcacacaattcgccgggtggaagcagaagtgtgggcataccagagggtaggctgctagcttccaggctccaaaatgtcataggtatcagtaaatttttcagaacaaatgaaggaagttggttgatccagcaaagagttgactagagatctcttagtaaagagatcttgttgtccaacaacaaaatgatcacaggttctctctggccctccctcttgatcattctgttgttcatttatttatgccattcatctactgttttccctggattgttccacttggctctggagaaggaggaagacattgaagaaggaaaggtagggagaagaagtgatgatgaaggccatgtttgaggaagaaacagggaaaccaggggccaagaacctttccttagcctgagttgagagacctaaattgtcttccctttccatagcctttttactgcacctgacaagacaggctatggtgctagcaacagggatgaaagctgagcaggacatagcctctgcccttaaagagacttcagcctagagcaggggacagtctagtaaatacaggatttcagtgcaatggaatttagttccatggtcaaggacatgtagatgctatctgaaacaccaacttgggtcttcaaagattagtaagaggttgccagatagagggaaggagagaagagagaaagactttcctcaaaaaggacacatatgcaaaagaatgaagctgaaaagagtttggtggcctcacagtgcctgcatgagggagaagaagttgatgagataagcagtgagcagatcataaagaaccatatttgccatcctaacgagcccaaccttacttctgaggccattgaggactccaggcagagcttttaggcactggagtaatgtggtcatgtttgtgaaatatcactctgagtgtaggatgttcagggtgaagcagagtgaggaggaagaaggggagttgtcaggattggaatatggaggagtcctcatttgatcatgactatgaaaggatttatagaggtcaggggtcatgaggtccacttagaaaacatatttttcccaggacagtgctcatgaggtccacttagaaaacatatttttcccaggacagtgctgggcacatagcaagggtgggtgggcgggctgtctggatggatggatggatggatggatggatggatggatggatggatggatggttgggtggatgggtggatgggtggatggatggatggatggatggatggatggatggatgggtgaatgggtgaatggatggacagatggatggatgggcttataattccattgtgctgctggttttgtacatgttgtcatttcctttcttccctcagccatctatctctgtaagaggacaatgcaaaataaagcaaggctggaactggcagattatgaagcagtaagtatgattattttccaggatacatataagaagagagtaaaatcatatctgcagctccgtctaagtttattttttttttcttttgtcccccttttgtccctttcagacagtggaagggaagtatcttctatttctcctcccttgttctcagctcctctgaccatcacaataagatggtgtttttacataaataactcttaaaactcaacaataaaaaaataagcagctcaacttaaaaataggctaatgacttaacagatattttaccaaagaggacacaaggatgataaataaacccatgaaaagatgtccaatattattagccatttaggaaatgcagattaaatccgtggtgagatactgttacatacctattagaatggccaaaataaaaaatactgatgataccaagtgatggtgaggaagtagaacaactggaactctccgctttgctagtggtaatgcaaaatggtacagccactctagaaaatagcttggcagtttcttataaagttaaacatacacttaccatataaccaagcaatcccacttgtatatacataccctagagaaatcagaactcatgttcacacaaacacctataaactaatgttcatacaagcttaatctgtgataaccaaaagctgaaaacaacccaaatgcactttaacagttgaatggttaaactaactgtggtacatccatacaatagaatactactatgcagtaaaaaggaatgaactgttgatacacacaaccacttgaatgagtaccaagaacattatgttgggtgaaagaaaccaatctcaggccagccattccatttataggacattcttgaaaagataaaactatcatgatgaaaagcagatcaatgattgctagtggttatggatggggtagggaattgttggaaggtgatggaactgttctgtatcctgatcgtggtggtggttgtatgaatctatacatgtgttaaaatttacagacttgtacaaaaggaaaaaagtcaaatttactacataataacatttcaaattaaaattttaaattgcacctttatacccactctcctgtgcttagtagcagaggcagaatctaagggtaaaattcaattcagaaaataagacaagatgtgtgtcacatgaggtatctacttcccagctttcttaccttccttctctatctttcttcataagatgagacttcttgcaaaaattagaggccccaccaccaaacttgggtccattcccatttgacagagcccagaaaccaaagcacttgaaaactcatagatcatttaattttttttttaacttttggttgcaaaatttttcccccaaactgaactttacatgggtcacagagaatgggagaaactggctaaactttcttataccttctacttccctctccctatatgtcttccaaaggatgtgctgctgagccatgaatgactgaagggccagcagctatggaaggaggggcaacattaaggggagcagagaatccttccctggatagtccagcattaacagcatcttcagacccacccaccgccaaagcccttcctgcttttactgcctcagtctttcaaaacaagtgtgaggccccactctgccaggccttacctctcctaggttcatgttcccaagcctaccaagcctaccaagcctaccaagccagctgggccatcgctcccctctctacagcccaagtgtgaatgcgcatgccattggggagcaggacgtgtgcatggtccttcacctctttgatcccactggcattgtggacctgtgaatggggtgcagggggccagaagaggaagaagcagtgcagcagtttgtccagagccctcaggacctggctagagtttgcattatcagatgatcatatgttggaatattatgatctccccagataaaccttggcctggttgttctgtggctctggacatcctgggagcccagtcatgcccctgtctgccccaatgcccagcaatcacagcacccctccttcaaaagactgctgttgtactctttgtgcgcccagtgcaagtagctttgacatgatgacattacctccttaacacaaccttgaggaaaggcccagacagtagaagcctggggcccctccctcctgtgtgtctcttccccatattttcaatgttttggaaaaaggtcccatacagaaatcagacagcatcaactcctgctgtatttgattcaatttctcttctcttgtcccttaatgttctgctctggtatttgtaaagaatatggcattgaggccaggtatggtggctcatgcctgtaatccccaaggtgggcagatcacgaggtcaggagatcgagaccatcctggctaacatgctgaaacccgtctctactaaaaatacaaaaaattagccaggcctagtggcacacgcctgtagatccagctactcaggaggctgaggcaggagaatcccttgaacctgggaggcggaggttgtgagccaagatcgtgccactgcactccagcctgggcaacagagcgagactccgtctcaaaaaaaaaaaaaagaatatggcattgagatgtgctctcaggttgaagttctgcacaaaaatgattcaaaaccaaaaaagcattttgcttccaaaatgcaataatttttttatgaattttctgattacatattctttttacaaaaacaaaaattcaaacagcaaagaaaggagagaatataacctgtgactccccctcacctaagttttttctatgcatacatttttttctttacaaaactatatcagaatcataacataaacattcttgtggcagctgcttctctttccccagtcattatactgtaggtatctcggggtctttaccatgtcagtaactataatctacgttattgtgtttaatggctgcctagaattctatgctatgactgtgtcacagttgattgacatttaggcattaccagttttgcttcctatgagcagtggaagagtcacaaagacagtttttagaagtactttcacaccaagcctgggtgataactgtgagctcatgtgtggtactctccaactgaagctccttttatattaataatccattaatgagggtaatcaattcgtgttggcatgagctctatgaaaatacatagcataatatgggctccggccttgcattcatcagaattaggaggatcattagggcgcctgtcaaactcccctcctcgccgcccatcctcatgttccattaggtaactctacagacttagagaaaatacttttctttttctctaacggcagccctcaatgacttttctttctgttttgggctttttctttcatgaacatcacaaacgtagacactccgtttggggcacttttttttttttttttgaaacagtttcattcttgttgcccaggctgcagtgcagtggcaggatctcggctcactgcaacctccccacctcccgggttcaagcgactctcctccctcagtctcccaaatagttgggattacaggcacctgccaccatgcccagctaatttctgtaattttagtagagatggggtttcaccctgttgaccaggctggtctggaactcctgacctcaggtgatccacctgccttggccttccaaaatgctgcgattacaggtgtgagtcaccacactcagcctcggccactttgaatcctgacattagaaaaagcatgaaagccaggtccctttggttttcctttcctgtgtccttcccagctccccactggaagaggagtcctgagaaatccagcctttggttttgctcctggagataccagcaggtggcaaagactcgttaattccccaataaccacagacaattttcccgattttcagcaacctttgaaacaagtgctgtgtgagttgcattcttgtaaaacaccttcatgaagagaggaatcaggtgaaccatagagacttcagacttaatgggtgtgtaaatgaatattaatagttcagctctgtacggagggtctggcgcaaagtcaaatgggatacatgtccaggggatttaaagcaggtcttgctattttgttggaagtaaccaaaattgatggatgccttataataagcataggtgtcgatgtgctaatttacgatgattaatgccgccttgttgattttcatttctcattaggaaaacttagcaagactccagagggcctttgcgaggaagtgggaattcatctttatgcaagcagaagcacaagtaaagtaggtgaacttgatagagaccttttcagagaggaaaagactctggaatttggaaatggtgtgaaggtgggattgtcaaagtgaagtttccagatggcgttagtatttctaatagggcctgagagcaactgagtagaaattaaagtcaggatggataagttttgtcttcataatcaatgcttctctaaagcaatttcagaaatgtgtgtttcagcagacaagggagatcctcccaaaggtagaactctggttataagaaggtgtacctatttccccaagagatttccagttattttctgtgttcaaaggctgaaatcccattttacccgttggactggagattttgtcttcatgggaaaacaggttggagttttaggaagaacaacaagtagcccctgtcttcttttccctgacaggggaggagtttagaaccaacagaaaaagaaggcacagaagtcagacagttggagtccaaaatatcagattattacattaattaaaagcaagagtaaggctgggcatggtggctcatgcctgtaatcccagcactttgtgagaccgaggtgggggtggatcacctgaggtcaggagttcgagaccaacctgactaacatggtgaaaccccgtctctactaaaaatacaaaattagctgggcatagtggtacatgcctgtaatcccagctactcaggaggctgaggcaggagaattgcttgaacccgggaagtggaggttgcagtgagctgagatcgtgacattgcactccagcctgggcaacaagagcaaaactccctctcaaaaaaaaaaaaaaaaaacaagattatagggcgtgacactggatatgtggccccaggtgaaaattaaatctgcccttcctgtacagaggtgtgtatctataggcctcctctccccagcatctccaccccaccccaccagggcataggtgacccctgtaagttttctgcatgcagagagcagctatcctgagcacaggctgacccagatgggggcccagagagggagagtctgaacttcttcaatttcttctttcaagtctaccaattagttaagtcatttttcctccacaaaggacaagagatgaaaggaagaaaaaagttggaagggtttttcccagatttttttctcctggatacatagtggacatttcttcctctctaaggaaacatgaggaatgggtactctatgttccccaccccacaaacatcgttgtcaaccagatccatttaattctgggaaacagaatgattggatctggatctcccctgtccctcccagggatgatgtctaggttagccaggatggttagttaacaggagaagtgggacaggagcaggaaagggatgctaagctgggagaatgggactatgtttcctctgggtaccacctgcatgtgagcagccgctgagtcttcagagcaacattcctgggcgatgttgcagcccgtggcctggagccgggtctcaggctgtgtgggtgtagactcatcacagctatggtcacagttggaagtgacctgaggccatctggtccagtggcctgtacactgccattgctgtgaacctccccccacagtctctgcctttctcctgtccatgatgccagccacctcctgaccacccagcagccccccggggataggcgggtaccaggcactgggtgcccccgaagaggtgcaggtgggagagtaggtaggatggaggctgggattcaactggactaaggcagaattatgcctgtgtactcagaagccactggaaagcaaagaggaacgctaatttgttcttccagaatcaaacagcatcacaagttataaacagaggggaaattgttacttcataaatacatggtatttctcgattaacttttttgattaactctgtgattacattataattgtgggccacctaagtacacagtaattatcacaaaaatcgcagggtgattatgggtttatttcagtccagtaaagtaaagcgttcccgagagagccgagacctaggagttacacggcaattaatctgagttgctttttacttgaaataaaatgaagtaatacatgcttttttaagaaaaaaaaaaaaagaaagaaaaagaaaaaacctcttatctatgctgcagatcagaacaataagaatctgtctttgtcacctgcaatttccctcttgcaatttgtgcctcccccagctgaggccagtgatatttgcctcctggatcttgtctcattctagggccattattctgcctttagaaagccagatggtgtaagtgacttataaaacacataattgcagcattttaaagacatttatttctactgattctaaatctaaagcaaactttcaaatttgaacatggaacactggcaagatggtggttacattccatcttataatttgtatatgcagtatcctttttgataagggggcatatcaatggataattcagtttttaataatccaaatcttaatacttcagatgaacagctgcattcttattcttcccttaggccaccatgttcattacacatgtatggcaatctgtaatctagcctaaaacaagttctcttaccatgtgtggaattcctgaggttttcggggggggaattatacacccctatttcacagctctgcagagagcaggcaccatgcaggtaccaatggccttgtgttcacttagcccctagcaacaggagcaaacgctggagcaagtgtcagaagggaaaacagaatacagagcttcttatttccttcctctctttactctttcaggattgaccggaaaaaagacaagacagaaaggaaaattttggatagtcaagaacgagccttttgggatgtccacaggcctgtggtgagaaagcgctactcaattctctagatttttttttcttaattgttcatttttatctctataaagaaaagaccgtctttagccaccaggtgtctcattcttaagaaaatcgctcagctttgtggaactggtttcgccattcatttatataatctcagtaaattttctggaatatatgtaagttccaccttttaaaaattattcattcggccgggcatggcggctcacgcctgtaatcccagcgctttgggaggccgaggtgggtggatcacgaggtcagtcgatcaagaccatcctggctaacacggtgaaaccccgtcgctactaaaaatacaaaaaaattagccgggcgtggtggcaggcacctgtagtcccagcgactcgggaggctgaggcaggagaatggtgtgaacccgggaggcggagcttgcagtgagccgagagcgcaccactgcactccagcctcggcaacagagcgagactccatctctggggaaaaaaaaaattattcattcctgaaaatatggaattgcaaatggagaagctatgggaattccaccaaaagacctttgtgtcccgaaggtttacattccccaaattaacaatttccatttccactgctattcaactctgaatcttcaactattctctgtcgaatacggttaattcttgttatccatggcagttatgttctataaagtctttgcaaacactgaattagcgcacattgaagcatcactcccgtgggaactaccaagctaggtccccgtgagcctgtggccacaacatttttatcagctgatcgatacataaccttttaaatgtgtttctgtataaagacagcttatgtaatatatatcattgattcattaacattaaactcatggccaacagcactgttgctcatgcctgcatgtttatttcctcctaaggcacatcagagaatggtgaacagcacttcagcactgtccttggggccattttaaacagcaaaatcaccaacaaaaagtacagaaatgcagaaaagttggcactaaattagccctaaatagaagggtctgaaacaaaaaggcaggacgtcaccttgttcaatttcagtgggaaacacacatatcaggctactcaaggtacaactactgagtaaggagttataaatgaaatttagcaagcaggcaaattcacaaatgcaaaatttgtaaataatgaggtttgactgtatttctgatttcacgttattaaaacaaatcttgcattttcctcatgaaatggaactaaaaaataaattattggtcttcttaaaatttgattaaaagcaaaaaataaataaatagctactcatcctgatatcgtggagtctttttcaaacggttaagtatgtaaaaaaaaattttaaggactgtgtctgaggcaatcttgccacttaaatagctaatttgctcttagaaactgtacactataccctctacatatcatccttagattatgaggtaagcttttctagatcgtatgggaactccacagaggaatgcatattatggcaaaatggaaaaaaaaatcatgcattgtctgtaatggaaaaagataaagattggtcctgatggtgtgacatgggctaaattggaagtgtaattttcacgtagtaatttatatgatgtgttttttttttctcagccaggctgtgtgaacacaacagaaatggatatccgaaaatgtcgacgtttgaagaatccacaaaaggttaaaaaggttcgctagtttagctgagttaaaaattcctgatgtgaatagcccttccagttctagtactattcaaatagtaatttgctacttgtaattctaccaccttttgtcatttgaaaccataaccatttcacaaatattgattgagcagctgatgcatgcttggcgctgtgctcgtgctaggatacagtggcaggtcctcatggagcccacagcctggcaggagtaaaacaagccaacaggcaacagggccatgaatgctgtgttaggagaggtacaggacagttgaggagcccaggaggggcagctaagccagacctggagtgggtgggggtggggggcttcccaagggcttcctgaaagagggtcaggtgttctgaagggtaagttgcagttgtcctggggaggtggcagggaggggaggaaacaaaaggagcaagaagtggcaaagctcacaggtgaaagcaagctttatacttagaagcaaataaaagtcttttttatggtttttttttttttttttttttttggatagagctggatcacccaaactcaaaccaccatcttgtccaactgtgaatgacccagtggtcacttgtgtttcactttactcaaaggagtagtggtcacagcatacccgagggtgccatgctcagactcccccacgattcatatgtcccaccctctccacagcaccagggacaatattgcaggacagcatgaccagactccgtaatattaatttccaaagagtgggccaggtacggtggctcacacttgtaatcccaacacttgggaggccgaggtgggcggatcacctgaggtcgggagttcaagaccagcttgaccaacatggagaaaccccgtctctactaaaaatacacaattagctgggcacagtggtgcatacctgtaatcccagcttcttgggaggctgaggcaggagaatcgcttgaacccaggaggcagaggttgcagtgagcagagatcgcgccattgtactccagcctgggcaacaagagcgagactccatctcaaaaaaaaattccaaagagtggagatgtgtccccaaacattcctatttcttgtgatgaccaattagctctctctcatgtatgcattaaaaaaaaatacacgcacacacacacacacacacacactagacatggcgtatgtatataaacttctttaatctacttacatattttgttcgtcactgacttaacaatatccactgtattatattttaaaatgttagtcctaaaatgtcctcatttcatcttcaagagccccataattctaacattacagaatttcatggagtcacatccaccttatctgagcccttctgcattttgatgattttgactacacattgcatgcccttcagtgtttcatttctttcccattgcaaagattgtgtttagtctttccgtaatacgaggaacagctttaaatgtagctatagctacggacatgtggaaaaacttaggccagaaaactgtttaacttgaaagggaaaccctgaaatgctgccatcccagttttgtaccagatgggaatctgctgaccaacggaaatgtagaggggatcttttgtgcatactctttggcagtggctcttgaactttctttattcagaatcatttggggcatttgataaaagtgcagatttccaaacccacccacaaagattctgatgcagtaagtccagggggcgaggggatactcagcaacgtgtcttttccaagcacacccaggtgattctttgcaggtggtctatggaccatatttggagaaacactgagatacaaggaggctattttcagcccaataaaagataggatttgggttatagtggtaccccaaagatgagatgacatgccttaagaggcagcattctcatcattgaagaaataaaagcagagaccaatctcttattgtcatgaggggattcacgaaattggatgagtcattggactagctgacccctaagccaccctccaattctgtgggtggatgatcctctgtgcttgcttcttctcctagtccgtgtatggcgtgactgaagagtcccaggcacagagcccggtgcatgtactcagccaaccaatcaggaaaacaacaaaagaggacatccggaaacaggtgaatgaattgacagcttgcactctcaggaggagacgtggccagtttaaaaaccctttcaaatgttcaactctgaagattgagcaagctttgagttcctggaaaccacagtggaacccagctgtgggtgattgaaccttttaagtgctgtgtgtgaacaagccacggaagcttgagagaaagaattctctacccagttcctccagcagttactagaaaagggcgtaaatgagtcatcccatgccttggggtaactgctgtaatggggtttcccacagtccgctgtgggagctggaggaaggagggggctcatgtcacacagtccttataattggaatgcaccagctcaggatggtctactttattgctgtgatttgaaaggaaagtttaagaataaataaagctctactcccaatgccatttcagcattacttggttgaatgttattttctttcatgatgagcagcccaggtcaacagacaatggctaattatattacttccttctgatatttactggtaacaaagcaacctactgtttatattatgccttgctggttcctagagggcaaaacccaaaggagtaaactttgaggtgcttgcccttgacaagtttattatctgatgggtaagaggtaatggatatatgaaaaaaaaaagctatttggcggggctcggggctcggtggcccacacctgtaatcccagcactttgtgaggctgaggcaggtggatcatctgaggtaaggagtttgagaccaggctgaccaatatgatgaaaccccatctctactaaaaatagaaaaaagttagccgggcttggtggcgtgtgactataatcccagctactcgggaggctgagacagcagaatcacttgaatctgagaggtggaggttgcagtgagctgagatcatgccgctgcactccagcctaggcaacagaatgagactctgtctcaaaaaaaaaaaagaaaaaaagaaaaaaaaaccacacagaaaaaaagctatttgatgattccagtcaagcatgccaaggacatgggtgtgacgtgcctgtgaaaggtgggcagaggaggggtcactggggattgttcaaaacaggtatttatggggcacatttcacctgtccatgctgttgctaagctacgtagaaaatacattgcctttaaattttggaaagcaagacttaaatcacaccacagtataggaggagatgagacaaaggctaaattgcagaatatgaatcttgtatgatagggatgtccagaggcacaagtaatttgctggagggcagagctgagggagttggagatgtctggccagaggaggtatttggatcttggtggaaatgcaggatttgggtttgtggagcgaggggaaaaaaataattttagtttggtcttaacatctgtgttctctattttcccagataacatttttgaacgcacagatcgacagacattgtttgaaaatgtccaaagtggctgaaaggtatgttttcctttaataatattactactttcttctaatttaacagggaagaaatgttacagggttatggttaacgaatgtgttcaatgccaagagttagactgtagttattccttagactggggtgcagaaaaacccacaggctccatgtgagtataactaagataacagacctcccttgagtgatgtcaagaaatgttccgttgctaaggctttacagggggtggccacgggaccttgtcaatcaaggaagaatgtcctttaaagctacataatgcacctttgccttcagcctctggattaattcaaatggaaattgctcccctttcagctataaaatgcccagattcactttataggggaaaagaaattatgtgtgtcctttgaggtgctggctgcatagacaggaggggactggatcatcgggaagtgttccgcctccacacgccatcaaccactgaactgcatcgaatcagctgtaaagaaaatatttggcccctccagcctggcttccacagcggtgtgtgtgcttcattctgcaccagtagctagttccactccgttaactcatgggagactcaattttatcaactaaatggtctgtttttttaactcttccgtgaagatgggagaccacatggggaatctatatggaataaatctaaccaggcagctcagtagtgaacatttattcatccatatgctaccgttaaagcaatgaccaattgcttaaggaatcaagagcttaagttgggtcttggtatttattggatgtcagataaactgagtcttttaagcccagctcctacagggggctggctgtgagagccatctataagcctgtaagcctttctctgctggctcctgggttgattcacatcttttttctagataaattacaacaaatggaaggtataaaaactccaaccccaaacaaagagtctgattgaataccctaccttcaggggctaaggacatccctggacttgggctcacgtctttattccagggtttctcgattgtggcactagtgacattctgagccagataattccttgttgtgttcttaatgtcctatgaattataggatagttagcagcattcctgacctctccccattagaggccagtagtcccccaccaccacagctgtgagaaccaaaaatgtctccagacattgccaaatgtcccctgggtggggtgaaagtcactcccattgagaatgactgacactcctgctttttctatgcaaatgtgctggaaagttgccctggctggagctcagcttacactgaggtactgatcactctggagtcgctgtttcagctagctgtgtaggctgcagaatcacctcatacctcctctctcatcatgtgtggcttctggccagagtaccaggctctgaaaatgctttttaggtctcactgtggttcctttgccccagaaaggtggctgtgagtgaaacagcagcatggcctcaactctcttggtgtcatccatggcctgtgaggaaccacgagcttctttctctgtgaactagggacagaaatggctgtcctagtatactttgagggtcggtgtgctagcaatgctcatgtctggccttggaaggtggaagagctctttagggtttgcaatttagaaagagcgtatatatgggagcatctgtttctttggatctatttgctcaggtccagtggttctaagtaccgtaatccaggtgagggagggggttaaaaaatggaaattcccaagcctcagccctagggattcagattcagtggttccagggttgagccaagaaatccacattctggataatcttcaagtggactgatctggtctttcaggatccggtgaagccattgcctgctactcaggctgacctgagagctcacatccaatttgttatatctttgggatgcagagaaagagcctgaacctgtcagcatgagggaggcagactccagggcaggtgtgcagagagtccaaggaatggaggaaaccaaggtggaggcggggagcccggcccatcctattgtttgtttgtttccttgctgtcagggaggggccccacctggtaccacctaattatgcttgagaggctgctcatattgaaggattattccaactggctactcctcggtgcccagctagaagctttcatgagtctctgcccggcagaggctggattttattcccagcagcaataactggcaacttttcaatgcgacacgagggtttttcattagagccacaaggaaacccccagataaggaggaggagggaaaggagacgcgtgttagctggagataaagcagctgggagccgggcctgtcagtggctctgtgaagatggggccagggaggaggtgctggcagctggtgagaagctgccagagatgcaggctgagctctctcaggtgggcacgcacatccacatccacatccccatcctgatctggcttccctgggcctgctccaggtgataagtggcaattccatatcccccaggaaaccgcatcccccaggaaaggtcttcatcatttttcacccagttctgtgagaactaatagtgaggagaggcaggagggctggggacagcgaggctgggctctgggatgtctacagtcagggttggactaaagggtgcatccagaccagcagggagggaaaaagggaactttgcaaactaaaggggcagaacagacagtttaggggatgggtctgaaaccgaccatcgaggtttgaaacctacccctgccatttcctgttttctaactgatgaagccagtggcttcttctctcggtgcctgtttttacctctttagaggggagatagtagttgtatttaaattataggattaatgagttcatgcatggcaaaagtatggtccagtccttgggactcagtctgcacactgggaatgtgaataataattattttccagcatgacacttaacttgtgctttggaagagagcagaattcaaggccatgagacagaatgaactggatatatggtgcttaaaggagcaaacaaagggcaggccaaggagggaggctgctaatgcaattctttcctgcaccctctgtctccccccagtctcccacacagagatctctgcaggctgcccaaggctgaccttgcactgcatgtctccttccactgcctcacacgccatcactaatctggggctttgcgggagaaaagacttgctcttctgcacagaatttctcagatcatcccagttccaaatattctgtccattgtcttcctgagtgcttaagtgtccccaaaatgccagcatcgtggcaaccaaactgcatttcctaggctgccttttgcacctggaagcaacacaaaaggctttctgagctgttacccaatttttgttgcagaatgtattgtctctgcacacacacacatgagtgtctcagataaatgacacttaacaccctaagctttttattttaactttttttttttttttttttttgagacggagtcttgctttgttgcccaggctggagtgcagtggtgcaatctcggctcactgcaagctccgcctcccgggttcacaccattctcctgcctcagcctcctcagtagctgggattacaggcacctgccaccaagcctggctaatttttttgtattttttagtagagacatggtttcaccatgttagtcaggatggtctcgatctcctgacgtcgtgatccgcccgcctcggcctcccaaagtgctgggattacaggcatgagccaccgctcccggcctattttaactattttttaatggcagtgtttcttaaatatggttcatccactttacttcctaataaaaggacactacatttcagttaattttgctagatgactcaagagtcagtagtcttctattatgctttaaaactgtcagtggtcaggatcttataaggtgccctgcttccccttccctaaatggccccagataataatattctttgaattcctgtttctgccttttagttgtctgtctgtctgctttctctactaacccttccccccaacacccaacccctgctttccaatctgtagcataccatgtgtatcagttagctgtcactgagtaacaaaacaccccaaaactcagtggcttaaaaaataggcttttactattgctcacatgtctatgtgccacctggctccactggtctcagccatgtttctctatgtggctatgggttggcgaggcagctctgctgatcttggctgggctctctcacatgtttggcttctgctggtttaggatggcctcagctgggacagttgagcactccttaatatggtctctcaccctccagcagactagtttgaccttttccacatggggatagtgggattccaagagagagaacagaagcatgcaaaactcttgcagattagaactggcattctgtcgcttctgttaccttttattggctaaaacaagtcactaagctggactagattcaagggcagaagaaatagactccttttttgaaactgaactaccacaccaggaaatcaaataaccaaattgattagctttgatcctaaagcaagtgtgaaaagtcttttttgtgaggtgtgttgttcccgataacaatgaaccttgaggcatggtgtttatttcatctgtagactatgcagaggctcttatgctcacttatctcatttgtgttctctggatacttgaagttgccagataaacaaggtcctactcttctctgcaagcgtccccaagggagtccctttttttattcatctaagccttatagcacttgacaaaccaactttgagaagcaacactccatgcattttagtcccaaactgtctagtctccatgtttggctgcgattccccagagacttctcccgacccatagcgagcttacaccacaatcactgcagctatcccagtgcactgctgcacacagagggatcaaaatgtttcattccgtacctgcatctgtacttggctcatcctcaccctattactgggagccattcgtgtgtcacagctgactgctgaattgattttttttagcatcatctcacttgcctgtatctgagattgccgctgctccctgaaattggatgctggttcttcctccacctcctgaccctcagtgatcatgaaatgtaattaatgaaatgagataagacagcaagggactggatacccctaagggtctattaaaaacctgctagggtgatagaggtttgggaacttaatgtctaattatagtttcaggggaggaaaaaagagggtcacagaagtcattacaactttgcttttatgggatttcagaaaccatggggtctttgctcctcctttctcctagcctgttctaggtgacagaaaaaaaaaaagaccggaggtatcattacagccagggtgactgtatctagaccaagatatggaatctgtagcatgtggaaaagaaggggcctccatacctggcctggtgtaagctcttcttcctgcagggctgaattcaccttcatgctccttcactcatcccaagtttctctattgaatgtgttttctctgggtgacttgcaattaaggagttctctttttatattttccctacttcccaccttctccaagtgaaaaaaaaaaagctagattaattaattaattgctaggaatcaaactttcttctttcctctccgcagtgctgctctgcttctcattttcctttctaatcagatccttcctgtcctggttctctgttgtgcatcacagttcagaaactgcatgtagcagagcgaggcgtgccagcatgctctcctcttcaccccctttaatattccaattccaggtcttctcatgtagaggctctgatttcataatgaatgctttagtgcatttgtactgtatttctaaagtaggactaatggtcgtatcccataatgctttagattccaggcctcgtttttgttggattttgtttgtttgtttgtttgttttcctggatagtagtttcccatagctgcaggccatacttcactgtccctttttcctggagcctagccatgtcagtatctcttcatcttctccccacctgctccatatatgtgtccttagctctagggattcctcctaggcattgcttaactcaggatggacagcatttcttcttcctccaacttgtcatagttttgtgtggtttttttttggtggggggcggtcacatctatacaatttgtagcaaaattataagtcttttgttaagagagaaaggataaaatctacaacttttatttttgtcatattttctcaagtggttggactgtatgtttactaaattctctttcattatttccttcccctccatgtttatcaaaggtagaccctaattagcaatctaaattgggaaggttttgcattaataactgtcctcctaccaggattggttactattgttagaagctgtgactttgctgttagctcagctctaacaactctctgagatccagagagctgtttgctatttaatggcatagtaggctctgaataatggctactaaatgactgaccacagagtgtacccctggtagccatctggtagattttttttttttttttttttttgccattactaaaggttcatggggcaggagtatgtgaacaaatagccagttccacatttccactcaagacccagttcaaagcccacgacaatggtgggtagcacatttgctaaaggttcacagatcagcatcttctagtgatgtgagaatttgtcatttgaaaataacaaaagcatataccaatcaggagtcagggataaagggacaagaatgctaaaattgctcattgagaaatattgttcctaatggacttctgaatttcctatatttattttatttcttccatctcatcccaattctgcttttctgccactcacacccagcggttggaggaccattgctgctgtgtactgttatatgctggacatcctacaaagctctttacatacctctattttcttctccctttttgcttctcctctcctacctctagtctttctgtggtcattggtattgactttggactgaaatggtactgtgcgttggccattgctgcctccttcattggcctgcctggccttctcattgtcttgtgtgtcccaagcagactctgttcatcttgtaatctgtacactaccaggaagcacatgttctgaaagagacaacctctctggctagttctacaaagggctgccttgatgaacttgccttcacactcccatcaccttcattcccttttcaactgtattggtttgattccaagcaataaaaccccagcttgaacctggttctgcaaaatagaagcatgccttggctcccagaatacaagaaggggctgtggaattgaaccctgggaaaggcagcaatgctactgagctcaggaaaagctggagccagggccttcagtgcctccaagacccattcttcctctctggtcctgcccactttccatgctgaccttattctctttcatgacagacatgtgttaggaaacatgacaccaccagcccttgaactttgtgactatacaactttgatatggtttggctgtatccccacccaaatctcatcttgaattgtagttcccataatccccacacgtgatgggagggacccagtgggaggtaattgaatcatgctggtgttttcccccatgctatgctcatgatagtaagttctcatgagacctgatggctttataaagggcttccccccttcattcagttctcattctccttcctgtcaccatgtgaagaaggacatgtttgcttccccttcccccatgattgtaagtttcctaggcctccccagccatgctgaaccatgagtcaattaaacctctttcctttataaattagccagtcttgggtatttcctcatagcagcaggagaatggactaatacaagcttctactgctgaagctggggaaagaagatatgaacctcacttgcgtcaggtatctgttcctggacaaatcaaccatggccaggagcagggcttataaataaatacatggcagctcctgaagtagccttgtgtacatgtcagagtacaattctcaggagacaagcagaagtgagcagaaacccatagaggccctctatgcctgctcacccattttggagtactcaccatccagaatccctatctgcttcactcagattcccaagagacccagcataagggtcaacccttgtacattcactgtattcctaggcagcacttctatctccatttggatctcctttcatgcctaagaaatggtgctggacagcctaggcacaaacccaaaagccttttaactctctgcattaagcttagatcttatcctatgtggccaaccttcatttctttcctgtgtcccaccttggaagctctagctaccaggcataaggcacctccagcccagactaaagagacaggagagcaaggaaagggtaaggagtccttgctttcatttcttgtgctgtttctgcacagtctgatgatgttgagaagcataagggaagaggagatcgccttccctctctgcccagcgtggggtgttctttcacctcctctcagtctttggctaccccagctgtgaagttaaccctctctgctactctctctgggaaggatcaccctcccctcccaccaagaagctgggagagcagttgaggcagcagactgctaaatgcccaggtcacccatgggaaactccaagatgcactttgctgtctcctgtcttttccatgcaatgatgatggcaaataggacaaatgagggtgcatagattcatgaacactgggtttatttgcgtgggttgtgatagtggcagcaaaataaaacatggcggtgccattatgcaccttttatctactgccacactctcctccaggtgactttattttctacatagataaatatagtaagaaatacataataatacatttattttttcacataaattgcagtcaaactacacctgtggtaggcagaataatgatctctcaaagatgtccatgttctaatccccagaacctgtgaataggttatgttacatggcaaggagaattcaggttgcaggtggacttaaggttgctaatcagttcaccttaaaatagagagattatcctggattgcccagatgggcccagcataatcacaggttcccggaaatgtggaagagagaggcagaagagtcggtgtcagagtgatgcagcatgagaaaaccatagctggctttgcagatggaagggggccacgagccaaggaatgcagggagcctctagaagctggaaaaaggcaagcaaatgaattcttccctagagcctccagaaggaacatcgccctgctgacaccttgattttagctcagtgagacccatttcagacttctgactcttagaattataagacaatacatttgtattgttttcagctgctaaatatgagataatctgttccagcagcccttagaaacaaatataaaaccccagtctctccccttctcatagaatctgaaggccaaattgttcatcctctttgtctttaatataccagcatctccgagcaccccgctgactaggagtgcctcttatagccccaatacgtgtatgtctcattctgatgattcaatacttccttttcccatcaataaaatacaacattcaaaatatgtatgcccatctaattttactgtttcctttacaaagcctctgactttatttatgtaacttaacaaaatagatttccctcttctaatacaataaatttcccttccgaccagtaccactcatctctgacactggccagcagattagttgctcgtaatgactttggctttgttgcctggttcaggttgtcaggactttctgtgttccttctccacgtgttcctctatagcatgtcttgacgcctcttgcctagaccttttttagagaaggcatgacatggcacaagctcccaggaacaatttcattcatgcttaatgcctgttgcaaagtcatattttttgctcttatgttgggtggtcacaaaaatctcaccttgggctctcaaccacattctcctaaaccaacatcaccatgagctctcaccacctctcttccacccacttctctaatgatattccaggatttttcttaaagagatctggctatgagcctgtatttcattacagcttaaataatcatattatttcccatttccttagttgctctctggacttttaagattctactgccttaggctggtcagcggacagctgccttcattgccatgcatatagtaataggcagctggagcctgcaggctcctcttgggaccaggtgctggctgaactctcaccacagcctctcctgagccttccctattgtcccctcagcccagcactcactcagggctccatatggggacttgtccacaggacctgacctggctggttggaccccacttcccaggttggagatgtgaccacatcgaggatctgctagaacacatttggggaggggtctgataaaaaccccagcctgtctcattgaaatctaaggaagcaagagggaggaggggaggacatttcatttttcaatccctatgttctacttcagggaaatctatttctggtcttaaaaaaaaattccccaataacgtaattaattaaaagaggtcctaccttttgccttgagctgccaagtggatgtcttttatttgagattcaaagctaactaaggctgagattattggaatggccagggcagatgtcctgggaggacaaagggggcccccccaccggctgtttgctcatctcagattttgagaatgccatggatgctgaaatgcctcataattgggagaaccccccaatatgtcatcgtgactcagatcctctggggcacctcagtacaactcgtcaccccctgaacaggatttcggttttctgctgctggcttgtctttgtgctgatctgagcaaaggagacaggtagcccagtgttctctctgtatccccacatccagcttgctctctcacattccctgtagtgggttgaatagtggagccccaaaagataggtcctaggccttacctgtgaaacctgtgaatgtgacctcctttgggaagagtctttgcagatgtaattcagttaaggatatctacataaatcattatggattatccagagactccaaatccaatgacaagtgtcctcataagacaaaaaagagagcggatgacacaggcacagaagaaagccatgtgaagacaaagacagagatgaaagtgatgcagccacaagccaaggcatgcctggagccaccagaaactggaaggaaaagaaaggaaaggaaaggagaggcaaggcgaggtgagacgaggcgaggcgaggtgaaattatcccctagagccttcggagggaggatggccctgccaacaccttgatatcagacttctagcctccaaaaccgagtataaacttctgttgttttaaccatttgtggtcatttgttattgcagccctagaaaactaacatattcctcaacatgcaatgccatttcttttataaagaattcaatcagcccaagtagctaagaagtggcttccaggtgcagcaccaacttgtagcctggtccttcctgccatagtgctttcttacagctcccttgcccaggttcattctgcctgagatgtcgtaaagctcttgatatggtttgcctgtgtccccacccagatctcgtcttgaattcccatgtgttgtgagagggacccagtgagaggtaattgaatcatggggcaggtcattcctgtgctgttcccatgatagtgaataagtctcatgagatctgatggctttaaaaatgggagtttccctgcacaagctcgctctctttgcctgctgccatccatgtaagacatgacttgctcctccttgcctcccaccatgattgtgaggcctccccagctacatggaactgtaagtccattaaacctctttctcttataaattgcccagtctcaggtatgtctttatcagcagcatgaaaacaaactaatacagctcttattggtgaagcctggccccagggaagatgcataccttgcaggagatttataggacagaggatgtgcctctagtgtgcccgtggtttcgcttgtctattttatatttgtagaggattgtcaagattctttggagatgctttcccattttctatcacaatggtcctgagtgctcaacaagcctgttatataacatgatgaacttgacaaagatcagttaaatgactcaaccaagaattcaaactaaggcttttcaactgggaccactgctgcttctaccccaggggtcatgataaacacctgggacagcgaggaggctctgaggtgtccgaaaatttacatccatcttcaaaaccaaaattaccaggggctctttcattttgatttgatgaataaaacatcttgtgtcctgaatgtttcagaaaattgaggaatgagatatggttctctcaaacttggatgtgcatatgaatcacctgggggatcctattaaaaagcagaatctgactcaggaggcctgggctgggacctgagatcctgcattgctaacaggctcccaggtgatgccagtgcagctggtttatggatcacacttccagtagcatgagatggcacctctgactaatttctctgcctgttcagcattaagctaattggccattattgccctttgcaattcagtagtaggaattgtggctctgactttgctgttgtgggagaagatgctgacacacaagctggcaatgcttaaggaaaaattttattgtggatcgataaccataaaaatattcataccttttggtcaaataattctgcttatggatatgcattctaaataaataacccagaagatgaaaaaaaaaaatctgtgtgaacaacggtgttctaccacagcactatgtatattaaaaaagaaaaaaatctgtgtctaataaaaaggaaacgattaagtaaattgtaataaagtcactcaatgcaaccaagacaatattgtagacatatgttcatcttctccctttcctcaaatgcaacatgtcactaaaggaacaaaaatggcatgaactcacaaggttaacaaactattaataatttcaacacatttgtccaagatacaaagtttacgtaattggggaacataaccacaggcccctatgtctgtatttgttattttttatttttttaattggtcagcgagtacaaggtatcaaagtaaaatcttacaatttttatacatttctgtatgcctgaaatatttcaaaatttaataaaaaagaaagtgcatagggacagagtaaagaacattctaacctacatgttgggggcagaagtgatgtgacaaagtgagccagttttcgcaacaaagcctggccttggctcttgaaggcactagggaccatggaaagcaggaatgaggcatggggctaacagcagaggaatggtcaagtctgtcacaggagactttgcacccctagatctcctgccctactaggaaacaatccttcccacctaccaccactgcaggagatgggcagttttttcttgagagaaattgagccacatacgctcagatctcagacacatcagatctcataagaggccacctgaaaataagagaattaatggaagctctacgcactgaactgtggggcctgtagggatggaaagtgtgatacctttcctcatctaccataaggattacggccaacactgctataacaaaagaggttaacaagagaaaagcataaatgcatttatttcatcagtttcacatgacacagaagccttcagaaatgaagactcaaagacccagggaaaactgtatttgtgcttaggttccatgaagaatgggaagccttgtagaaatgtgattggacaaaagggtgtgatctactggtaacagactgaggggaggaaacccagcaaggcctgtctgttcagattcttcttagtgtctctgagtagcattcctacctcccaggtaggacctctctggaatgagggttttcaagggagaagggagcgagtgacctttctaggttttgtggcttgctttgcaggagaggcattctagtttctatgacccactttggcgaaaaagaattcttgtttctatgacttacgtcgggggagaaaaagggatgggagacgggggcaggagagaaggtgaaagccttggcttctgaggcccttccattctcctttagttcaaagtactcagcatgccaacatactatactttagggtatcatgttctgagccccaacagaccctcagcccctccccgaccctgctctcaggcctccaggagccagacatatatacccacaggcaagagactgtcaaagtacaacctgtgggccaaaccatactccattctgtttttgcaaataaagttttattagaacacagtcacacgcattcatttgcaagctgtctatggctgcttttatgccacagcagtagagctgagtagtggcaacagacaccatctggcccacaaagcctaaaatatttactatctaggccctgcagaaaaagcttgccaatgcctgccctagggaaaaatagacgccccagaggaaagactccagatccctcatttggagctcccattaaaatactggtaaacttccctatgacaatgaagcccatcagtgacaagccccatccacacgcccactgagccgccaagcaggtttcagtacctcagtcttaagtacaaatggatgtccaaagattttccagacactccaggaaggctcagcgtgaaagagtataatcaaaataaaccgacagaaaaaaggaacttggaagaaccaaaataattcaacaactggaagaaacttacaataaaagtatagaactcatattatctgagaaatgagaaggtatttcatccataaaacaagaactagacactatgataaccaaaagtgaactctgaaacttagaaagtaatggctcaaaattaaaaaataaataaatagttaaaagagagtttaacaaaaagacaaggagatgaaaaatgggagggaaaataaacaattcaggatgtccaatattgaactggaaaaaaaaatataggacaagcaaacaaaggaaacaaagggtttaaaattagtgatgaatactataaaattcctgataattattttcttatctatcacacactgtgcccagcatagtaaataacaacaaccagcaagggccatcatgaaattgcagaacactctagcaataaagagatgattctaagttgacagagagaaaagaaactgaaccaaagaacgagaatcaaaatggatccaggcttctcaatagtaacactgcataccagaaaaaaaaaaacatggagtgatgcctacaaatttctaaaggaaagagatttttcacctagtgttctatgtctagcactatcagtcaagtatggagataaaagcatttttagacttgcaaggattctcatgcatcctttattacgaaactactaaaggatgtgcttcaacacaatcagggagtaaaagcaagagatagacatggaatccaggaaacatgggcttttcaacacagaagtgaaggaagtcccaaaaagatcattttccatcaagtctatagagcaaatgatccagtttcgagcaagaagactaaagacttcaggaaagaggatctctgggaaacaagaggacagaactgctcaattatttgatgtgtttaaggtataaaaaaatgattgctagatgttttacaggtttgttaaaacacttgcttggaaaaagtagtatgatatttagctgaacagcaaacaatttttatctagtttaataatgttacactgaccattgatttaacaaaaattgtaacacaaatctatttggaggatcacgtaagaaaaggagggagttgaggactggtgaatagaaagataaattcttgtctaaaataaaaaaatcaggaatagatataaaagcgtataatttagaaatatataggtagcttttagaaaaaacataaggtggaaagtagatgcctctctgagaagggatgggaggaaaaaataattgcttttgcttttttagtatatataatcatttggtactattttattattctaactattcacatacattttgataagaataaaaattagtctaaaataaattatatcaatctataagatcaacatatctattagatcataattataactagaaaagttgcttttttggaaaaaaatgcaaatgtttactccttgtggtctgctgatatttaaaagtctttatcataagaaagtccttccgttgggaatgctgagctggcagtctggtggagctgtagtgtcttttgtgtgttccagatgcctcgagaatcagtctttgtgggagggtggaacacaaacagttttgaccagtgtattagtatcagtaaggctagcataaccagggagagatgcaccaaggttcaggtaaagaatcaagtgaggaaaagatatataaaatgcatgtatatatcatggctgcaacagtgcaaaaatggtatgttcgttataagaaggaaataaggacaaatgaaaacagtttgatgtgtcagaagtgggagcggaaataaattttttcctttaatttagaattatgtgaagactgctataatgtttgtgtaaaacagaataaaggggttttctaaggaaatcagtggcattctttgctctgcctccctcctgcagtttaattgcctacacggaacaatatgtggaatatgaccctttgataacaccagctgagccatccaacccttggatcagcgatgacgttgctttgtgggacatagagatgaggtaaaaaatgttttaaggtttgggagtgggatgaatgtagacaaaaatccatgagatcatgagattaccttatattctatcttaatttgacattttttatcgctagaacagaaacccctcaagtagcctcccagctgagttctacttacagtttctacctccttatagctttgatttgtgcatggatcctttgtggctcccctctgaccctttggataccatgataactgagacagtccctcaccattccctagttctgattgctggaagaaaagaatctgttgttccaattttttttcctgttagacagcaacaataatgataatagctggcacgtattctgcattggccacatcctgcagtaagtgtctctcactgaatcccctcgacaggtaaacattactattctcaccactcagcagttatggaaactgaggcacagaggagttaatgaacttgcccaaggtcatactgctagtacagcagagttaggactagaactcaggcagagggctccagaaccatgatttcatcactctgttcttctggagtaactgccagcaacgattccagccagtttctccttccctgtgagggaagccactgtgtttacttaagaggggaggaaccaaagcccagagggacttggaccactttcagaattacagaaggaaacacacagacaaagctagtgtggtgtgccttcacaccccctgcaccttggctggatgaatttttatttcccttttcatgtctctgtcactcacattgtctttcacttttgccccttttctggctgcttttcctgaaatggaaaaaatcttataaaaataataaaagtcgcagatgctcattctaaaaagttcaaattatccagatgtgcataaagaagaaaatgctctcttcctccaacccgatttcaccttccagaaagaacctttgtttatagtctaatgctgtggttcccagagtggatcagagcaccctgagcactgtggggaactcacagagttaccactggatagtccaaattttttatggaaacacagcgatggttgacacatggcagatactgcataaactactagcttaagatggttcagtttcaacattagagcacgttacatcccttatgatgatacgcatctttgcaaatctggcttttcggagcagtcactatgataaaaagcaagaactgcacaaaaattaacatggaataagaaatagggacggtaagttccaacctaattccaaaatttaagaaaatgcgtagtgcccaataggtgcatattgtagttatttaagaatgaaaacaaaattttcaatttatgtgtctttcaaacagctactaagttgttaggatacaaatacatattaagttgattggtcctagccataataaatgacactgttaagtatttcttttggcccaggggcactgtgaaaaacttactgagacgctaagggtaccatgagctcagcaaatttgggaacatctgatttagtgtctattactttggatttttatgcacatataacattctatccttttgtataattgggttcaatatatatacccaaatatgtacatatatatatatagtccaataatttttaaattaacaataggtcgtggcagtctttccatgtaaacacatatagatccaccttactctttttaatagctacatactatcccctggcaccggtgaagtaagatttattttaccagtacctggatcataaatatttagcttatgtcctccttttttgccaccataaacaatgattccgggaacatctttctacacaagttcaattatttcatcagtatatattttccaggagtagaattcgtagaaatggtatgcatattttaattttagttcgtaggtccagattcctcttgagcaaaactgtaacacatctttttcattcccttagcttaaaagtgcccatttccccacattcttaccatcccaagcatcatcaatcattttgtctttgcaaatccaaaaggttaaaataattctcattttactgttttgtttccttgttaatatacttgagaatcttttcacatgtttattagacagattctagcaatatgttttgctttggatatttggatataaaacagtcacatttacttgaatcatatattttatctttttcctgatatatttctgaatctcattctttgttcttgtttctttttctcttccctgacttttactttattaatgttatattaactttgtaaaaaccctagtttctattctagttgtattaacttttaaatgttttaattaaaaacatcatcgatttaaacaaacaagagtgaagtatataaaatagtgaagttacctttgcctcccttaaatcccattcttcccagaggtatgttaacttgatatattttaaaccaacatttttgaacttgtatttctatgaacatttaaagaataactagtatatagtacgtatcttctttctaatatttctgatgagccctaggtagttccttctaagtcaagaacttaactctttctttaactcaggattttttttctcttttttaaaaattattgctgctttttttccattctatcctcacttttcaggaaatccttttttaagaagtctgggcctctgggatggagttgctacatcttttatattttctctattataatttccatcttttagtctttttattctatattcaaaggatacaatttcctgaattgctcttcagaatcactgctttgattttcactggtgtccattctgtgattttatactttagagagtttttcttttcccactgagtgttgggagagtggttgataatcaagcttttcatttccaagacttcttaatacttcttggactgttcttttcttagtagcctgctctgttctattggtgtttatcatgttactccccctggagatgtgatatagatttttttcatagtttatattttttccatattttcatatctcctctctatttctgccgcttagttttattcggggttattcattagagaatcatcatttctgctcattgtttcattcattcctctggtcactgctcagagcagatcattctttttgtatgcccagctatttggaagactgctcatttttataaatgaaggtcttagctttcaatcctgccatacattagaaccacctggaagtttctaaaaaatactaatgcctggtcctcacacacagccaattaattcagaatttctcacaattgaacattgttttttaatctccccacatttttttttaaatctccctttttaaatcagggagatttaaaaagtctaatgtgcagccatggcctaggactctatcagtagctggtgagggtgctctcagtgatggtatgggccaatggttctaagccatgctgtgcatcagaatcacctgggctcctctttaaaaatacacgcatactggggtggctctgggcgtctgcatcttgagcaagcaccccaggcgttctgaggcacacgacagtttaagaagtcctggtttggttcacggagttccccggcaggctttcccctgagcagttcacacaggagcagggctgcacctgaatgtatgaatggatgggcatagatcaattgccaaggttcccctctgggtcccgggtatgtggtccaagaacagattaaaagattgggccctctcttacagtgagacaggtggcaatgggagtcttggggaggtagacccccacccttcctagtgtgacatccctgcagccaagtgttctactctgtgggtcaagccctgatggagtttctgatgtctttctatttcctcgccaaggtactccccaacaagtcgactcttctccctccactaatgggtcttaggggaacccacttggatctgcgaaagccaatgagaggtggggagaaagctaatgtgtctttaaaatctccctggttcccaagatgttttttctctgtgtgtgtgctgtgctggcaggaacacaatcctctggccttactgtccatatgagaagctggccgggaaacatcccccttaacttagcaaacccttttggccatgtggaacctgatccatgttcctgagttgcttccatatgccccttgtctgatgccacccactgcctccacttccaatcctgctgctcagagctcggggtttcccaaggcttctgttggggacactcagctattttcttctctgatgcctccactggaatcgtaggctgctgtcgatcagatatgtcacaagttcagtctatgtgcttcgtgccttcctgaaatttctcaaagctctcatctgctgataggaaatttctttgcctctacatactgtgtttagtttttttggggtttttttgttgtttgtttgttgttttttttttacttaactgagctctgggcttttgcctgttccctcctcgttggccacttgtcccccagatcctcacatggctggcttcacttctcattcaagtctcactcagcactggtgtcccttcctcagaagggctttctgtgaccaccaatctagagtggccacctcatccctccagctgttctatatcacatcctcctcctggttccctttctaaatagaatgatttcagcgcctaggcctatctggcatacagcgggcaccgtgtgggctggagggaggatggatgaacaagtcattctttatttgatcgtttcattggtatttgggaaaggaggagaggcaaatgtgtgaacctaattcacaatgataaaatgaacttcctcttttgttcttgaaagtcagcaaagaagtatgtaatcatgtaggaaaatggggtcgcatggcctattggtttattccaacctattcagcactttttccccaaggaggtgctacctgccccctactactcatgccctggttctactcctgttgttctagcttcgactctgaacttcatgcctaatctaggatagctacagtgttctgtccacttacaggcagaatcaagtgttcagatacaagtgaaaacgaagccctgtttcttctcccaacagactactcctacccacttagttgctggcagtgatgttaggaaaaaacagggtggaatcagtgtcaacatcacactccagccaagggatggtttctgtccacaaaacgaaggctgaagatgaccaataaaataattgagtcactttctctcggtttcagtttaattcaatacatttgtatagtagtcaactatgtgctgtgttctgaacaagaagggctctcaagataacaaatgtagcaaggtaaataaaacatgctatcttaccatctggcaccagaactcctccttgcttggcaaaggacattaagccacttggggcagaaggtaaggccctaagggcagaagggttggcagagactgaaacaacaaagggagagggttgtgctgtcctgctgagaaaacgagacaaatgtattctctgttcctgagaggggagaactaagggcaggggaaagcaggggagggagagaagccagaggccaacaaaaactaagtctctgtgcaaggccagggaaatgcctagcattgaggtgaccagggacttttcaaaagcaggaatgtctagtatgtgcttttttaaatagtaggctgccaggaggtgcgatatgtacccatttttcaagaccctcaaattcctgtaaggcccccaccctcccaaacgcttcatgagaggaggggtttggtgggtgtgggtgaaggtttgtgggaaaggagagacagtgagaatgcaggactcccttaggaattcctgccaatctcaggtgggctttggacttcactgggctgggtgaaggggtccaggcaggctcgttatgatttccagggcccaggatgtcaccgacaatgtctaaattctgcaaggtggagaatatactgagtctgccgtggggaggttacagacagccaaatggaggatggccatagcagctgaatagaatcacggataagatgacataggatatacaataaatagcagaaaattgtgctttaattctttctccttctcagacaagctattcgatctggaagtccaaggataagaaagttatattcagaggggaaaaaaaggcaactgttttaaaggatgggcaaactacacctcaagtttatgcaacatagtgagctgtgatcgcaccactccactcccgcctgggtgacagaacaagacccctaaagaaaaagagtaaattctgagaagtaaagtttaattaaagaaaatagtgattgccagggcttctcattgaggagaagtcagtcaaaagttgccagatgacgtaattctttatgtcatctgaaaaccaccaggagagtgtcccagggatacgtatgtaaagtatttctggtggtgccactaactagatgctggagtctaatgaaacctggtgttgtcagcagaatgtggtttgtgatttgctctctccgcatgacttcagtttagctctccctctctgctgggtatcaggcacatgagcaaagagctacaaggaacctggcttgtccagcttggccgtaggcattcactcccagccaacctgacctgctgagaggcagagatcatccctgagctgcccatgcacagcgagtttgacagaactattaatccggaatattagtcaagctcctttcttatggtggtggatctccaaatatggccccattggtgccttccctctttacatcaagtaggacaccaagaccaaggccagatgaaaagagagggagcacctttttccctctctcaaactatttgagaaccagtaatccagaacccctgtggtggcttccaccttggtcatttgaaatatttgctcttgagacattccttcttggaatccatctgccatgcttggagaagcccaagccgttggagaggccatgtgcagacagtctggtcagtagcctctgctgagctcctggtcagcaactagcatcagctgttaggtgatgagccctcctggatgcacagcccagtcaaatctccaaatgaccccacctccagctgccatccaactacaaccatgtgatccccaagtgagaaccacccagtggagcctagtcaacccataggagagtgaaagagactaataaatggcttttttaagcccctggattttaggatggtttgttacacagcgtaaataactgggccaggcgcggtgacttatgcctgtaatcccagcactttgggaggccgaggcaagcggatcacgaggtcaggagtttgagaccagcctggccaacatggtgaaaccccgtctctactaaaaatacaaaaattagctgggcatggtggcaggcagctgtaatcccaggtactcgggagcctgaggcaggagaatagtttgaacctgggaggcggaggttgcagtgagctgagatcgtgccattgcactccagcctgagcgacagggtgagactccatctcaagaaaagaaaggaaaagaaaagaaaaagaagtaactggaccactcttcattggagtattcaggaccctcaggttgttcttgaggtattaaataaaattatgattgtttctttagtagccttggctctgagatggggacattggattattttctttttaaggaattgccttatttcgtaatttttctaataacttgtcttagtctgttcaggctgctacagcaaaaatgccatatactatgtggcttaaaaacaatataaaaatttttttcacagttctggaggctgggaagttcaaggtcgagatgccacagattgggtgtctggtgagggcctccttcctggttcataaatgtctgggtcctcacatggcagaaaggcaagagagctctggggtgtccttttataaggacactaatcccactccacgtgacctaattacctcccaaaggcttcacctcccaaaaccatcacattaggggtcaggatttcaacatataaatttgaaggggaacacagacattcagtccacaacattctacctcaagatccccagaatttatgtcatcttgcatgcaaaatacattcattccatctcagtagtccccgaagtcttaacttgtcctggcatcaattctgaagtccaaagtcttatctgaatatcatctaaatcagatatgaatgagattaaagataccattcatcctgaggcaaattcttctccagctgtgaacttgtgaaaccaaacaagttatgtgcttccaaactacaatggtgggagaggtataggatagacattttcattcaaaaagagagagagagagagagagaaataggaaagaagaaatgggtaatgggttccaagtaagtccaaaatgcaacagggcagaaaacattaaaccttaaggctctaggaataattctctttggctcaatgctctgtcttttagacccactggggcagcagccccacctccatagctctcctgggctggagtcatacacccatggctttcctgggctgatgctctggtcttccaggcccatttgggtggcagcatcatccccacagcttggtgggatggccctacagcagctttctcctggggtccctattgctttcccaggctggggttcctcacctgcagctcttctgggcagcccagtccaccatggctctgctgggtgcagcccatattgcagctttctgtggggaccccatcccaagtcactgggcaggagcatcctgatctacctaaattgaagagacgagttgatcctttaaaactgttctgctctcctactacatgtcccttgaactctgggcctatggtgcaagtggcagccctgatgaactctgaattgcttttgagtaattcttccattgtcttgaagaatagttcctggattctgttaagatgactcatccatactaatatacttatcaaacagtcacttggccacactattagtggtctcattttttgcatatgaatagacaaagaatttttcagatcttcaggttctggtttctttttgtgcttaacaattctgtctttaagtcacgttttactataagtagtcaggaagagccaacctgcaccttcaacacattgcttagaaatttcctcagctaaatatttaatttcgttgcttgcaagttttacctttcacagaatactagaaccaaataaaattcagccaaattctttgccactttataacaaggatcaacttttctccagtttctggtgatatatgtctcatttatgtctaaaactcatcagaatggcctttaccatctatatttctaccagtattctgttcaggattatttaggtattatctaggaagattgaggctttctttatagctctcctctttactttctgagccctcgccagaatatcctttaaaggcctggttacagcagtttaggttcctctcccctcctctcccctcccctcctctccccttccctctcctttcctttcctttcctttcctttcaagatggagtctcactgtgtcacccaggctggagtgcagtgtcgggatctcagctcactgcaacctccgcctcctgggttcaagcaattctccttcctgagcctcctgagtagctgggaattacaggtgcccaccaccacgcccagctaattttttttttttttttttttttttttttgtatttttagtagagacggagttttgccatgttgtccaggctggtctcaaactcctgaccttgtgatccgcctgcattggcctcacaaagtgctgggattacaggcgtgagccactgcacccagccaatttaggcttttgctgacatatatctcaagacccttccagcttctattcattacactgtaagccacgttcacatttttagttgttcattacagcagcttcccactcacagtacgaacttctgtcttagtctgttaggactgctgttacaaaaatactatagactgtgtggcttataaacaacagaaatttatttctcacagttctggagctaggaagtccaagatcagagtgctggcaaattcaatatctggtaaggatctgctttctagttcatagatggctgtcttcctgctgtgtcttcacatgacagaagggaaagggagctctctctggtctcttatagagtactaatcccactcatgacctaatcacctcccaaatatcctgcctcctaatacgatcacattgtggatcaagatttcaatgtattaatttggagagggacacaaacatttagtccttaacataattcttaagtgttttgaagatagcttgtatattccccaagtcttagtttagatattgattgaggcaaatgtagtagaaggcaaggtaacagagtggaaaaaaagaataggctttggagacaggcagtcctgggatccaggtcctggctgccacctaccagctgtgtgaccttggacaatctgacctcttttgaactctggatgtttaaatacaatgtcagcctccctggcttatattaagatttaaatagggcactgtaaggaaagctccttacaccatgtgtagcactatgaagctcctgcagaaatgagcattgatatagacaattgcttcctttgaatctggctttcttgtcctcagtttggtaactttcctccatctctagctgggggatcagcagaaatgaaagacagacacccttggagagctttgctatgtgttggtttgggctgtccagtgggaggcaggaacttgataagaatgaagaggcacagaggacaaataagagttagaaaaaggcatccagctagcgattagaaaacactgtcaggataaggacacttcatccacatcactatacacatttctaaactgatttcattttagtgctgaacacttgccatgtgaaaagtcctatgctcattacaaagacacatgaaatatggtccctgacctcaaagagctaaaaaaaaatagctggaaagacaatggcataaactctcgaaaatccaaatgctgacataaaactctactagagaatatgtcccaaggaaatatcgctacacaatggatgtaaagagactgtgcttctgtggattgtttgcttgaatttggctgagggacagttattgtaccacttacctggagatggatgttgaaagatattttaatttgcagaattattttataaccataagagaccattcagtggtaacaacatgttcaagtcttttcttaaaccttgaagtggatgatattgggaatactcaagtgatacagaagagatatgtatagggaagatgtatctaggaagcttttaatagaacagactcccagtagtgaaatcgtactaggaaaataaggaagaaatgtggatcatccagttgtagtaatacaattgtgaataatggatagttgagggaagccaagtatacatggttacattgtatcgactaaaaattcatgtctttcccagaacctcagaatctgacttatttggaaatagagttgttgcagatgcagttagttaagatgaggtcgtacttgaatagggtgggcccctaatccaatatgactgatgactttataagaagagaaagcaggctgggcatagtggctcacgcctgtaatcccagcactttgggaggccgaggcaggtggatcacaaggtcaggagatcgagaccatcctggctaacacggtgaaaccctgtctctactaaaaaaaaaaaaaaaaaaaaaaaaaaaaaaaaaaattagctggccatggtggcgggtgcctgtagtcccagctactcaggaggctgaggcaggagaatggcgtgaacccaggaggcggagcctgcagtgagccgagatcaccccactgcactccagcctggacaacagagtgagactccatctcaaacaaaaagagaagagaaagcagagacacagacacttacagagcaaacaccatgtggagacacagaaacacaggaagagagagtgcagtgatgcatctgcaagctgaagaatgccaacatcagaagttaaggaaaagtcatggacctggttctcccctaaagctgtccaatagagcatggccctgtcaacaccttgattttggacttctaggctccagaactgtgagagaataaatttctgctgttttaagccacccagtttgttagtcctttgttatggcaatcctaagaagctaatacaccagggtatcctgtctctctagacccatttatttctgctgaactatgaccttgccattttccagatacccccaccttctgtcctaagcatccctctgattctacatctacagtgacaccccaagatttctggcccactccaaaaattgcccttctcccactcttgccaccaccaaggaatctggtggaatgaatgtggactcaccacttgggtaccagaaaggggtgacactggtggtgggtgtgcatccatgaggcagtcactacaaagtctgagtgaatttctacagctgctaatatgggcacagccctcattcgagtacagctgccactagtaccatccctggagagccctgaatcctcctctggtaaagagtaaatggttgggtccatccttggtcatagcatgaccttggcagaaagagacaatgtcctgcagtctctggggcttaaatttactgccagcctcaaccccaggggaattcttccacaaacagtatttttggttcccttgaaagttattgagtttgattaggtctgtggcttgcgtttgagagaatccaggatttgtcttcatgtcttgttgtgaaaggcctagcctggtactttggaagaggtgtttcatggagtctcccattgtttgacctgatggggttagtctaccaccatgaccctattggactatgctggaaatgcagagttgcaagccagaggctccctgacctccaggctcatgatctattggtcatcatcattgtaattagaagatactgctgttgctgattatgtgtgttggtgaagaagtagttgggtttggatgcggtatgtctagagctgcataccaatatagtagccactagccacatgtagctatttaaatttaaatttgaatcatttaaaattaaatgaattttaaaattcagttcatcagtcacactagccagttttcaacagcccaatagccacatggggctagtggctgccatattggagagcacggttatgggatattttcatcattgcaggaaattacactggacagcgccagtctacagttatttgctttcccaagctttccacgcacacaagctcctttttttttttttttttttttttttttttttactaagtggaattttccaagtattgagaatatgtcagctccataataagaggaaacatgatttaatctcttactgtctgttggaaataataaaatatatgcatctattttttaaaagaggaaaaatgagtattgctagaccaatgtttcccaatttgtaatgtggacataaatcacctagggttcttgttgaactgtaggttctgatttagcaggtgcaggtggggcctatggttcttcttctggttcacagaccacaccttgaatagggaagagttgtagcatgtgacttgtgagttaggaccttatcactgtttaaagggccaaggacataaatacagcaagtgaactttaaatggaaagacagaagctgaaggaaatactcttatcgcccaacaccagaagaattagaccaatgcccattctttagtctgaatgtgagacagcatagcaaagatgagctatgcagcatggcagaattaagaactggggccgggtgcagtggctcacacctgtaatcccagcactttgggaggctgaggcgggtggatcacgaggtcaggagattgagaccatcctggctaacatggtgaaaccctgtctctactaaaaatacaaaaaaattagccagacgtggtggtacgcacctgtagtccccgctattcgggaggctgaggcaggagcattgcttgaacccggcgggcagaggttgcagtgagccacaatcacgccactgcactccagcctgggcggcaaagtgagactccatctcaagaaaaaaaaaaaaaaaagacctggtgccctctggagccttgctgtctagatttgattcttgacttcattacttcctagctgtgtattcttaggcaaactaccatgagacctcaccttccctatctggaaaatgggaatcatactagtacatttttcacagagcagttgtgaggactcagtgggttaacagatgtaaaatgcttgagacggtgtctagcacacggtaagcactgtgcatggttgttaaatcaataagtgcatgtaacattctgcttctaacaagagaatatgctttactctggatgtgtcaatacatttctgaccagttgtacatcacttggcttgaaacaggaccataatttctcccctgaggattgaggaaggggtgggaggtggaggatagtgtgttttgatgaaagattgggtccatgaagcatcctgggttatagtactagtgaaaaaattagagtcaaaagttgagtccataattgataggaatggtccagggagtttaatcaatggcatggtagacagcagccatttgaagggcatgccggcaaccatcacttaacatgcctccttaaagaaactgttcatcattggttactgttggtgtaccaaagtctgcatttggaatttgtgcagcttttgtagaatctgccccttaaatatgagatgtttccctttggtgagtgactgcaaaacagacttgagtcactgaagagaatatgacacgagcttttctctggtattgatcttctttaaaccttcttccttcaccccaaagcaaagagcccagccaacagcgagtaaaaagatggggcttctctttcgatgagatattgaaggaccaggtggggcgggaccagtttctacgattcctggagtccgaattcagttcagaaaacctcaggtaaatctctcaaagtttgagctgtgtgcggaatgtgtgtgaagaaatttgcataatcggtctctccatctctctctctctcaatgaaacgttatcagggttcaaattcaaatgccagctaatctggctgaggttgaaatggagaagaacaaattaaaatatgtaactctgtcaccaccataatagcacctactaacaccagcatgtttcagttcaagtctatatgacctttgtgcgactaattggaaataagtcttcaataataattagtcaaacggatttgacaacatcattcattaagtacagccatagaaccagggagcttcagagtggagaggcatctcagaggctgtctcctcaaaacttcccagtctggggtcctgaatatctgagaagctaaacggaagagggagaagtcagtgggctcatttcagaatttcaaagagcaaagtaaatatcactcagtaactggtgatgtaactgtagcagctacgtaacagtagcagctaataaaaacatgcttttttcttttagaatgacttctgtcgactccaaatagtggttactctgatcatctgacgccagtgagaacacctgattgttcctattggtctataactaatacttgatgagggaaatgtattaataattactatttaataggagaaaaaaataagatattcaaaacctcaggtccaatatgagaggaagaaaagggggtgaattgaaaggaaaagtctccttggttatgaaaaatttgggaacttgtttatttagacttttatggtattagatgaagaatcagaaatctgcagaaaatgtgacttatctgagacttatctagtgatcttagcaaactggtgactttttaatgggtaagatggaatctctctctttcttttttctttgtaccagattttggtttatatagtagagtaacacccatcttccagtgctgttttctttaaagatgtcttaataatgtttcaatattgtattactttaaaaactcagagcatgtgctgcgggcaaaggactgcccctccaaagttaatgtgcaacatccatgcacttatttgaagttgagaccatcggtcccatacgtcaatcaagtgatatttatgctacacctgtgctgtatcaagccctgtgagagtctgctgagagatgcaagtcaagatgtgtgatctttgcctgtaacgaccttgtaggtccttgaggaaaaaacacaagaaatgattaaatcattgaatgtctataaatgagtgtaaactctaagaaccatttcgaaagcatttaaaggagaagaatcaaagctgaagtagttaaatcataagctggactttgaagaatacacaggataatagtagacgaagaagcaggagagagaatattccaagctggaggaccaaatgaggaaagaggtggccgtgggactctcccactccataaggtcctgagaggacacgtagatgccgactagctgtatggagcgtgctgttctaggcatccacgtgtctgttataaaccagacaaggttgagtatcttattttgggttattatacaagagcctttccttgtgctgaagcatgattccaaacacatctcagagcttcatttcaatgcctaatgaagcatttgtaacagaaggcttgacttctaatactcttcactagggtggtgctcagactagcctccctgtataggaaggaaggctctctgtggccagcttgatggacccaggtggcctctctgtgtagccagctcagtcccagtttccaccccctccatggtccctatgagccacccctgggagtccttctcatcttcccttcttacctgttccccttgggtctccaagatggagcggtatagaggccccctttacctaactacctctaagcccgtaagtagcctcaggaccctctgctgcctgcactcttgcagagagcttgaagaatgacccagagtttggtcattgtgagggtcccaggagcatccactggctcagctgccaccttgcctggtcagagcattcattctagaaagtcccgagtgtagccagaaccacatatcagttcagactagtttcacaaattatgcatcacacttaaagcccagagtgcaccaaggagtgtgtccctggcaggtgttcagtgcttcttcctgccatcacctcctgcgcctctgccagctcctttccccatgccaggagggctacatttaatcttgggtgaaagcatgcatgtgagcatgtgttcatgtgccagagcctaagccacacccccagaatgcagaaatccagacttcagagggtcacccctgctccatgacaggaaaggaaatagaatagcagggaggaaaaggatagccaagagcctctaaaatcctctctggatgcccaaattccatttttatgatattcagcataactggatacatggtgggtgagagagaagctcagtcgtaaatcacataactgtaggactcttcagtcacccatcacagggcagccttttccccgttccattgcgttcatcccttcagctgcagatatcatcttagcaccaaccgtggcacagggctggcggatttagagctgactgagtaaatatcagggtggccaggcatggctatacagatgcacctccactgtggctcatgccatggaggcccctgggagttgtgcaatatggcacaacttgaggatcctgccaacctgtcatgttggccgtgctggagtcgtcccttctccgcaggattggtgaggggcccaggccactggcattggagcatggcaggaaaaagcctgaccagaactcacctgggtaaattacaaagtgcttctccacttcctctgtcctcctgtgctccctctcatctctccagtgaaagggctgcttagatcataacattcttgcacaacccacggggtgccagttaagtagccaagtggctgaatttctatcagagcttcagaatgcggaatggaggagccccaaagtgtcaccctggatcctttaaggaacaatttctatgatgatgtaatagaagttgacatcccctttgatcagtgtcttctgggtgggtctgtgagatgagggtgggggcatcatctctgtggactgggtggggtatgaccagcagcgcattttgctgaagctgtgagctctctgtggcagggtctacctctttttctccttttctgacccacctgagctgggtgcaggctccctttgcaccgagtggacccacagacagctgtttgttgagtgccttgggaatgctcatggcttctgtccacaaggcaggggcctcacagctctgatgcagggagctccgctcagtttcttggcctcatccttcttcctgctttgtgcattttcccagaataatgacagtcactccttcccatctttgctccctctcccacatctcccctacacaaatctttgtcctccctggcttgacaccctctgctgcacagcagagaatgagttaaaaatcaaaacccacagcaaagagtgtcccccgtacattttttgtgagctgtaacatctcctgagagaaggtagttgttcttctaacctgcagattgatgatccgagttccacacagtgtcggctgaagggagaagcaattaaaagagaacacagtggggcaccaggttcatctcgagagctcttgtctctggcagttgccctgagtccaaggaagacctcagaaggttcactaggcccagcaggatccaccacttaccaaacccatgattaataggaacagaggtgactcccacgacaccacaaccatctgcagtgtttcagtcactgcccagtgaacagaactcagcttcagtggtgctgggggtggttactaacgtaggcaccccggaattttagccccaccgggaactaaaccaagtttaagctctgctgcctacgtctctggttgaccagcagagggcatagaaacactttcttctctcctggagtttgctttttctctgggagcgaaccaaaagctgtattttctaacccatgaaaattctagtttatgaaaagatatgtaaactggtgactgagggcctgcccagacctcctggtaggatggagaatgatcaagggccaaatggtttgtcttacccagccagccttgagaaaatcctcttccttgaaagcctctagggagaaaggaggctcccactggggcagcccctggatggtcctccagccctgttctccactgcttcgccccagtggtatctgagcccaggctgcctcgctccaaaagctagtttccccgccagcatttctaagtcatgaacacggatcaaatgcccgcacaggggctgcctccctactgcagctatgacaattggcagagaccaggggcaggtcaggacaggtggtctcccagatattagtccttgtggcctgccagtcacaacggcccttctgctgcaagccatggaggctcagtgcaggatggatggatttgatgcagctgctggcatttcactccctgccgctgcccttggggaggagcggtacctgcaggttttttataagagcagaagcttccaaagcttcaaggggcttcccatgggcagcagatgtgcagagaggagctgctgtggctctctgcagcggggaatgtggcctgggctctgagttcccagctcaggcctgtggggctcgaagatggccaacactaaccaaagcctgttctgaatttcaaattgacacaaaggttcctcaaaaccagtgatggtaaacacatacgggatgtcaggatgctgctgtgacagcagttttgctgttgcctgagagagacaaggcaggtcaactccaaggcagacagaaggccagggagagtccccagtgtgtgcagggagagaaaactgctgtctagggaatgttaccccataccttccccctctcccttcttgccctttccccctccttccctccctttctctcccctccccttcctcttcctccagcatgcctgttgttttcacttgtacttaaaaaaattcttggttttatgtgacaaagaaaacctttttatttttacataaaagtttattaaatttgattccgcggcctggtgcaatggctcacgcctgtcatcccagcactttgggaggccaaggcgggcggatcacttgaggccaggagttcaagaccagcctggccaacatggtgaaaccccatctctgctaaaaatgcaaaaattagctgagcatggtgacatgcccctgtaattccagctactcaggaggctgaggcaggagaatagcttgaacctgagaggcggaggttgcagtgagccgagatgtagccactgcactccagtttgggtgacagatcatgaccctgtctcaaaaaaattgattatgaaatttgtatttccatcagctccggtcatctctatatccagctgagtgatgtacattttcatgtggcacccaaatcatcctgcaaaaaggaccctgagccctcaggaaccgcagggagcctgcagagctcccagggtcctcagggccttcccacaggggctcagcagctcctcctcagtgctgacagaggtgacagaaagtgacctcccatgtggcattgattgagggggcaggaaatcacccaggtgtcatccatttgtgtgagaagttgcaggggcccagggggcgtgggaagacgctgacccagaaggttgcttccagccagggattcagcccagacggcctccctctgtgaacctggttctcctgtctgcctagcatggggctgaggaagcctcactgacttcgtctctggacatttgaccccttctgggccttggaaaagccaacactggcttcttcctatagagccaggttccccgcatctttcacctactggtcagacatggccttccaggcagagaaagccttgtaggtactctcaccagcagatggccattttcacttggcaagcctcccggccacttccttcttttcacagcagacctgagagagtggacagagagccctacagaacctagggcaggcctgggagatggaggagacccatgccccagctcaagagtcaagggcccacctgaacaatgaggtaggggaacagctcctttcaagcccttccttccccaccctctctggactctggataaagaaacacgactgctttcctctcacccagaagccagaaggacctgagcacccaggacttgtggctgtcagagagctgtggaagggcaggggacaccagatggcagcagcaagagctgggcggcagcatctgcccaggccacctgcggagagaaggctggaatccgagggatcacactgggccagcattgagcctgtggccaccacactgacccctcctcagctccccctcacaggacctgaaagcatttctgagttaagtctgcataggaagttttccagagccatgccacatatccctccatccactcagtgcccattttacagatgaagagagaggcacccagaaaggtacaccaaggcaagatatggcgtagacaggatgagggcagagccagcttcctgatctgatggaagtcatgaagccttctctgccttacgcttggctctgcagggtcgctgagaggttcctttaaggagatcatcagaatcctaaatggcaaaaaatggcaaatcaggggaagagttggagcccagcatttggggacacacacacacacacacagtcgtcttgccttgcagaaattgggttgcattactccagtctgccactgagtggcacctttgggccatgcacttggctccaaagacatttctctgaacagcaacagaaaaacatgtttaaccctaaaaaaaaaaaaaaaagaaacaagtacatcttactttggatgaaatttgatgacagattgaatgcactgtctgcactttccaccacgtcatgtttcagcttcgcttgtccctccctttctgttgactagactacctgtgattcccgctgctctcggaaccagcacaggacctactctcttactcactgatgggggagctggcctgtccatgcacagggcaaaggatatgacacccagacctggatcctgctgcaaggctgccttgggaaccatccttaagacccggtagctgttgtccaagctttggctctggctgctgctgctctcagcagaaaagagctcactgctcccatgcggatgctgagggattaaacagaggcaaatacggaagtgagcagatttttctctcttgctctcagcagaaggagaaccattctgcagagaagttttcaacatatgcctcttcagcattgctccagatgcgtccgtcttcactctgaaacccatatattgagcacctactatttgccaagcaccgtgctgagcactgatgtgaattggctcagtttctccatctataataggaatggctggttcattcttacacagatagtctttatgattccaggacactgcctgcttctgggatctctcctccattttgatgccatcacttgatcccaactagatttgacaaagggtctcacactgtctgcatggtggcatgtatgtagcactggggttctcaaccaggaatgagttcatctcccaggggacattgggcaatgtttggaaacatttttagttgtcataacttgggaaggggggttgctattggcatctagtgggtagaggccaaggttgctgctaaacatcctacatttcacagaatagcctcaacaacaaagaattatccagcctgaagtggcaatagtgctgaggttgagaaaccttcatgtagaaggagagaaatcccgttctgataacgagaagcacattgatcttttaatatgcaattcttttctgttctgcaccataggaacacctttgatgttttcacaatctccatggtctttgcagctcatgtagtggcatcagggcaggctgagagatgcagcagaatgggtttcatgggacatcagctctggggccatctcaggcaacatcccgatgctgagccccctggaactgactgtgtttctgctcccacttcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggtttgcttatctactcaagtggttgtcataaggtgttcatttgtccccttcattgcctgacctattaacacaagttcaaggcattgtgggtagttaaaatttcagatttggttatttttaagttcatcagtggaaaccatttcagataggcgcacagcaaaatcccaggatcgttttcctagatgggttatgtattacatagaaaccaaaatgtgcagttatatgctttatttgttccaggaaagcctcaaagtgttttacaaaatctgaaggcttgtaataagtcagtgatagaatctggaaaccagaacacagcattggggaagtgggtgtagtgagttagcagggccatgagtcaaacccacatctgtctacctctgaagcccacactgataaccacctctctacactgcttccgcagtgatctccagctctgcagtgaatattttttaagcacatctatattccaggctctgcgctatgtgataagataccacaaagaacaggcaaaacccctgttctcaccgaggttgagtgggagacagacaagtaaatgggcaacttcaacagtgtgaaaagtgccccaaatgggtgaaccctaggttaaagcaagcctgcaggagggactcccaaccctgtaggacacaattaagatgctcacagatgctagtgatgctggctaaagaaacaggaaccaccctaaccagcagactaaattttgacggctgggaggtgccatttctaaaaataagcattgggttggtttcttacttcctggcccctaatttctatttcctgtcaccatcccacacccagtgacagggcttaagattttgcttatctccttgaccccacttacttctctcacctctggggcccccagtagagaatttgggtggtttgccccttgcagacattattatctgatttaggaaactcagtgtagctgcaccaatgcaaataatggcatgagaacagtgtcccttatcatccagaattaccttgtcatttgctcagaacttcaagatggaaacacctaccaacctcaacaccataactatctacttctctccccctggtcacgagctccatcaaatgcctgtgccaatcacgaaatcatgactccttcatataccccttgcagcttcaaagcagaatgtttgagtcatgagagctctttgctgagatatttttgcttatgtgtatgtacgtatgctttcaagcaccatattgacatggccagagaggagagtgacaggggagttccgtgggggttccctgcatgaacaagctgaagctcaaactccaatatttatgaaacacaagaagagggatactggtcaaaaccttgatgcatctagcacagtattaacactccaagcatgacatcaggagggatttattttaattttttattatgaaaacttttaacacttggaaaagtggaaacagcaaaacagcaaacatttatagaccctcatccagcctcaaaaatcatcagtacacgtctgatcttgctttatctctagccccatctactttttcacctgccaccaggttactttacaacaaatccaagatgttgcatcatttcatctgtaaacttagatatgtatctctaaaaaaaagatccttttgttttaatattgccacaatatcctttatctccctcccttcctcacatccccttgcaatttatttgatgaaggatttagatcctttgtcctgtaaagagttccaagctctggatttttctgattgcagccctgtggtgctatttagcatgttcttctatcatctctctttcctataaattcgttttataagatatttaatcagatttaggtttgatttttatggacaaaaccacttcatggattgtgtggtgctctcctatcagaaggcacatgtctagccacctctctttttgacctttttgcagatattgatgtctatcgcttatatccattagttaattagaggttacaaaacaacaacgtactaattttattctttcttcacttattagctggaatactttcataaagagaaacttccctccaccactatggtattaactagcagtacaattcacataagaaaagcaggataaatatttgattctctcccttcatttgccagttttcaaaatgagtggtttgctattatcttcctatggtaaacattagggtctattttggttttactatctttgtaaactcatgagtttaaacatatatgctatgttttaatccattttgctgattacttttattgatgcttggattgggccatctctggccagttggctctttctgacacagccctaagagtgatctttgacatcatccaaatagcagggaagctaagatattccagtctttgcccttacccagaataagctgtttctccaaggatccctgattcctcttagtgagaaatggtatttagagactaaaatctaggcacttagagtgtttcattgttcctggattgtttatcatttccagcccttttcagtcgacagagctaggaaatgtgttgctgtttataataaaaatacatcctgagttcatactgatacttttaattcaaattctgacctacaggggattttatttaaccgcttgtttcttacacctgtgcctcttttctctatgctgacaatcctgactttcaagggcactggatgatagcataattactcatttgctttatactacacagagcagtctctaaaccacaatgctaaaaatacagcaacagtatgattatcgcctggttctttaattgttgcatagtattccgttgtgtggaggcaccatagtttagtcaaccagtcctctcttcttggacatttatgttgtctctacttcaagaaagttttgatggaagaagtggggaagtcagcctaacgaaggttacatattgacaagtatctcaatatccaacctacagtgctctaccattttccaagtacttctaaatacattctatctaatttctacagcaatctagactagacatgaggatgtcttaagcatccccatcttcttcattatctgctaggattagtctcccatgaattcaaataaaacactcttcctaagccaatccctattttcagaccaatttcctattgcttctgaagtgtatttccaccataaatatacaaagtgttcctttctagcagagtgaccttggacaagttgcttaaattccctgagtcttcctttcctcatctgtagaacagggatacaatggagcctacacataggggtggaatggggaccaggtgaaaggaagcatgtcaaccactaacgatgtctggcccacaataagacagagtaaatactaccatcttatttttctaatgtcactaatattctctttttaagccgtagtgtttaatgtatttggtaaaaatttttaaataatttcacataaccttagcacccagagataacccctattttggtgtattttcttccttgatttatgtgtgtagctacgtgtaaggtctgctcaggctgctaccacaaaatagcacacactgggtggcttaaactacagaaatttatcacagttctcgagactgacaaatccaaaattaaggtgtcagcagatttggttgctggtgagggctcacttcctggcttgcaggtggccgccttcttgctgtgtccttataactctggtctctcttcctcttcttataagaacactaatcccgtcataagggcctctctcatgacctcatttgaacctaattacctctcaaaagacccacctccaagtaccaccacactgaggatcagggcttcaacaatatgaaatttagggagacacaacattcattccacaacagggcgattttgcaaatagcgtgatcctgtaacctgccttttacctaaaacaggggtcagttaaaaaactatacttttcctaaaaagagccagatagtagacattgcaggctttgtgagtcatgtggtctatgtcacaactattcgattctgcatacaaaagcagctacaatgcaacaacatagcaatgtaaacaacataaatgaggacctatggctgtgtttatttatgaacagtgaaatccaatttcatataatttttcacaaaatacaattcttcttttagtttttttcagccacttaaaaacataaaaactgttcttcgctcatgggatgtaaagatctagatcacaggtctgtatctgtagatttgaatcacagactgtagtttgtgaccctgtgctaaataaaatctagcacatggtcatgaaaattattgaaatgcttcaagaaatccagaaagctacaggatagaggattgggcataaaggatcttcagtttttgggggagagtaagttagaggagacttggttttgacgcagccatggcaacacagcaatctgaattgtgaatgtttctacatgaggattgagtgttgcggagcagaggtcagcaggtgccaagagactcacactgccttaccttcctggacagcactggctgcctgccccagcaaagtaggtgcagttcagaagttcccaggtataaaaaggaggttaaaatcctcagcagcccatgaccagccaggacttgcactcagatgtcctcgcttgctggccaagattctgctcagaccacactgtccctggattgttagtgctgagggcttggtggtcgcactgagacctggagaagttctagtccctagagaaaggccaagagtctgggagttccttctagaattatccatttaagttctttaaactttctcttctcggtttgcctctctgttaaatggggatgttaacacctcagcccatggggctcaggggctctgggtggcttcctcagctggtcatgatggttctcataaaccccctgcagtggtcatatgctttaatattagtgctcagtagcctgagagaaagtacagccagatttatggattcactggaagcagggactgggggtggggtgcagcctctctccaatgggttttgtttcttatttgaccacacgcattgttagagccaagttaattgcctgtatttgcttcctgtggaaatatttcacaagacaccctgttatcgtgggcccagcatttgtacttgtgttttgctgatccgtttagcttttttgaaaattttgggccaagaccaaatcttccataaaggtctgtgggctgtgaccatagtcctcagctgtttgctgtgttgttccaatttcatagatttagccttgtgaggggagaaaaatatataggccatgattatttttttttaaggactcagttctttatgctatggatttaattctctgttcccaaccatgtggccttaaaggacctgcattgtcacctgcttgctatgtggtctgaggcaagggccttgaccttttgtgccttagtttcctcatctgggtgatgggggtgatgtcttctttacagcccgctaaggatttcagagaaatcagatgagctaatagccctgaaaaatctttgaaaaagtaaaaagtgctatatatttgtaagtgtgaactcacaaaaattaatgactttagtactctctggggtttcgtaattctaagctggatccaaaagaaattctctcaaaatatctgcccttagatgggaaaaaatgccagaaaaggatgtaagaactgaattttcaggtcctggaatgcatcctaaggaatttgagcttctcatcctgaagacagtagcaaagcattgcaggcttttacctggaagatggtgaatcccatggtgatgggcatagtaggctggagccaagagagagttctgaaccctggggcatgtcatataaagctctgctggcagttgttggtggagagaattaaaccacaggaagtattgagaaccttcagcttccttgtagggcatttgtctctttccaaagccttcacaggctctagatgagatagaaatcaaatgccagcacagtggctgcctggcttccattttaaatctcagagtaccaaggatgttccaaggactatctccctggatccattcaatcatttgtccatctgcccatacacccatgtcatgaacatccattctcccattcaagttgggaaaccttgacccgtgcggcataatattctgtgcagagggaaataacatgagaaataggaggcccagatggctttttttttgccatcaggcagagcttatctaaaagcacatcattttcaaacaaaacaaaccagacctaagaaagcacttcattgagataggattggattggaaatctgtcctttaagtggactgatagtggaataggacaagccagtccagccccattggctttgatccttgcagtttcccacctcaccttcctactcgtcccagccccactgctttcctgacctgtggtacctgctaagatgccccaccctgccctgtacctggagtgtctgggccttccagacctctggatttgaaagttatttcatgggagcagaaatttggtcttctttaccttttataagttcctgcatcacaaaggtaatgctgaatgctgaatgtcagctaaatgctgataattcattccagaattataacattttcagctgtgcctatcaaagaagcgggggacaatttgtcccttagctttcaactttggagagacaaccttggggagtacacctagtagatagtcaagaaaagcaggttaaattaaattcctacaatgtgccgattcagcaaaacttggaatacccactaagtgtcagatgttctaggcgctgtgaatatacaaatgcgtagggaggttcctttccttaagcggccctgggtctgacttaccacagctctgcttggccttgatgaactcacaaaaggatcaaagagcatgctcaaggccagaatgaggtctgcgtgataaaagagctgagaaagataccgtcaagtccacatccgccatgagcagacaagaagcctctagcaaaacgtttatattattacctaagtgtagatgtttaaatgcaacttgattaaggaatgcaaggtttctaccatttgctttgtttaaaagccaaagcccagtagagtatgattttaggtttgcccagattattcagaagtagaagtcttcccagctgttcatctttgctccagtggtggaggtggcggcattgcgtgccagtatcacaagaccacaccaagtttcctggtattaatcctctattggaaggcatttcctggtagactctcatgccagacatattttaataaggaattctgtgacactgcttgctctgggggttgctcattttatcctgtaggtggttttatttttgggagatgaacagcagagggagggatgcattttgcagagaataaatcagtcatttgtgatccagttctgtttattaccacacagactagtagttcctgacagctactgagagaagacgtcaaagagttcaattccaaaatttcttggttgctacatctaagcatagattccttataccaaaccccatgacctccttgaggaggaaatgaaaatacttttcttcttttttttttttttgagaaggaatcttgctctgtcacccaggctggtgtgtggtggcacaatctcggctcactgcaagctctgcctcctgggttcacgccattctcttgcctcagcctcctgagtagctgggactacaggtacctgccaccacgcccagctaattttttgtttttttttagtagagtcggggtttcaccatattagccaggatggtctcgatctcctgacctcatgatctgcccgccttggcctcccagagtgctgggattacaggcatgagccactgcgcctggccaggaaaacacttttctaagttaacatccctggtatttgggtaggtgaaagacaatatgcaaagctgtctttgaagctacacttttctaagagtagggattgaacagcatgaaaatactgtgccctttggccagttaaattaaatctgtttttatagatgctttgcagagtaaaggcaaaggatcatttactctcacatcctcttatgacctggaatgatgccttatgtggaaacacagggctcccatgtcctacttaggaggctaaggaaatccaaagggggcacttcccattttagatccacatgatcccaggttgttcatccaaagatacatccagaaggagcaacagcttcctatctttcacttatgtggatgtccatattgttgcggtatcttttctgttgcctcttctatgtttgttaagcagatactgatttgtgatccacttcaagtcctcaccactgtgctgtcctgcaagaaccgtgctgaagaaaagctcattttccctaggcttcagctaaccatgcctaaggtctgaggacctttggtcaaacatattcaagtctcttgaaaggtgagactcaaggatacagacttatgacttcctaagggcccatcagccctcaacgctttaccaggttgggaccttgtttccaaagatgttcatagctcccttcaagtatagatggcaagttgtgcatggactgcctgttaagtgagaaaccagagcctgggccatccctggtgtcttggccattaccattgctaacagcagtgatagtgaatagtacccaaaagggaattgtaagcagtggccacaccttctactaggatgactcagatttaggactcaagaggaggctcctaactttcctgcaaccacacatggagggattttgtctcagccaaccagtactgactccccttgggacccaagtaaaggacaatgaaaagcagcacttcaatgtgagaagagcgtgagctttggggtcacagagctctgggttcaaatcctggttccatacttaccttgggtaagccacttgacctgttagagtttcagtatcctcatttgtaaaatgggggtgtttaaacctaagcactacttcagagcaaacatcaccaacaactgaaatagtacagctagactctgctcccaaatcctctttgcttctttctccagaatctctctcatcccacaaatcatcccttgcaaggacagtcacagcatgaaattattattgccacttgacatgtataatcatttttgtagtgcttccacttctacttccacatttaattgtgtgattgacaggactagaaaggtgagcttttggctcccagtccagttccttgtccatcaccccacacagcaacaccacattctgtccacacagcctcattttccttcaagagactacatgggacccaaaagctcccaaagtctggatgtgattctaggcagcttaggtatggagggcagagatgaggcacacacacctacaaaaagaaaaataggatacttgaaaatcacaagaagagctcttggccgctgtgcaatgctccagctgggtggttctccactccaggaggacgttctgaagctgggaaatgagatctgtgctgtcttaggagcccacagcacaggggaggacataagggtcttcttgaggagttcagctgcatgcttgtggcccagggccccagtcatttgtctgattagcttccccacctcttgagagagtcactgtgttttgtctaaaaagaaaggagatttccaaatgaggactctctgagcaaaatattgattttcagcaggtgtggttttgagacagtttgtactgcatgctctctccagctctcactgtgcctcggactctattgattctagttggttttgatcctgccttagcattccaggaaagcagagctctcctagcccaagaagagaaaatgaaggtggagtggctcatcggggtaacatccctccactacagccatcaaccactccagggatatgatgcctcccactgctgaggactctggctaagacactggtgtgatttagagccctagagcattggtttatcatcatatagagaaccaccctcatcttctttggaggaggtgcctctccactgcatcccaaggtgggagtgacctctggtagttctgcttgttcatagtcagcttagtcatctctgttgtagaaagagaaagagagagagggcaagaaagggaaagacggagggagagaggaaggaagtgggaaaggagggaagaagataaggcaagacaaaataagacaaagcaagaaagagagagagcacgcgggccagcacgctttttctccatccccttaggaatttactctcagcaggggcttggcttggctggttttgccagtgactcccttgcactttgcagattctgaatatacatttcccttaagactggttgtctgcagaataggggaaacaaaccagcacccccataaatcagcagaggtcactgccaagagctttgtacacttgctgtccctggcagtgataaactcattgcatttgggaaatggccaaagaccctgagtccaatcttaattctcattcccagaaaaatctcagttttctgttcacccacccccgtttactgtctttgtgtttcctagacaaagctggcaaggaggaaagaacacagttcaataactggatcatcaaaggctgcatttcgttgcttgggggaggagttgcagggcaggaaagagtcacagatccctaggctgtggaaaagagaggcccaggccagagggaggctgaagccatggggtctgcatggggtgtgagagatccgcagaggttctcagattctggttttctcagacccgcaccttggatctgctattactgctgtggtcggttgttcccttgaagggtggttcaggctgttataatggtggtcaagggctagcagtgggattggtgtggtgagaccacctcatgggactcatgctccagtaggttgtgttcttattctcttatctttctccccacaccatcctcaccttggtatctggctttggagttggccatatgacatggagaagatgagagtggtgtccaaactgctcctctgacccacatgggcctcctgagagtggacaacctctctctgctgccctttcctccttgccccttgattgtctttctcctctgattgatcagactgtgaagctgcaagaccagacccccccctccctgcaatcccacagaattaggagacatatttctgtctctctacacagatctttccactttgatgaggatctttctggttgagagaccaccattccccacttgtagcaggataggtcatccccaggtatacacattcataccctgtgcctgtacttcatctctgcagcccttagctgaattggctaaatgcgtctctgtgcaaagtctatcttgcctagttggatctaagctttatgacattagaggccgatttgtcttattcaggctgttatctcagcgtctgacacagtgccctggcacctagtaaatgctcaataactatttgctgaatattattttgattcagtgtttagacatctgctttatcctgctctattttgattgacaagttctttctcttcatgaaccaggcttttccctcctacaatgagtctataagaattagctagatcagaggggaatttggtgctgagccagaagagctgtctaggggaggtttcctcacttcttatggggcagcagaggggtattgtgagatattgagaagtcagaacaagaagcagggaactgttgctttggagaagggtctggagaggttccaggcactatgataggcttttccagatgactcaggagccacctggctctgtcagccagaaagaagtgatgcctgacacaaggagacagtgtgtcatttttactgtggactaacatttgtacctaagctttaaatgttaaaataatttggctgggtgtggtggctcatggctgtaatcccagcactttgggaggccgaggcgggtgaatcacttgaggccaggggtttgagaccagcctggccaacatggtgaaacaccgtctctactaaaaaatatataaaaattagccaggcgtggtggtgcatgcttgtaatcccagctacttgggaggctgaggcaggaggattgcttgaacccgtgaggtggaggttgcagtgagccaagatcacaccactgcactccagcctgggcaacagagcgaagactccatctcaaaaagaaaatgttagaacaatttaaagagacaacaaatgaaaccaaagaccaatgatacccctcagcctgggctctgagaccattagggatggctgagccaagattttcatgctcctctgagctgagtgtaatcctcattctccttctgtgcagagagcaggaacttgatgcagtcataaacccaagcaagtatggagccagtaaacttgctgaacattaaattccaaccggcatttcagtgaacatgtatattcgactaatatctgagcctgtgctagacagtatgcatctgtaaaaataaacacatactgttcctcaaggcacttaaacaagagtgagctggatttttgtctgaaattttcagaaaaacacttagtgaagtgtgttcacactaagtttgttaaatcagaatacgtctggactatccaagtagtctcagaaccaggccactattggaggctgggcgcggtggctcacgcctgtaatcccagcactttgggaggctgaaacaggtggatcacttgaggccaggagttcgagaccagcctggccaacatggggaaaccccgtatccactaaaaataaaaaaatcagctgggtgtggtggtgcatgcctgtagtcccagctactcatgaggctgaggcacgagaatcacttggaacccgggaggcagaagttgcagtgaactgaggtcacaccactgcactgcagcctgagtgacagcaagactttatctcaaaaaaaaaaaaaaaaaaaaaagaaccaagtcagtatttaatttcatttgagtccttccagtgggtttattcccattagtggggtaactcccctgcttttgtaaatatgagggtatctcaggaagaataagtcccaaaacaagattctttgggttccaaccaaagatgaaaccaagagggcctcacatgtgaccaagacattttctgctttctactttcactttctttttgtttattttttaaattgagatgtaaaagttgtatgtatttatggtatatagcatgcaattttgatatatgtatacattgtggaatggataaatcaagccatttaacatatgcgtggtctcatacacttattgtttgtagtgagaacacttaaaatctactctcagcaattttcaagtatataatatattgtttttaactgcagtctgtagtcaccgtaatgttcaagagacctcttcaacttattcttcctctctaattatgtggtgtcctttgaccaatgtcttcccagtccttctcactccccacagcccctggtagaatggccattctgctctctgcttctgtgagtgtgattgtcttagattccatatacaggcacatctcgttttattgcacttccctgtattatgccttatagattctgtgttttttacaaattgaaggtttgtggcaaccctgcatcaaacaagtctatcagcaccatttttccaatagcatgtgcttactttgtgtctgtgtcacagtttggtaattcttgcaacattaagcttttttagtatgattatatgtttatggtgatctgtgattggtgatctttgatgttactattgtaattgctctgggggtgcccaactgcacccgtataagacaatgaacttaatacatgttgtgtgtgtgtgttttctgactcctctaccaaatcagccattcccccatctctttccctctccttgggcctctctactccctgaaatgacaactatattgaaattgggccaattaataactctgcagtggtctctaagtgttcaggcaaaaggaacagtcgcatgtctctaactttaaatcaaaaactggaaatgattaagcttagtgaggaaggcatgttgaaagccaagataggctgaaagctaggcctcttatgccaaacagcctaggtgtgaatacaaagaaaagtttattgaagattgaacatgctactccagtgaacacacaaaagataagaaagcaaaacaaccttattgctgatatggagacagttttagtggtctgaatagaagatcaaatcagacacaacattcccttaagccaaagcctaatccagagcaaggacctaccttgcttcaattctatgaaggctgaaagaggtgaggaagctgcagaagaaaagtttgaagctaacagaggttggttcatgtggtttacaaaaagaaaccaagtccataacataaaagggcaaagtgaaacagcaagtgctgatatagaagctgcagcaagttatccagaagatctagctaagatcattgatgaaggtggctacagtaaacaacagatttgcagtgtagattaagcagccttatattggaagaagataaatctagggttttcatagctagagaagagaagtccatgcctggcttcaaagcttcaaaggacaggctgactctcttgctagggctaatgcagctggtgactataagtcgatgccaatgctcatttactattctgaaaatcctagggccttcaagaatgatgctaaatatattctgcctgtgttctataaatggaccaacaaagtctggatggcagcacatctgtttgcggcatggtttactgaatactttaaggccactgttgagacctactgttgaggaaaaaaataatatttctttccaaatattgctgttcattgacaatgcaccaagccatccaagagctctgatggagatgtacaaggagattaatgttgttttcatgactgctaacacaacatccgttctgtagcctatggatcaagaagtaatttcaacttttcaagtcctattatttaagaaatacatttcataaagctatagctgtcacagacagtgattcctctgatggatttgggcaaagtaaatcaaaacccttctagaaaggagtcacccttctggtggatgccattaagaacatttgtgtttcgtggaaagaagtaaaaatatcaacattaatgggagtttggaagaagttgattccagccctcatggatgactttgagaagttcaagatcctagtgaagaaagtaactgcagatgtggtggaaatagcaagagaactagaattagaaatagagcttgaagatgtgactgaattgctacaacttcataataaaactttaatgaatgaggagttgcttcctatggaagagtaaagaaagtggtttcttgagatggaatctactcctaatgaagatgttgcaaacattgttgagatgacacaaagaatttagaatattacatcaacttagttgataaagcagcagcaggatttgacgggattgactgcaattttgaaagaagttctactgtaggtaaaatgctatcaaacaccatcacatgctacagagaaatctgttgcgaaaggaagagtcaattgatgcgacaaacttcattgtcttattttaagaaattgccacagtcacctcggccttcggcaatcaccaccctaatcagtcagtatccaacaatgtcaagacaagaccctcccccagcaaaaggattatgactcaccaaaggctcagatgatccttagcattttaacaataaagtattttttaattaaggtatgtaccttgttttttcagacataatgttattgcacacatcattgactacatatagtgtaaacataacttttatgtgtactgggaaacgaaatatttcttatgacttgctttattgtggtggcctggaaccaaacccacaatacctccaaggtctccttacataagtgaagacaagtggtattttgtctttctgtacctgacttatttcacttaacctaatgttctccaggtttgttcatgttatcacaaatgacaggatttccttctttgttaagaccaaatagtattccattatgcctatatactgcatttcctttacccatttatctattcattgatggactcataggttgactccatatcttggctactgtgctctccctttcttttgtgctgggtaaggagtgagtcttggtgaatccttgtcattgctctgtctttttctggccaggcatctctaaaatgtgtcccccagctgatgggaggtctgtgcctcctccttcgatcccttccctggaaagagcaccaaggaagaggtccttaatgaccagtcctgcctctcagatgagcactctcctcctccctgaccagctctccatccccctcaccactagggcctttgtctggcttcatgagaagaacaatgagcatacatgggggaagatgcttcctccaccaggacagccattaactaacaagcccgccctccccagtgaaggccaacctccctcctaacacattctctcttggaacagccaagctttcctgtgcagctgagctgaattccacttcaatggataaataatcttgcccactgacaagtcctcttttctaagggaccaggattttccaacccttgatgaggacagatctgtttggaagggaccacaagattctaggaattagctggaaatcaggggtgaaattatttgccaaggccagaatgtataacaaatgcccctgggagccgaggaaaagaggcggcaccttgctgcagcacctgcccctcctgggtgttagttacatgtcctgtgatgtggttgccaagaactccttccaggacgaggtggtggccctgaaatgcacaaactgacccaattgcattattgcctgtttttttaaattaaactttttattttgagatacgtattgattctgatgcagttataagaaatactgtgctgtttacccagtttgccccaatggcaacatcttgcaaaactatagtaccatatcacagccatgatactgacatggctacaatcccctgattttattcatatttcccagttttacttgtgccccatgtatgtatgtgtgcatttagttctatacaactttatcacgtgttaagatgtgtcaaaatacagaaccattctgtcaccacaaagatccttcctgttgccttttataaccacacctcccttgctccctctacttcctcatctctaaccccaggaaccactaatctgttctttgtctctataatttgtcatttcaagaatgttatgtaaatgaaataatatagtttataatctggagcttggcttttttactcatcctaattcccttgagattcatccaagttgttgttgggtgtaagaacagtttgttcctcctcattgccatgtctggttttaatcattaagcaccccaacatggcacccaagcccaattacaaatccctcaggacatgatcctcagggaacttttattctaagagagcccatatgttttgtttggtgctgctgagtttgggggtgtggggatggaacatgttgcaagtttttctaggtacatgcaaacatacctaggttccttcatctccttccccaaaacagtgatcaattggattgtaatattctttagcactggttgacagcccttccttgtgtctccttgtcaccttcctccccaggagcacatctacaagctgatgaagagtgacagctatgcccgcttcctccggtcaaatgcttaccaggatttgctgctggccaagaagaaggtatctttgggaagggcaggcttgctcttagcactgttgactcttgcctgctgcttgctgctggtttgaaatgagaatatcatcccttgggttttatttatttcctactttcttctttcccttctctatctgctcccattctaatggaaaacagttaggattgtcaccaccccagccccactgcaaggtccaggatggggcatcctacctccacatccctactgcctctctctgcatgttctgcccatggtgggggtgggtacgtagggtgacaaaagactaaggccacagtggctcagcataggagtgcagggctggcagtaacaccagcaaaacccttaggacactggagagagcccctcactgcaaagtccagccccttcacctcagacttctctccctgaccagcccagagaggagtatgaggccagggttggggcagctctctcactggtcagaaagccttgtcagtttcaagagcacaatcaggtacctaaagtcatcctggggtttctccctccttgacacccccttcctctcccgcacctgccccacggtgttgcctttctctcttaaccaagaagtaactgcacccagctccttcctcctcctccttagaactcagccatggttccttgcagcccatggagtcatggatttgaggtgcaggggccctcagcatgcaggtgaggggtgacagaagcaggaataaattcagctagattcctgggaagagaggaggaagagtaggcaggagaatagggtccaggaagggaatggaaggcaagagagagggctcctggtttcagtacacctgcccaccctctgtgcttttcagctctgatctgaggcccatgtgtggttaagtgtggctcaacttgcaccaaaccctatgacttctgtgccatggcacttagggagcacaggcatccctttctcctccctcctggactcccagccccaggccctaagcacgtggttgcccatcacatgctctccgctgggctgcctctcagccacgcaagccttctctctgtgtgctgtcaccctcatgtgccaggatcctgtctgcgtatctggttgggaccacacaactccagagtcctggagagcatttataacctgctctcctgcccttgtgtagccctggaaagaggccatggagtctgagaaaggaaagaggacttctggggtatcccagttgtcagcagctctctgggtttcctgcatccctccccacaggtgtggctactgtgatgggcagtgtggagcctggcctcctgtcgattcccctgctggaggatgccaatggaggggctcctttggaggaggccgacaccctcatacatggctctaatgcccattttttctaagaactagaggaaagaaaaattataggaacttttgataactccagcccagatctcatggatgaaggtcaaagtaagtttttcttattttctgtggctcaagacccctgatctgatcacagtttggtgactttctaaggctctggtagtttaaccagtctaggcctgtctacacacctagaagaagagaagctagaggccattgattctccttgtgggtttgaacacaaaggaaaaatgcaccccaaaccaggctgagacccctgtggctgcagatcctcccttccaagaagaaaacctctcagaggaggtcacttgagtgaggaaggaactggcaacctgcctgggaaaagttccttagagttatcctcccagctcccgaagtaagggatgttcttgagacagaaagcccttgcagataccaacaacgtctcaatactgaggagttgtttcccaaaacagtgacaaaacctgctttctccttctgtttcttcctgagagtctccaggtatggatctgatttgtaactcggcactttcaggtaggcctagagtattcttctgatttcagggacgggttcaccgtatccaggtcataaaaggtatgtgagattcacaacctccggcggagagagggaatatgaatcagcctcacttttctgctgagaactgacctggacggagtcttgaggcacagccttctgatccttcatccctaattcagcctcttttctaatattttccaaataaatgatagtcacactgaagaatcaggttctcagggggtaggtgagctgagtcctgagggctactctaggaaacttcagtaccagtgatgatggttttccagggcagctcaatggccagtgcaaggcagaggagccaagtgagccagaccaatggccaccctctgtgagccagaggataagaataacaggccgacaatgccagctgcagggcccaggactggcctgacttgagccaagtgtatgccacccaggctggccacagggttcaagctgagtcctgccatccccagaatagagacttggtatggtacccggggccaagcatgagtccttcagttcctagtacaagaagaaaggccagcccaactctgtggtgttatgtcgtttgtgttgtattttccttctgcaacctcatatctgtcttctggcagccagctgagctgacaaggggcctggctgccaaggaagccccccaacttcatccacacaggcggctgcctttggcctgtcccctctgctttcagcacagtccgcagacccacagacctcaggctgcctctttagctccctcatttcagttatttgctgggtgtatgtttgtgtctatgtgagtgtgtgcactctccgaacttctcagcctcgggctcaggaccctggaacgggatccaggatacactagcaggtatttgagcggtcattctactctcccggaacccctgcagctaggaaatgtggggtgaaaggaaagtcaggagcaccccacacctctcttcctcctgtagtagagggaggctaggcctggaaagacattcaagggctttgcctctcctcgctcctgttctgggaaccccagctaagagttccccacaatggtttctgagcttcctctagcctgtcgtacgtacatcttggcaggtgttatgtcaccttttggatactgagaaaacacacaatccccatgttattgtcttctgagacccaagaccctttgtccatggcaaaggctatgagtagaccctccttgctctaaggacacagaacgagggtcactaggaagtcactgaagttagcaaactttctggctgcctctgggcaggggaatctcaagagagaaaacagtcctaaggcagactcatggatgagtagataacttcgcttccccggcagccccttcctgacgtccctcccacaccctgctggctctcagagccagtctgttctgtgtcaggacttggggggcccccagggccccagggccacaaccaccagggctcctgcctgtgggcacggcaggttgaaagcagcaagcaagctgctcaaacccaccgactgtggtcctgcagcaaagtcatgatggttctgatccaagccccgcaagcaccattcatggcccccggagaagcaaagcccccctctctgctccctgctccaaggaggcggcaccatttctcgtgggcttctgtcttctgtctctcccattgactcttccaacagctctggctgcttctcttttcccatttttcgccccattttgctttggtttttgttattctttagctgcagctgctgctgtttgggaaccacgtataagctgaagattttttttttctgtatttttctccctacccttttttttttttcctaaagccagaaagtgagcaaggtcgtagaacttccctagaaaagttcactcgcagtgtggtaagttcagtcggttttcttccctcagcttttcttttggttttggttttttctttcttcttcttttttttttttttccctttggttgttgtttcctttggggtgggagggagtccagtgctttctccctcgactcagcccttttcttttgcgagtgtctgcagcttctcttctagggatgaaaatgcaaaaaagagcaagcggctccctctgcagaaggtgcacccttgatcgcccagcctcaggcctgggcatttgatcatctgttcagggctttgaggaggagggaccctgctgccctcggggctgtgcggtttgtgcatcttctgcagcagctcagggagaagccatcgaactataccgtgaaataaattggctcagaaccatagctcatcgaaaaaaaaaaaaaaagccaaaatttccctctgtgaaccctggcagtcacgccggtgtgggtcgcgagctaatgttgctgtgtaggcggcttttgctgtgtgcagaaagcggccgtgctgcatgggtcctggcgatgtggcctagctggcgtgtgtgttagtcgcctctgcatgagtcccttccagcccccatcagcctcatgtgcacagtgtgatagggagaggagggaagtagctgaatccctgcggtgtcctgggtactccccgggggcaaggtcctaccggcctcctcaggccttgattctaacaggctgggtaaagatgggcttcagattcctacaggttcatggtacgccccagctagagaggtagagctccccacagtggcacataaagacagccgtggcaacaggtgggagtggggagtccgtggctgttccctggggtgcatggctgagactctctaccatggtttgtagaacaacacaggccaatctcctctttccatgctggtcggcccaagatttgaacattgagctcagtgcacaagaaatactcaatcccgctcaatcacggggcccatcctgtaccatgaacatcaaaccagagggaaccagggagcagggtcccatgcagggagctggccacattcccttcccaaagggtggcagcccattgatattgacttgcctttgttccacctctgttgaggaggaaaatccttgtaaaacctgactactgtgtgactggtatacgtatttcatccttttaagaaaaagtctaaggctcctgggttgaaagcagcctagtcatttacgtgtcgtagctagatgcattttaagtgcatttaaacattatcttgaatttgctacatgtaaacctcaaataactctagtgggtggcaattaattaaacatcggtatccatcccttcccttcctcggtcttccctctctgtggcctttcctcatgagaaatcagaatgtgcagaacacaaggcctgcgggtgcctggtctatcttcatggctgctttgccaatggccgtgtggctccgcacaccaagaagctgccacgggctgtcagagtcaaggcttctgggacttccttcactccatgatggcctgagagaaggtagtgggatcccatctctctctgtttgtctcttttgaggactggctactgtgcgggtggaggatggttagggattttgctgacaagccaagggtgcctgtgtaagcagagccttgacagcccccggaagctcttgagggtgaccgtgcaggccacgggtgtgagaggggaagcctggtacttggacaaaacgtccagacattttcaggctgtttttcaagagaagtgagtatcaagaaaggcaagaatggtctcgcgaagctctgtgaggagcatttattgatttcctttcatcccagaagtggtgttggcttgggggttctcccaaggtctgttagcaaagcatttggaacaagaaagcaccaagacacccctaagtgtctgaagtgcacacatgggagagcttccagagggagtttcagagtgagctgaaggagaaaagtatcctaagctcctgagggtgtggataaaaggcccaaactattaaaaaaaactaaattcctaaattccctgctattttatgaacaagaaactctaacaggtgatgcattcagaatttggggttccagtggtggagatggattgccatccatccatgctcctcctgctcttggggtgacaccatagccccacaagatgtggctaagtttggggaataatatgacccatgtgttggctctcagattacttaagattggaacccaggaatctggtctcaacagcccagtggtctcatcaaacagaactaactaactgatcaaccaatatgccttgcaatttgatagccattctctgactatcatatgcctaaagtatttgatttctctaagagaagatctacgtgaatgttttatctgctatatactgcaagctataaaactaaatgaagggccagttcaatagcattcctgtgttgctgggaaagatgtgtaagaacatgacccatgtcatggggctaataatggaaacaggggagtgaagctgggcagctcacggaccaaagacgtgaggccaattaccatttaggattaattgatggcaaaaagaaataatgttgatccaggtgattggataactcattcagctggaggcttgtcaagactgaatctgaattcagaatttctccccagaacatgccaatgtcctttcttttcttggtagaagagaaacacttggaaaaaacaaattgttctttccaagtcttatgttgtgccatgacatagagggattatctgttaagaccacatatgcccccttttccatgagatcctaaggagacatttaatatggttcatggaagcttttagggccatgttagtttgggtgacgaaggggcctggtactccccagtcaatagaggaagtgctgtatgagcttctctttccaatgcaagcttcattccaggttactcaggacttggatatacaaagcaaatgtctggggacactgggccaagcatcctgtcattttgcagactgaaaccacaaaccctgcttatttgataaggcccaggttctgaactaaacatgactgaagtccacgacagggcgcaactagcctaccatgtacgttcatccaaaatggaaaacaagactccctctggtgggcccagcctcacagatgcccagctgaccaggcaaaacacaggctgggtttcagcccctattgatcctcagctgccctggtgcagtgaataacccacgccactgtacatggccacccttgtccgaggagcctgtttcagaaagagctgtaacacacagcagcttctccagggcccccaatacatggcctcaggtcatgtgatttggagcctgtctctgcctaatcctgctcatggggaagcttcctttcacagtggctgtaacatatgaaaaccacagtaggagaaatctggctagtcactgtgggttgcctttgcttcaccttccagctgttcttcagattctttggtgggaagtctcaggcattactgaccagggagaggaggtgccttctctcactgaagactctttcctgttgcttggtgatgtctagcctgccactctctgctatcttcctggttttgcagttgacagaggacaataggagcatgaaggtggccagagctgaaatgctcaccctcccactgcttcttgagacagagtctcactctccgagcctggagtgcagtggcacaatcttggctcactgcaacctctgcctcctaggttcaagcgattctcctgcctcagcctcccgagtagctgggattacaggcacacgccaccacacccggctaatttttgtacttttagtagagatggggtttcaccatattggccaggctgttctcaaactcctgacctcaagtgatccacctgcctcccaaagtgctgggattacaggcatgagccaccacaccccgccctctgctctctcttaagtgtgcttgttgcttcagcttccacagagtctaccacagtggggtggggggcctcaccaaagagggcctggctctgacatagaggaccaggagcatgcgtgggagggagagggggcaagaggaatcggggccaagccacagcagcagctcccttgttgagatagatactggctgaagccatctggtgagagctccaatctggggaggagaagctggagaaagtcctttgctcctctgtccagttccacagaaaaagccgcagagggtgatagcactgaagttaggagaaaatggcagccccgagtgaggctggtgtcagcctccctgggtacctttggaggctcagttgaaaccttacctgccctcttgagagcttcatcagctccagccttgggctccaaagatagatagatagaaaatggggttgctggtgccagagcaagcactggaggccacggaggagaagggagaggaggaccaggcgttcatccacctcctaagagagcatcgaagtttagctttgccaaggtgctccttggaattgcggcaggaagggccggaagctgcagaaggcttggcatgtgatgggtggcatctctgcgacaggctttcctgtcctgcctgcctgccaaggaatgcagcaggcaagtcagatggggagcgggaagctctgggagccagctgccactcagcctccctcgccccctccttccatccccctgttccttcccctgccaaaagccaaggaagagctaatgagagccaagaagtcaacagctcactcatccccctccaggcagctctgcagagagaaactcccagctccaggcccaggtgctgaccggaagtggagggctaaggctctccgcaggggagggggcaggcaggcaatcagggcagtcagccaaccggcagaagcagctcctgcccccaggaaggcggtgttgttttcccctcctcctcaaggtttcatggggaacagccttgcaccctggtggaatgagttcccaaatacctagactcagcagaatccccagagggctttgacctcagttgaaatgatctttctgtgcctctggcaagggccaattggctaaaaatctttccaaagggttagtttttattgcaaacagtccttggactcctttgggaccactgggtcacaaacattagtgccagcctctcccatctcagagcactgagatccagctgcagtgaaaccctggccctggctggagctggagggagacttccatcgaagtgtttgggaaggaaagcagggaaacctgcctctctggagcagcaagtgcatgtcctgggactctgagacacctcagcagccctcctgcagactggctcctgcttccagcctcagcttgctagctatgtgacctcaagcaaatcactagccctctctgagccctggttttctcctctgaaatgacttggactaggtcgtctcgatggtcccttccagctagcggtgttctgcaggtctgtgcttccctctgtcctgagatttctgagttatataactcattccttagaatgggagaggagctgtcttcttgcccagttagttacctgattcagaagtgcctgccagcctgtgaggctgggaaataaactgtggatagacttgagttgggtgtatttacaaagcctggacatgcactggcaggagaactgagtgccccaggctccccacacctacaccacaggccctgctcagttgttcagggttcactcgtccacggtgagtcgccggagggtcagggaggactcacagagaacagggtgagtgccctacacccttcagcttgccagttctgcagtccccacccttccggtctggatgcccagctgtgtgtgtgtgtgtcaggtggggtcagctgggcagaaaggtggaccccagggtcggtgttgccgcatcactgcatgcactgtggggtcccaggggccctatgggtataggaaggaatgaaatgtgagcacttgggaatctcagcacactctgctgctcacctgctaccaggctttctggttccccagggaaccctgggccagcttgttgctgtcctcttttagcgatgggaaataagagtatgagagacagtgttatcctgtttacaatcagtggtgaagtccgtggttaagaccaggttacaactcctctatgcttcgcttcttatcttgactctgtgtgaaattaggaaaagcatatttactgttatagttttgtagctggaaaatgaaaatataaaagtctattttttataaactacaaaatgtaaaacaacagactcagtatggctggtgggtacagagaagacaaagtggctcctcacggggttgacaggagtctcgagacttttatcaaaaaaggccagaagttggttgtcatttttgagacactgggccctagaccctgacgtttccgttggaaggaggagcccccagctgttcccgctgatggttcaacctgtccgccaaaagcagccaaaatgctctccccacggagtgcccacttggagaaaaaccccactggtgactcaccttctggacatgtggggcaatcagggcccggtggaggcagctgctcctggctttccctggtgggccctccctcgacccccgcccaggccctctcctgccttccccagaccccaatgtgccaagcagtcaagtgaaaatcaaatcctctgaggcagaaagacacagctgtgtgtttacagccactgattcagatccaaatcgcgtaccctgccagtctctagcaaggcaggctgggggcaaagtgtgtgtatgccaagcagggatctatttcgggaggtgacctgcaggccttcgccatgacagtgccttcctcccacccactctcaggaaaggtgctctcactttacaagcggctgatggggttgtggggtctcggcatgcttgtcacttgtgcagtcagaccccagtgccatcctcgtgcagccacatgggaactgtgtgggctcccacctgcctagtaagaaggcagagagtgaaggggagtgcagggccccccgcaggataaacagcgggaaggccgaccactcagaagacaggatgcccgcctctgcctaggacagagcctgcctcagtcctgtccggggagcagcagcaccgcagcagagggggccagagaaagagcatccaatggcaggagtctggcaaggcgacagcactgccaatgtcacggtcaaggagaggagacccaactctgcctgtggtccagactggaaagttcaaagagaagtcagagagcttcaagtctgaggacttcaaaggctaagaagtaagacccccccccgacccatggaagtccccccaaaatgagctcctggtggaaacaacaggggatgcttcccccttttaaaatagtgatgagtgtccctggtttgagttgagttaggaaagcatgacattttggaaggaggccaggatacctgtccataggtaggaatagcctgtaagatgttgccctcctgcagtgtggctaaatgggacactgccgggggtgggactcagagcagtgggatttttagttttgtcatgtttgcccaaaggtggatgagagaaagacccttgggtgtttgcttagtggcttcccaatgggtgggaaggtgagacggggttggaagcatggagccaccccagcagtggcagggccacagggcagcggttcttccatgccccctaatcatggccacattgtatcagcctgagcatgagcaacagcaccatggccacatacgggaatgggcctcattggtgtaatatttggcagattctctccacaccccccgtggcggtctggcttactgttaagaagggtaaccttaaaaaatacatttcccactccagaaaatactcatatgtggcctgttagcagcacaagaagggtgaaagcaatgcccattcctgcctccctccccctgctcacctccacgtccctgtttgcccctttgtaggtgaagtgagtatattcagcgtcttcatggcaggggagagggtgtattaatccgtctatgtccgctggaaaggcagtctctgagcgggccacaagggttcagccatggcccatccaataacctttttgatgacttggatgaagagacaaacattccaaccacattcaaagatccagacctccaaagtgtggctcatttggtagataatggaattatatttggaaagcatttcccgcagctgggatgatgggtcaaaaacagatagcattttaccagatcatatttgtgtgtgtgtgtgtgcgcgcgtgtgtgtgtgtgtgtgtgtgtgttttaaattcagtttcccaactacaggatggcatttgtagcctttcctaaaaatcaagtttaaaaaaaaaaaatttcttgggttgtaattgacgataagcttagtgtaagcaaatgcagaatgcagctgctttccaaagggcagctttaggctatataacaaaagtgggaaaggaaaagtgttccattgctttttgttgctctaagcaatattaagtcttggttctaagcccccacattatcaggaactttaacatctagagacaattgagagagaagagctagagagagaaagtgaccctggaagccacgtcggaagaggctggagtaaaaatgtctagccccccagcagacttgatggccaccgtgagctctttgcatttgtcttcaagagtggacacttccgggttgctccagagagcaaggctagaacaaatggctagaagatagataggtagatactaaaaatattctaacaataacagaatattccaacaatagactatgtcccctcaaagggcaacgagctccatgtctagccgtttagaagctgaatggccaaggatagtgcagagtaggtttctacaccagatcccatgatcttttgcaactggaattctatgctgccccaaatacttgttaaatggatccgactgcatttcattctgtggtttataaataagtcctggaaaaggagaatgaattataaggaaggagtttgctgagattggaggagagggatctgaaagactcaggactagactccgccttgagggagaaaaagccacaagatgacacactcaaagcaagggaaaccgtcaggaagtggaattactgcccttcacatgtcatccttgccttcttttctgttttttgtttttttttttggcatttgctgccgcagcagctgagctctgggcaacagggctctctctcccgaatgtctgaaaggaggtcagcaagtggaggacacaggcgcccactggcacagggcattggcaaccatcgtgcagtgagccccagcacagccagggtggccatgtgcgtggggcgtcctggcccaaggttgaagaaaactcatcctgtcatagttcccatccggaaagggtgttttgttgaaagcaaaaaggatcataaagtcatttgccttttacccaatgccagttccagattccaggtaaatgagctaacatcaaaaacacctcagccggctgggcgtggtggctcacatctgtaatccgagcactttgggaggccgagacaggcagatcacctgaggtcaggcgttcaagaccagcctggtcaacgtggtgaaaccccgtctctactaaaaatacaaaaatgagccaggtgtggtggcacatgcctataatcccagctactcgggaggctgaggcaggaggatcactagaacaagggaggcggaggttgcagtgagccaagcttgcaccacctcactccagcctgggcgacagagcaaaactccatccccatcccacaaaaaaccccccagagacctcggactgaggagaaactatgcccccaccctggcttccctcctctagggccctgccagggggacttgtcctcagcccagctcagggaaagggaagggttcccatgtcacattctttccagctgtcctaagaaccaccccgattgccgatgacactccctcctctcttgggcttcaccagggctgctttcaactcatcgtgggattgtgtaattatggtgattacagcttgtgacttttttcctctccatcttttgctttcaaattctttgaggcctctcattaaacatggcgatcccggtaaagtcagcaaagttttaataagacactttttacagctaaagaaagcccagtcagggttgattgctactatgttctctcagatactccattaaaactctatcaggtgcagttggtgcctaggtataagaggtgggggagagggaaggcagggaggcagagggcacctgtacttagtgacagggctggagaaccattccacaccatgcccctggctttttttgtttgcactaagcaccaagtacatctgagcccccgtgcctaacaggaaaagacagactgtcaagcaaggaccgaaagcctggccttaacatcatagcacattacactgggaaatggagatggagcatccaagacaacacttaacccaaccttgtaatcttctgcagcaaaagtggtgggggaattctgatacgtgctctgtcctggttaatactagaaggttctgaggcatccataattctaaataattaaaggagtcaatcaatcactagcctttgtgagtcatcacaatccggtggttttacacctgatggaggttttacacctgatggaggtttccttggtagtgattcagcttcacatctcattcttggctaatctttaatcatagcttgcttgcttgctttttgttgttgttttggtttggtttttgggggggtgttttttttgagacagagcctcgctttgttgcctaggctggagtgcagtggcgcaatctcagctcactgcaacctccacctcccaggtttaagcgattctcctgcctcagcctcctgagtagttgggattacaggcctgcaccaccacactcaactaatttttgtactcttagtagagacggagtttcaccatgtcagccaggctggtctcgaactcctggcctcaagtgatctgcacacctcggcctcccaaagtgctggagttacaagtgtgagccaccgtgcccagctcatagctttcttgaatagttatcatagctgtaggacatcatgagaaggaccatcaaggagtgtggcttgtgtgtgtgagccccgtgacccacccttcagcaggttcatccaggttcccctcatttctatattccctggggactacacagatgcccgcacagtgaagtgcatcttgctccagcaggactgtgtttctgagaggtccctgattggctgctcgtggctgaccgtcccataccaaccagactgccttttaccctgcaggtagccagttacctcactacctgtgtctcaaaagagcaaggagctggattgtgactgagcagcaccaaccacctggagttaaatgtcaaaaacgtggcagggacatttcccccaactgcattcccatccactactgaaggtggcctgctcgtgtgaccccttgagaacaacggtccctttagtacccaccagaatgcagagaagtaagctaagttcgagacaggcaaccccagctgaatccctttttctccacctgatattatgtgaccctgggcaagtcacttgcatgtctgacaggtacaacaaagcccactgcacagggtagatgttggcattcaatgaggatgtgatcacaagagctgccatttattgggagctcacactcacagtgttggactgtgtcatgctggctttgcctgggatggactttggttctacttcagctccatcacttagttgtttgaattgcacagcttctctaagcctcagtttcctcatccataaaagggagataagagtaaataagtaggaataaaatgcataacgtccttagcacactgtgtgcagtgcgtgtgcttaacaggtgtagctcttagaatcagtttcatcattatgatattatttgcagctcatacttaggctgcgcttattaccttatttaatttccaacaatattctgcaagataggcatcattatatacatcttgtggttgagggtgggtacgtgggtatctcctatatgacagtctgcacaaggtgcatgtattacagagatcagctcatggtaactactcaataaatggcagctatgattgttggcttatttttaaagtcaactcagagagttagtttttctgcatttcctggaaatgaagggactgtggtgcccagcaggccagcttctgttctatggtcgatttcctggggcccctaagcacttcccgggaagctgtgggaactggggggcttgtcagcctgtaaggtgctgggaggtggggagggccaccaggcaaatggtgcacgtgttgtggggatctggcatttggccgcctactgagttgaaggactcgaaggtgcctcctgctaccagagacagataaggaatgggtctacccaagataagaagatgaaatccactcctccaaatgtagccctccatgtgacagaaacactcacctctcagctgtctgcttgcctggagccaccctgagcaatgcaacctcaacaagtccagttgctccgtcagtccaataaacagaggtttctcttttttaaccacttattccaaagcgaggtagtggaggagtcagaagcacgtggcaggggatgctttgaaattccttgataaaccggacccctggggtgggcactcctactgcctatagtaccgacagaaacagaagtggagaagttgtttatttccaatgaggtcaataaatgcctttttcatgggggagaattccatttttatatatgtattttaaggtgaatgctttaagtttgcagtatttgtcagagtggcatcttaggagctgatagaaaactctacagccaaacaagcgattgcctgtgcaccttgcatgagatgcttctgtaagtgcctgtggtctcaacatgcacatgaacgcatgcactggtgtatgcacatgtgcacaggtgtatacacaggtgcatgtgccgcctgcctgatgttcgcctctgtgttcagtgtatggtgtgcatataaccataagctgcaaacctgcaagtatctctgttgcatggattgcatgccctctgcagctgtgtgtgtgtctgggcaggggctcctctaaagccacaggtcttcacagtttcagctggataagttattcttcacttcccttcctaaaaacacaattgcctagtgctgctggcgcagagtcagaatggccgctgcatttcacccccgaggtggcttccttccagcagtgggtgagtgatcccggcgttcgcacactctctaatctgtggaatccttctgcacagaaggtgttccaaaatccaaaagagatgatctgtttgtccatggcatcgtctctgcccaccactcctgttctcatgccctggttccagggacagtcggcagcacccatttcttggtgtctctgttttttctgcccattttttgtacccatagtttttctctcctaagaaacaaggagctgaggggtccagaaatgatgctgagatgagtcccttgtcccagaggcaatgtgcagataacatccttagatattgacccagtaactctcttctcctagtcccattccctagcagaacagggaatacccactacctttgaagatgcttctaaatccaataacagcatccttaggcttcatttcctggtgaaagcttccataactcttcctctgtgggccctgggccaaatcctgcaggaaacgtagcaatctcacatttctacacactacaccatcaggggagaaaaaagctgggaaaccgcccatcctctgtcccatggggaccaaaagcatctcagcagcacgtgaaaagagcctgtagggaaataaggttctctgtagctaagagttccaatgacctaagtttctgtccaggtatctcctgaaaacgctgcttagtctgttccctggtgtacttcctccggttaggaatccatgtctgataagtgcctgctaaattgcattcctgatagtggggaagaaagaaatgagccggccctctttgcatatgcatccaaatgggcatggacattcactgaattgttatgcttttgtggggggatgagaggtcagcaattctaggctccgccttttcagctggctaaaccaaggaccccaagaaatgtacgtgttttgggtgaacacatttgcaagagataagtgtcctcaggaggatggggtcagagtcctcataggtcctcaggagaatcacatactgccaaccaaataactttctcttgccgctttgtccacaatatcaagtaactaaattccagcttcactgtctcccgtagtcatagtcaagggttacttgaatttcctagttggaaaaaagtagcatcaacttgttgccaatagcaacacagccatgtccctgtttcctagagccttttggtctttgcctaatttggagtgaaccagagcttagatgccagagtccatttgggaaggaggaggagaagaggaacaggcgggcattaagtgggtcacaggaaggcatgccaccgagaggccttacaggcagaatgccaccctcattccactcctgaagccaccaagaatttcctgcaagctgagagaagaaagagcaacagggttgttccgtcagatgagaggagggagagaagagagagctggtgtgaaaagggggcatttccaccacacagggatgcagagtagcagggaaaatggagatgcacaacttggacgcgagaccggggagtctggacctggcattctgccactcatgtagggctcagctgctgagtccttgtctctcccaccatccctacccagctccggatttgtccctgcacagctggggggccatggagaaaggtcccccatcactcagcaaaactgacaggcagaagaaagtgatgagcatggtgaggccagggtcagagatgccaggaacaccagcagggagggcttcctccacctggctgggcaccccgaattaggcacttggcctagaatgatttaaagtggggttggttttcattagagtaaggccaccctgcctgccccaccttagaaagggaaacatcacacctgctcctgtcctccctggggcatttgccatgtgtgttcctagaggcatcagcatcagtaacacagggccacaaacagaacggtgggttcacccagcctgtccagcagctaccacctgaaatctacatgcaccaagccatggtgacctgcaccccagctcaatgcagtaaccaaaagccccttttgccaggcttgtcagccagcagatggcacctcctttctctcaggatttccaaatgggatgaggggaagccgcttcgcagcatagaacctgcctgagataagctcaagcatgctcaagaacttaagttcttttctcagggaagttgagaaaatcaccctgcattgcccagagaggttgcccagtacgggttgggcacaggggactccttcatccctgagtgtttccatctgcctccttccttgagagtgacagccatgtgcaaagtaagaggggcatgggtcgtgaaggccgaccaactcagctttgccactgactagccatgcactcccaggcaagttactcaaactccgtttgagtctgtttccttgttcgtttagtggagtttatagaaatgcctaactggcaagcatgttgtggacataagtaagtgcgggtgcttgtaaaatgcctcgcatgcttgacagacacacaatagttgctcaatggtccatcagcaggtggctgtttgttagtaactgtcctcacagctacctgtgtacctagtgggggaccattcccaccatgccactgtcaaggcctgagtgatttgaagaacaaggcacttgaggagagagggtccatgagctacccgtgccattccatcaaacaggcccatgggagatcaggggataggtgggtccttttacatttaatccagataggagaactggcaactcttcttttgtagattcaaaaactttttaaaatattttaaagcactggtagttgccaattatattagtccattttcacaatgctataaagaaatacctgagactgggtaatttctaatgaaaagaggtttaattgactcacagttccacatggctggggaagcctcaggaaacttacaatcatggtggaaagggaagcagtcttacttggcagcaggcaagagagagcgagtgtgtattaacacttaaaaaaccatcggatctcatgagaactcactccctatcacgagaatagcatgggggaaaccacccccatgatccaatcacctcccactagttcccgctctcaacacatggggattatagggattacaattcgaagtgagatttgggttcagacccagagccaaaccatatcaccaatacaggatagagtaaggtgtctgagcctactagtggtcccagtgacattctgtgggaattgctttcagaagacgtgactgctgggtacctcctccatccccagtgtttaccaggcagagcctgagtgtttacaccacacacagcctgagtctttataccactgtacatgagaaggtaggggtcgggggggcggggtggggggtgctgttgcaagaaaaaaaaatccattacgtttattttgatcaaatttattattttttaaacaggttcagttttaagtattcatgaatgtaccatttattaattctttaatcagtgaacgtctcttttttgattaattcacttttcatctatcccttgacttttttaaaaaaattggggtattgttttatgtttgtgatatagcttcctatttaaaaggggtcaaataaaaaaatattttaaaaccacataaaatgcccttaagcccctgcgagagttgaggaaggttgccaaggccctacaagtaacacagaccccaggaatgggtcagccacaggctcccgcccctcctcactgcggaagggtgagaaagacaggaatggcctctcttccttcccatgctgctctgacctacctctgttgtggaggaaccataacgggttccatagcccggtttttccatttcctatgccccaccttgtttcacagagttgagttaatagagggtgataagaaatagagaatttaaaaagtgttttgaaattattctaggttaagtgtggattttcccaccatcccctgccagcgtttctccgacatctcagactgcactctctctccccagttttagacatcattgaggaagaagatgccacggaattctttgcattcccttttaaaatcatttcttttgctttgctcagtggagaaggagcaccaggggcagcaaccttccgggagtcacccgatgaagtcaggcaggcctttggcttctcccatcctgctgaacccaagccaggatcccctacctttccacctggctcttgggctcctgacccttatcctcagcaagtctcccccaaccccaccccaggcctctaattccacacgtatacatcctttatgaacttgagcaccatctattcaaaggtgaccttcaggctccttgagagcacgactcatctctctctggggcctccacttcttgcctgctaagttgcatggtgagctgtattcaacgaaacacgatttttcatgagcagggatggaaaatgcctgtgtgtcacaccaaagggatccgtttgcatcaatggaggctagaaatagtgttccacattagttctgttgcgagttcgaattccccaacagaggaatccaggttcctcctgtactggagggggaagcattgaatttctccaaacccagggatgggcccagcaactgaagaagggtaaggagtgggaaattccaaggcatagatgtcatagctgggacttttttttgtcctaattttttttttcttttgagatataattatgcacggtaaaatgaacagacctgaagtacatggctcaatgaatttgacaagtgtatgcacccgtgtaacgtataccccatcaccctagaaggctccttcatgtccctttccaatcaatttcatccttctcccccaggggcaaccgtggttgatttctttcccccataatagcctggattttgatttggcagacttgagatctgtaacttcggtcttagttcatctgagcagatcagcaaaagaatctcatcagaagctcagatgtctttactctcttagcattgaaaaagatcctccctgagccgctagtgcttggctctgctgtcccccagtatgccccaatctgacccccagggctactctctgagccacagccctcctcccagccaaagaaagagtttagcatcagtctcccaggtaagtaagtggcaaaagctcttggtaacccagatagtgcatgctttgttgattaatatgtggaagtgcaatgcacagagccacagcatgtcaagcagcatgttgatttttctcactgcacaaaagggggctattccttttgtgtgtttcctttcagaaaacaaaggattccatgaccaccttcttccaggctcctagccatcaagatggccacagagctgaaatgattaatcagagcggagggtgggaattgaatgtgtgggtgttagtgaacccagcactgagcccatggtccatgaaattgaaggatcccaaattctactggattacactttgccaaatgtctcaaaggtgaaaagcactttgtcggtatgcaaagctttggtgtctctggaatgtaccttctgcagctcagttcttaatcactgtatattttttcacttggacaaaggctgcctgctaatagcattttcaaccatcctcagctgcttcgctcagctacgccaaggcctcgggctgagctggctgcggtttcctggcaccatgatccattcccaactgaccaacactgaggaacattacacactcacaccctgaaaaaaacctgcttcctctgtaactatgcaaatgccagacacaggcaggcagaattaccattccccttctgaagtggttccttcaggatcatccaaactggagacagagatgagagtaaagagacggggcagtgccctggagggtacaggcaggagctcccctctctctgggcacagcggattcctcgggagcttcctgcaagcctataggggcatgcactttggggcagctcatctctgaacacaggtagcctctactatcagatttcactttgatcactgaaaactacaggagtctcagctcttcagaagggaagcagctgctgagcaagtgtgattgcagtatttcttccccaaagccccgggccaggcatctacccatgcccgcatcctgcatgattaaccgccttccagtctgagcctgccctcactcacgcgggaggtcactgggtagcgagtagattgcagctgggctgagctgcctctcaagccgacctgaaccctcatgacctccatctttagcagcaagctggcatttggtaaatgcgcgaaagcaggagtggggagagggagacaaaaatgccaagcagcaccgcctgggttgctgagaggttgggaacaatcccaagggtggcccctaagctggtcagctgcaccatcctaccctgaaatcctgggaaataaaagcagtcgggggaagcgaggagcgggcagtgacaggctggccacaggtccttggagtcagagcggtgaggctgagctccaggatttagtcaggaagagaataattagcaccttcaagcccagcccagcccagcccattctgtagaaaggggaagggttgagggtatggaagcctcagggccaaattcacctaaaacaaatagacacataatcctccagaaatagaatctccaacctccctcaacccacagtcccctctccagccaaaataaccttgttaataggaatgaggctgcagtgaaggtttgggcaactggtaaacctcacctcctttgtctctgggctttgaatgtactcattggcaacagactcttattcagaagcttgagtgattttttttttcccatccaccagctaaatgagagccccaaacgctgtggatagcaaactcagaacatatatatttgggtacataatgtgtgatttgtggccctggcgaaggagggatgggaggaggaggaggacctgatattggtgtgtggtggttatcacagcaataagtggcacctaaaaggagagcaaacttcctttgtgcctttcataggacagggatggacataggtaaccgggggtaggggaggtttgtaagagctctcacacaaggaggcccctaggctcagcagccccgtgtttccccagcaaggatgccccacacccccatgtttcctgccttcaggcctgccccaggaaggcacattcccgagtgacaaatgcctcacactctatgtaagaaagggcactcaaggagagtcaccgctgggtgtgtgccacagaacccggggctggggggagcccttgaaggtcagcctctgccttctaagagctattgttgtacctaacctggtctagacaaaggagtagtcattcttagtgattttcaaagactgacaccataaccctcttggattttttaaaaatctgattaaaaactccttagccaagtataaatgtatcctgctgcaggctaagtttagtgcacttgaagattcagataaggttgctgatggggtgattttgtggacgtgtgtgtgtgtgtgtgtgtgtgtgtgtgtgtgtgtgtgtgtttaagatggggagaaaaaatgaaaagttttgtctcactagtgaaaatggggagtgaaagcaatggggaggaaaaaggtcaaggagaggtagggaaaggcagactttctgacagctcctgagggcaatttcatttttggacaaactcccatctatagcaccagaattctcaaagtcaggctggccatgcctctccatggagatctaagccagatgccacattgtcctgtatccagcaaatccacagcccgtgttgtttattagataaacccgttatccatcaattcatcaatcagcaggtttattgaggaccctaccaggcttcacaaacctgatcaattttttaaattacatctagcttacacgcagccaagcccagtaaacaagacgagccctcacaccccacttggaaatgaacatgaggaatcgctggcccttgcaatctcacggccaaacactgcagccccatgctgacgagctatcacgtgctgcccttcacagatggcggtggtgtcgctgacccactgtcaataatatgggtttggagtgctttcccagacacagtgatcaatctgcctgggtctagccatactgtcctctaaagccctgtgcaatgatgcggatttctaaagagggtgagctggagaacgggcacacactatgtaagggcaataagcaaagcgacggagcctcgctcgtgcccctcaccctcctcctggtgcccagtcgcaactcccctcctagatcaggggcttctccgccatctctccagggcacatacacaacgggactctcctggcacctctatggctgatgcaccaggcctcatgatccagttcactgttttagtttttgagaagaactgccacatgggttatagttgaagggcttgtaggctttcctggtatggggtcatcaaactctgcctctgggtgccacagatgggaagccaagaacataggagacagcaggagtgcactgccctggggcctacagtggctctgagccccagcaaatgccccccactttcatggtcccagaactggtcatcaagaggactcaaggtctttgtgtctaccctgcattccaaacaggactctgccttcttaagactagttcattcattagcttctgatcagccagatccttggccaccctctatttgagtcaagcccccgtccctgatctcagaacaccccaagtccaccttttcctcccccacgtgaacaaaatcaatttcagggcagcccgccggcattaaaaattgctctacctaaaggtttaaatacctggtttttggtaagtaaaattcccataccacaaaaagagtaccaacaacacaccctcataaggggaccctccaggactccctgaaccttccctggagccctggtttctccagctgtccaaagttaaggctcccatacacctagagatcaaatatcaagatggtcagttgggttggttggtcgtttggcctacatggctcatgcaacaattaattcacctgtctggctctctgtctctgtccctctgtgtgtgcgcctgtgcgtgcctctctgtcgctgtctctctgcagggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtatgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagcaataaagcgatcgctggtatttcttttctcatgcagccaaattcgccagctggtgaccaaaggctcagatgcttgcttatttgcagacccggcctcctgggtgctccccagtgacccatctttccaccccaccacctccaagtcctgtctatgtctgcttccacacagccctgtccccagggcaccagccttctgtccctcacagcagtgccatcgcgggcattaggagtcttcgttatgttgtatccttgtgagttcttgactaccatgcccaagtttcccccactggcaatggttcctctcttggaggtacagtggaaaccagagagatgacagatgttgagtcctcagtgtctcagaggcagcaattcttgctggacacctgcacatgctcagcacagaggctggtactttggaggcactaaccacttgatgagtaaatcaatggcataaagccccattccaagttatggggtcttttgacaggcccctttcatcctctttctctttgtataaacctcatgtttcagaacaaaattacagtctaagttcatttgcccccagccttgcccaaggatccccgggctgtgctgacccctaggcatagggcaaagggtgttcccaagcagcaggcacctcagtgccctcagttatccagggcaaggggcctggctgccccctgctcctccccatgatgcaggggctttctaagccaggctgcagacagggcagggttggcttcttggccattccctctgtgcccccttctccttctgactggtctcaccctggagatccccagaggatctgaccagagccaggtggactgtggccctgagatggagctggctgcaggcttacaagcacctctggggacatccagaggggagggtcagtaagcacaacggagctagggagacttcagatggactcaaacccagagcaataatactctcacaccaccccacagctaaggcactcatgttccccagtagatcaagccagaagctttgcaagaagggagtggaacgaggctgcctatccaaggtccatctaccacgcagaacttggtcatgcaagtacatttggaaaatctggtcttggcccgtcccccattggcctggtctacacagccaaaaattcagactagattagatgtttgcaggcaattctgtagcaaagcaaattcccctaccccgtcccttccccctagaagctgccttagcctccctgactgggtgtggtctctgggcctaggactcctccctatgaggaaaagtgctctccagccacatcttggcagccccacaaccacagcatcagggcagctgcagcaagtgaccacccacccgtcgggttagacacacaaggcaccaggcactggcatctgactaaaataacctttccctacatgggaagaggaaagcttgtaggctggcacatataaacgtccagccgcagccagatggcctgaactaagcagcaggaactctctgggctggggaggagcctcctgcccttctagaaagtgatgcgtcagctttgttctcctgggaaggtgttgctataccccaggaacaaagcagggcccaactgccagtgcagtcagctgggcctgcgctccaggctcaccaccgctaagtggtcaggtaccgggccagcatcctgggagggacctcttgcgactctgagttgcagcttggactagctgaacacatggggacatgctccaggggcttcttccctggcaggattcctgggatttcaaactacctcaccaacaggacgctgaaccaggagcctgccacccaactggcccccttggtgattgtggaaggtgatgtttttcctaaaatgcatccctcctgttctgctccatatacatgtgcttcaaaaaccaccaccaggaaagccttcccagaagagggaaaggattaagggctctcttcctttgggccctgcagaatgtattggagggaggtgttgctgcaaggtccaggagctgggaaactctgggctcggggggagataatgcaccaccagcctcaaaaaggagctgcccaagttgaatatgtagcaaagaccatgggataagttgaatagtggccagacgaatcactaataactcaccatgggaccctctgaagagaggcctgtgctcgtgtaaccatagcaacagcagatgccagcaacctactcattagtaccacccagtgataaggcatcccctgggctagacccaggggccataaagtagcaaagtagcaaatgtagcaataaagggcccgggtctatacggggacagggtccaaatgaccaggacttggccctctccccagccccgatgagggctcagagccagctgctgtcagctgtctggggagggaaggccctgctccataccaggggtccctgttctatactctaagcccactcaccgcatgatcacggactcatcggaatggcctcctcttagtgcatgtggttctctttagtttatttttctggaatttggggattggaccccagaaccaaacatgctggtacagtctaaaaataaatgacttgaacccacttcaatcca

SEQ ID NO: 2376 - DNA, 629678 bp, Homo sapiens; identical to SEQ ID NO: 2368

SEQ ID NO: 2377 - DNA, 633454 bp, Homo sapiens; identical to SEQ ID NO: 2370

SEQ ID NO: 2378 - DNA, 516441 bp, Homo sapiens
cctctcccgccgcgcctccgcctgcccgcccccgccggccgaggctgggctgcgggaggcggccgggcggccccgagcttcgctagggcgaccaaaacaaaggcagcatccggggctgggtggatgcaaacaaccatgaaagactgggttctcgctctccccggctctgctgctgctgctgctgccgccgccgccgctgctcctcctcctgccgccgccgctagggctccgctgtgagggggaagcaggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtaagccagccccagccgcgccatccatgcctccgtgcctccatccgtccattcaccactcactcccctagtcctcgcggctgagtgtggggaaggggctgccagggtgctgggtgcggacggaggcgcccgccttgggccaggggcgcggggcttgagcagggaagaggtcaggggaccggaggagggaggggatatgccacagatccaggaacccaaaggccgggggaggatgacttgagactggggtgcagaggagggatgggtggacgggggccacgctcgtggtgggaagtgcagaagctgagaggtgctgatcccacccaagtggaaggtccctgggctgggagcaggttagggggcaggggatgagtagaaacaaggggaggcaggatgaagaggtgctgaggacagctcctcttctcttcttggagttgtttagctggtcggggttaccccagtgaaggctgcctatatttatataataaaaatgcttatttttagtgttcattttagtaatcattcatctcacagatcaaggttgggtctttttttgggcaattgccatctttggtaacctgcctccccagcttctctttaaccttttattcagagtcttctacacagcatacctgtgtgaagacagattctcttctccatatgtaatgccactggcaatacaaagtttttaatcatgggagaagctgacagggactctggcctgaataacatagaggttcctctttagtggtttccaagagacctctggggcctgttcagttcctggaggaaacagtccaataagggattgggaatttgcactcctcctcacttctttagagcgcatcaacccttcaagggatttctgtctgatgccccattttcctggtgatggggagaagatgggactacttgctggtggtgcaggagtgtgtgacactgtgctgctgcttgcctcagacaaaactgcttacaagggactggcagagagacggggctttccttgcttagcatcacccatagagtagagctgaaggaggcttcaaccctgccttttcttgggaagtcttcatgtattcaggaaagttttcactctgaagcaggggaatgtaggggccctgactgtgactgactccttggtgtcccctgcttaggctggaaggtgtatctggggccaggggattggcatgaagagccaaaaggaacctgttgcatctggagttacctgatagcaaaagaggggtggggagggagcaggggtgaaacccagacacagagcacattctgcatggcctctcccccaccccctagaagtgcctcctcgagagaagatgctgccgaagaagatttcttctgcttcccctcagtgcagcagtgcctcataggagaggaatggagggaggctgcattcacagaccgatggttccccaaccagggcaactgacactcagataggggagggggatactgagggagagatgtggctgttaggtcacagcaaaatagtagaaatccagtcattcctgttctttcattgtagattcagaaaagggccattaactccgaaggccagagctggcctggttctataaagagcagcaggtttctgaattccctgctccttctcatccaaaaatcaaatactttaagcctgccggcttgagggaggcagaaccctcgttaatctgctgcctgtccctagtggaagaatgacgtccctggtgctgcaggcttcccctcttctgagactggaagtaatggatggtgtctgatagtgctgctgtctgtctgtctggttgtcagtccgtctgtactcactggttacagcccctgccacctgtcctgaacaccttttcggcttgtcaggatttacaggtttgctgctgttccttttgctgtttgctgcagacagcaggtggatggaggcctccagtagctagtggaaaatataggctgctgcttgccagagtccggataggaaggggaaggcacggtgcaagtagtggccatcatgcctcttcattggctgtctcaagcatggtggagagtgagggattttaagtgggagtgggtgagttttaggacagaattccaaacctgctaactgccaaaggacagcaattataagattgtatgggcttatatgggcaaataaaaattaggagcactgtccaactgctcatgtctaacacatcttttccgctgcttttcctgtgactgctttctactggcttgcatatattgttcctttgttgcatggattcacaaaatatcactgtatatgatgctgttatacaacagctctctataatcctggacctctgtattaactttatccatcagcctcctctgctaatgtcttggccttttgttcagtgacagattggtgagtgttttggaatcccagtttgctgccatgtaagcatgtcatattgtctgcaattagtggaaaagtgctgtaatttttttttataggggacactttatgtcttaaaaactggggataatgggaactatttagatgacacatatatatgaggacataatgacacatagtcatagatggtggcctttttaaaactttgtgttaaaatagattggaaaacaggattcttttaacagggctttaaaatattgttacatcagagaaaagtttttgtggtaattatgggtgatcataatcacacatctgagaaattactttcacaaaacgctctacaaagcttaagttctggcaatacggcaattagacttaaaattcacttgtgttattggtgcagaactatctccttaagctacctactgtgcatgctgtctcttttcacaatgtataaaaataggcgcagagagaaaatagaaaatgatggatgaatatgtgaaaccaacattataaaatatcaattaaaatgtatttgtaagtttcatcggccttgattgtaaattactagttgaatttggctttgagaatgtctttaaatatgtataaatggaaaaaaatcaagctactttaaaatcaagattttagaagattttatttgaaattgaaagtactttatcataaaaagaattcgttttgttggcaaagtacactaattttaagtttaatggccatataactggaaatagttggctcccacaaattatgtttaatgattgacttaattatctgcaaattagaggtcttttcttaatcttaatagtgttttggatgtgagtgtgtgtgttctgaaggctttctgaaacctaactttctcgatgaatactccttcaagtaactgttactagacatcatgagccaatatattacataggctgaaaactgcattatctgggacctaaatcagagaagatctcattagatctaggatcttactcctttttgtaaaaaaaaaaaaaaaaaaaaaaaaaaacttcatagagaaagcagctactgaatagtaagagaagagaaaaaatgtagagagttaaggcgatggtttgaggatgagaatcgagtaccatattggaatataatgtaaataggtaacatttattgaacattaacctcacactagctcttattttaagttatttaatctaatgccaaatagttaaactgtgctcaagtttattataagtataaatatttggattctcacaatagcctgtgcagaaggtaaaccaaataatataattctcacatcctcacactaccctcagagaatttagtaatatcctaaactgactcacataacatggtccaatcatgattcaaaatcagaccttttagtctaaatccaagtattttcccgtacactacactgtcttcctaccaagaagcagcctatatttcatttatattttctttaaatgaatttatagtcttttctcagttgcagagaagtggcttggcaaaaaattaggctgattcagatcagctgctgatcacagcagagcctggggcttcacctatactctttcatagagtgttagaaggtaataaaaagcatcacagtgtagtggaaagaccattaagtttgtatccgagtgtttttaggttctagttctagttctgccacttactgtgcaaacatgggcaagaaaattaaattgagattgtatgaagtttcatttttttcctacaaatccttcagtccatggtatgaattgatttataaagagtattgactttgggcttctccttctcttcttaacaggtcacctagcatttgctttctaatcatccataattactacttttttcctggaaaggagagagaaagtagaatgagaagaattcctgtaacttcagctttcctcctccttttacttactttacacaaatataatactgtggcctgaaatatatccataaggttcattatgagagatcccagttaccaactgggaaaagaagaaaagtggaaggaaaatctggggaaccttgagggggatgaggatagcgttcctatgtatgcaggtatcatattttcattagggtttgaaaagattttaatatcttacaccccaaaatatgaaaaaggcattatttaagtaaatacattactaaattagaaggagaatatggaaaccagtgtgggctggatgtgctactgctgacttgactaatagaagcataatgtcttgggaatgttatttgctcaactttttaaacgaggaaaacaatttttgtaaacttgtgcagtgagcttcctggaaagatatcaaatatgaattcctaaaatcatattattatccgcccatacctgtaataagcagatggatgaggttgcagtaccatggcttataaagtcaattgtattgcatttaatttgtcctcatgggctgttttctacttttatacatttggtcctgtgagttgggtattttagagttggtcctgagagtcaaagtaaatttgcctgaggcacgtggcagctagcataatgaatccagaatccatgtacactgacctcaaaccattattgttcttttaagtctttaaaaaagtgcattgagtgctggctattatgatttgtttccctcatctgttggaaaggaaactaacatttatcgtgtaccttctatgtattatgcatttgactggatgctttacaaattttactcacccaggctcacctcttgaagagaattctagcctgtgagtatttattagttttccaatgttagtgaaattcccagaactagcttggcatcttcctgaccctttgctcatgacatttgattctggagtccagagaacaaaacttaaaggagtgagagaggagcttcatgtggctagtaacatgttccacccttttctgagggtggactctccagaactgtctggcttccgcagttctggccccaggtgactctctaaccccatttgtacctggagttttccttatctgcttgctgttttgcccacagggttccctaataccatagcattttcccaccattccacctaaccatgagttatctttgtttgccactattgttctgaattttatttattaaataggctatttctaacaaagtgtcatatgatatttaattcaacaagaccattgtttcaggtattagaattaggtcaggcattaggctgctggggtagaataaaggcgaatcctctgcttacagcccaatgttggctgagttcctatcattttaaaactgccgtagtcagaaaaagaggtgagtgctggatagttggatagaacactggactagattctggtcttaacattatgactttttataggtgtgaacattgtcaagataatccatccaagcatcagattttatatgtaaagtggaatttataatggcagtccttctaatctgtgaagctttaaaatgatagtggagtcatcatatcctccaaattgctgtttccaagaaaggtgccattattatgcttatttgttaaaactgtagaacaccaagattatattttccagtagtctttgaaggtactagggggcttgggaagatgagctcttggagaagagcccacctatcctttcatgctagcaatgcagtgttgccagggttgcagctcccagtgtgagaatttgacaaggagttaaaaggtaaaatgagttcagggcttggtctgagactatatttaccttctttcttttctttttttttttcccctctcattaaatagctcgtacatgtttttagcacaaaaagcaatgtgggcaaagtgataaagtttgaaagatctaaaaggcaatcctaattcaaaaatgagaagagaaattagcttggggtaatttcctcatcttttacagaaaaaaatttggagaaatacagtaataattttagtgtcactgggtttaataaattcttcattttcagaattagctgaataaggggtcatgtatatttgtcaggtagttttctttcatgtcagtttaccattgagtgatgtaataaattgcatgtgtttaagaactttttaagattctttattggatgccttaggttttctgtatttatattctcacattcttacatcgagtttatatacacttattttgactagattacttttctgtggacagcaagagggggttattctgcagaattgattttagatgtttctgcttctgttgcaatattgtgaaaacttcctgttcatacgaatgcttacttaaaggcaaaatagagctgtttaaaaggaaggtgactgtacatgttgattttcctttatctgtttataccaatttcctgctattattatgtatggtaaccccttctctcaattttgagtttcaacccggatgacaaattatattgtcttcctctttttaaatcttgctttctcttccccaaattcttcatttataacttcagaaaatcaagcaattaacagtgttaaaatatatctcaacaataagtaatgcaagcaagtggtagatataaaatcttgatcattgtttggtaaatggagaacactttttctgagaatgaggtattatcagccaggcgtggtggctcactcccgtaatcccaacactttgggaggccaaagcgggtggatcacttgagctcaggagtttgagaccagcctggccaacatggtaaaaccccgtctctactaaaaatacaaaaaattaacctggtatggtggagtgcacctgtaatcccaggtacccaggaggctgaagcagaagaatcgcttgaaaccaggaggcagaggctgcaatgagctgagatcctgccactgcagtccagcctgggcaacagagtgagactctgtctgaaaaaaaaaaggaaataaggtattctcttttatggaatctcaacagaatgatgctttttatggcaaagctgaatttaaaatttcaaaacatttttcaaataatagtagttatgaattgcgacttcatacaggactgtctttatgagaattctcctttgagccttgcaaagagcagcctgcagtttaccaaagacatctttaatgtgtgagaatttatttaaatagattttgggatgtaatattttgatattcctctgagtttagatggcaaaatgaggtaatgttacagaaagtaattgcatgttatttgtaatattttgataattcctctgatgtttagatagtaaaataaggtaatgttatagaaagtaatttcatgcaatatgtaagtaatcaatgcacttaattataatattagctattttaaagcataatgaatgaaagatattttgtgtaatatagaaaataataccatgctaatgatttatacattatttagtatttgtttgtattacccatcattatgccaggtaatttaattatcatctggaagatgatagtatatttacatagagaaggtatgtaaattgaaaaccaattaagatatctgtactgtcatataaaagtcttacactacttagcttcttttaatggactctcatgcataatatacacactcacaagtggaaactaatgtagtaatcttgatggagttttcttgctgtatttgctggactttacatcgtccatttgattagttcacaatttacatacctacatatggctttctgtacttaaagcagtattgcttaatatttgaagactatttttaatctcaagaatatattttaaagttgtaagttattggtgcacaagcattgtgtgccatattattgtttttgttgtttaaacacagcttttaaccaatgtaacaagaaactctttgaggccgggtgcggtggctcacgcctgcaatcccagcactttgggaggctgagaagggcgtatcacctgaggtcaggagtttgagaccagactggccaatatggcgaaaccccatctctactaaaaataaaaaaattagccggcgtggtgatgcatgcctgtaatcccagctacttgggaggctgaggcaggagaatttcttgaacccgggaggcggaggttgcagtaagctgagattgtgcctctgcactccagcctgggtgatagagcaagactccctctcaaaaaaaaaaaaaaaaaaaaaaaagaaggaaagaaagaaactctttgataggatgtctagctgctagctgttttgttttcaatttatgtggtttttattctggaaaaaataggcagattgtatatgaagtacctagggtatgtaaaaatcaatgtattgggtttctttaactatatggtagtatatatccacatttagaggttctatccaggtcagaaagattacttagcgtattggtagaaagagatgaaaacaaaagtaaagtaaccaaatggcttttccttttatatttcacacagcttagcagatttatcttccttggctatctctgtattgcaatatattggagcttaagccttctttcctaacccctttgtttctgggaaaaaatgaagacattttacatcctagtatctggaataaagggatattgaaatgaacagtctcatttattttagatattgaaattttagtaagatccaaaatcctaaagagattctaattttatattattcatgattgtgacagttttcataaaagtgtaattttgaaaaataaaatacagtaaagtcttcttatattgagaatggatatttcaatttacagctgtctgcataccctaggtcaaatctagccacctaatatatagcaacctgaagtaaaaacttgatgctagtctgaaaaagatattatggtctaagtatcatgccagacacaagcattagaaagggattttatggtatttagagctccaaaagcctaagctttaacagtcactattgggtacaactatgatggataatcagtccaggggctatctagtccctgacttccataaatgcagcatagttaaaggctataggaggtccacatgcaatagaagagaaataaacatggtaccaggccacaagaagcagatacttttgctagtaaggttgtgcaaattaaaaaaaatatgacatacgcactttgggaaaagactaaatactcaagaacacaaaatagtgcaaattgagtggtggttatgataagaggtgaagaatcttttgaagctccctcttgcccttgcttctataattccatatccttttgatttgccttcaatgtttctaaatgcttctattttatcttctcttgaatctcagatgttggcgttctcatggggtcctattctccatattctcccattttatatgcagttccttgtgtatctccgtcaatggctccaaccatgtatatgtcaatgatccctagatctatattactgcattagaatttactactaaattctggattcatgtccttagccacctgttaaatttctctacctgagtgtcctataggcacttcaactttattgtgtcctgttataaatttcttgactttctgcctaaacgcagtgtctctgtatttcttgtctgtgtgggtagcatcaccactgcaactcctcacttcacccatcatcaaatcctacagatttaatcttttggaatcttttaaatgtctgtcttattttccaatcccattgtcattaccttaatgtaggctctcttcagtacttatctggatgcctgaaggaacctcttgattcatttttctgccactaatcaaaattcctcccatctgatctgatctccacattgctgccagaggaatctttctaaaattcgtctgatcatgtctctcccataaaacccgcttgctttcagagtaaagtttaaactttgtaatctggatcctacttgctatttctgttctttggtccgtgaatacattcctgccataatcttgctgaactagttttcaagggtaattgctatttcacaacatggtaacccaactcatacttttctctccatcagaaatatccttttacatctgactaagttttacctagccttttgaattagctcaagtgacaccttatctggtatatcttcccagacttctcaaatagattttggtattcgtcttaacctcttttgattgttttatttgatttttctataacctctttctcttaacagtgtcctctcagtacagcataaattctggaaaggaggaccattcttatttgaatccctcatataagcatattgcctggcatagaataggtgcccattttttaaaattgtatatggatggatgaatgaatgaatgaatgaatgaattagattcaaggaatgtggactggaggagtcacccagggctgctaacggtataagtaggaggatagagtgggatgattattctaaccacgggaattcagtcagcaaattttgaaaacaagaagtgagttgagtgcttttagttatcgagagaaccaggttgaccagaacttatgaggaaaatatattggatactagacattataaggtaaaattaacatgtaatttttgatggcctgttgtatcttgatttatcattcttaggtttttgaaagacagcattcttaaagtatttgaatataggtgaggatgtaaattatatattttaaaaagtaatcctctggacagacatgcttaatggaaacattttctttgaaataaaacatcactaacttccatgacagtttatagcatagtactgttagttttctgatttgatatttagaattagatcagtagtgtattgccagaaagcattctactggttatattttttaataaaaaaggatacctcagttaagccatcttctagacttaaaatccttgaaggaaggtatcttatattaatcatcttttcattttcattgcccaactctgtaacccatacataataggcctccatcaagtgctgttgaactaaattgtatagcctgtgtgcccaggacacaacagcactgacttttgcatttcagaattaggctgagttgaggtgtgagtgggaactcagtgactatgtcatccaacactggtaaattctcagctcacctgcaaatacctgtacctaaagcagcatcactaatacatgtcagatgcctcagaacctttctgaacatagtgctccaggccatcaactgataagagttggcaggaaagatggcaataaacattctagccactgaggatttatttttactctaagaagagaaaactgaggccagagactcaggatttcatttttcattactgagagagctagggataagactccaggtcttctgtgtcctagtacagtggtttttttccaccgtcaccctttttacacttggttccattttaactaccaacacattcaaacatttaatttttttcatttctgtttttatttgctttctctttgagatactatttgttatagaaaactccatgagaacttataattactttgttcattttgaatttggttttattaagtaaataatatataagtaaattattgccagattatataagtacattattgccagggactaagaaatattttatttaaagattccctttggaatcatatttgttggaattttatttaagctgtatcaacatttcttaattgtgataattttatttttaattttaaatttttccctgaaaggtacatttttactagcagtaatttagttatgattccaaataacttttcctattatgcttttgaattatgtatatattaaaataatgttttggttttttttactcttaaaagccagttgatttttgcttacaaagaagagctttctttggttcctcttcacttggaggtttgacttcaattactgtgggtcagtaattcaaggaaagttagtgggatgaggtgtgaatggctactcacatatatatctaagaacttgtatttgtatacacacacacacacaaacacacacacacatatatatatatactctcatctcacctgtgcctccatacatgtaatctcacatacccacatccctgaagacttgaaacattcttctataaagtcttaaggaagttaattctatctaatttaccagaatttgtatatttgtatgatctagacatgacttgcattaccttttgcacccacagccctttctgtggattttatggcagtggctattctggaagaagcagccctacatccatatgatcccaacatggctgtagctaactggactaatggtggacagttggcccaaggccaggtaatttatcgactggccaaatactaatgagagtgtctttcaaatttttaaatagaaaatcatcagagggccaaagaaaatgaatgatccacattcatttgttcttgaagcaaaaatagattgggcactactcatgatatgctaggtgtggtactagaattaatagccttttgtagaaggaagtaaattttcttgaataatcacccacgtaaaattaaaatctatgataaaggcagcacagaacattgtataatattttgataaaataatactttatcaggaattttgactaagatcaggttatccaggtgtgcttcccatggaaatgacagtaaggactgagctaagatctgagaatgaacagaagttaagcaggcaaataggggtgaagtaccctctagaagtaaagaatgagagccagtgatggaagggggagtggtaagcctgaagcactggaaggaagccagtcttgtggaagaggaaaaagtctgcaaaaggcaggagtgtggtttgagaagaatttggagaggtaggcagaaactagacatggtagggcccaccaggtcatgttttagagttttttctttattttaagagccaaagggttttgaagagagatatgatataatcttattagcatttttaaaagatcattctggctgaagtatcaagagcagattagatgaagtcctggggcatgtatgtgtagagaccagctgggaggctactgtagaaatccaggtggcagatgttagaagcagaaactttggtggtgatggcaaaatgttaaaatttgagagagatttgggaagcaaaaaccacaactgttattgttgttttaattgattgaatatgggttgatgtcagacttgtgccaccaagttttgggagtatctggagtggtggaagagagatcccaaatttagtcctggttatttggctttgtggtaactttgagaaatccgagagagatattaagcaggttaaaggtcaggaactcagaagagagtatgggttagaaatgtaaatttatgagtcatgtgtacacagatggccatgaagctatgggtgaggctgagtgattaaattcagacaataagaaagcctaggagtaagctttaatgaagtttcacttttaaaaattgatagaggacaatagccctgcaaaagcattaaagaagaaatggccagagatataggataaaaaccaggagagccttgtctcactaaatcaaagggaagagagtattttgaggaggctaaggcacactgactatgatagctaaaattagatgaacaaacaaggaagactggaatcacctaatgttgataaagataatgagaaactaaaagtcttatatattgattgtgggcatgatagagccacttgagaaaactctggcagtttcttaaagagtttagcgtgcatctacactatgacataggaattccattcctagatatttatataagaaaaatgagaacatacactgacaaaaagacttatttaagaatcttcatagcaaccttattgttaatgaccctaaaattgaaatagctcagacgtccatcagtagaatgaatttaaaagctgtgaaatactcacacaatgaaaaattcactattccacaataaacaggaataaaacattgatacataaacaacatggatgaatctcaaaaacattatggtagataggaaaagccagacacaaatcaggcagactgcatgattgattccattcatatgaagctccaaaatagggaaagctaatctatggtggtggatatgagattggtaggctcctctatggtggcaagggtgaaggactggctggaaaggggtaggaggtgactttctggagggttgtaaatatcttaaatattgatagaggtatgtattatacatatgtatgcatttgtcaaaactgaccaaactgtttacttactacgtgtgcatttcactgtatttaaattttacctgaatcaattttttaaaatgaattctgcagagacatcaaataggatgagaactacgaaagagctattgtattcggtaacaaggagatcactggtaacttcaggaaaggctttttctacaaatttatggggtcagcactagattggaatgggtagaatgggagaaagatgaataaaaacaaatagttgttgcatgtaaatctttcaaggagcttggctaagaaggggaaagaagcatgagaagatagctagaggagaatgaggagttcaatttgggtttctttaagatagaatttaaatggataaagttaagaatgtttagaaatcaaagaaggagagaatacagtggaggaggtggtttgaataaaagagagagtgtattttgtgacgggaaagaaaagatgagggaccttctgtctgtttctattttttctgtaagtaggagttggctcatcttttgagagtgaggggagtttgagatttgaggataaagaaaaaagtctgaaatagttgagttggggagcaagagtgtgggtttatcagcaagacaattgattactgatctacagatgaagccatgctgggtcatgtataagatgagtcaacagaaagggagagactgacaaaagcatgcagataagagaggctttttggcccatgagacacaaaaagaagagtctttgatttgacctctcaagctgaatcattgtgaaacctgggtcaacaatttcctatgtatgtgatctttctttttttcttcaacagttattttaagttctggagtacatgtgcaggatgtgcagatttgttgtaggtagttgctggtttgctgcactcagatcaacccacctcctagatattaagctcagcatactttagctattcttcctgatgctctccctcccctgcccccgacaggccccagcgtgtattgtttctctccatgtgtccatgtgttctcattgttcagctcccacttataagtgaaaacatgtgatattcggttttctgttcctgtgttagtttgctgaggataatggcttccagctccatccatgtacctgcaaaggacagaatttcattcctttttatgactgcatagtattctgtggcgtatatgtttcacactttctttatccagtctatcactggtggccatttgggttaattccatgtctttgctattgtgaataatgaagcagtgaacatacatgtgcatgtgtctttataatatgatgatttatattcctttgggcatatacccagtgatgggattgctgggtcaaatgctatttctgagtctatatctttgaggaattgccacactgtcttccacaatggttgaactaatttacattcccaccaacagtgtagaagcattcctttttctctgcaaccccaccagcatctgttgtttcttgacttttcaataatcgccattctgactggcgtgaggtggtatctcattgtggttttgatttgtgtttctctaatgattggcgatgttgagcttttttatcatatgttgattggccgcatgaatgtcttctttaaaagtgtctgttcatgtcctttgcccactttttaatggagttgtgtaaaactcaaaactataaaaaccctagaagaaaatctaggcaataccattcaggatacaggcataggcaaagatttcatgaccaaaacgtcaaaagcaattgcaacaaaagcaaaaattgacaagtgggatctaattaaactaaagagcttctgcatagcaagagaaactatgatcagagtgaacagacagcctacagaatgggaggaattttttgcaacctatcaatctgacaaaggtctaatatccagagtctacaaggaatgtaaacaaatttacgggaaaaaaacaatcactatgtaatcttaaactgacttcgtttgagtaggtttctgtttctcccaaccaaaagagccctgataaggattagtagtgtgtgtgtgtgttttttttttccctacatggaatttgactaagtctgcatgcatattaagtctgcactagaaatagactaagttttgagtttccatgttgagacaaaagaaagatatttccatttcaaaaattaatacatctgttttcatacatgtatgtatatatgcatgtacatatacacaaattcatatgcagtcttcataaattggcattcttccaacaagataaattatccttcctctttttcacatgtatctttcatctagtcagtttatgtttttgtcctttcacctgggatgaccttgtttattattatttgaaaggtctggaggatacagaataaagaatggcattatttccttcagatcttttaccatgagggacagtctgatacccacagtgtgatagggaaagctctgaccacactagtttgacttgtttcccatttcatggttgcagagtaatttggatttgttttaggccaggcccctcagaagcagactctgagatggagattattgtgcaagacgcttattagggagtactttcaggatcaacacctgtgtgggaagggaagtcaacagattggaaagtaggagaaagtgggctataatacaaatacagtaaggcctcaatgagtcccttgggagttctgagactagctggaatatcttgctttgaccagtcactggatttaggctgcctggggaagaggatctagccttaggagaggtggctggcttcagcagagggcaatttcaaagggaagtctgatagctaatagcatcctgacatctggaggagtaagaccccagcctcgcaatggacatctgggcttagtgcagcatccactcactgattttagctgaaaattaaaataacaagtttgggaaagctaatatttcttaactacctaaacattaaaggaattcacaggttaaatatcaagtcaactataggatgatgagaaacctaagatttattgacaaaatggaatatataagtcaactggtaagactgtccagattgtggacctcttttggggatttacaacatcatccaaatcttaaattacaagtctatctatagaacacttgcaaatgcctgtgaggcaatgaataagagttgtggagggtagtgacttcactgaggacatttaatttgaaaggtttggtttcatgaaatcgttagctctataagatttcatttcactaattttttgtaaataagacaatatagcaggaatcttatacagtattgaagatatgcaataatgggattttacttcagtgacctaagttatagggcaactatggcatatggtctttggaaaattccctcctcccatttaagccattgttccaaaaacagtccttacctcttcctttggtgtgggtgccttctgttagcactaaactctgaggactttttttttttatatgggaaaatagagcggtacattttagaagatctattccataatttagtccaaatatctccactaaattagcagtgtgtttttgttagaaaaattaagacaaacaactttcacttctcagtaacctagcatgatacaactttctcactagcatagttcagtgtgaatcaggtggccctcttctatcttgaagcagtgatccctgaaacacatggccacagctggggaagagagggaaagagcaggtagaattaacatacattattgttgccattggccaggaccaggcaactgcaggagatgataggaaatgtaggagagcacatggaatatttgctgagcactaatttcagaaatttaagttagaataatttaataaattaatattttatcaattaagctacctgtttccaaaaatgtacctagtttactttccttgatttaaaaaaaattaacttgttgaagacagaaaaaaactgggatgcctgggatttgagtgagaagagcgttagcagccagatcagtggtttccacactgtgtctggtgcagttatcccagagtgttggggaataatgttgactggacaagaaggcaacagggcaggctccaggtgtcttggctctacaccctactgcttgattcccagctctctatctgttttgtattttgtggggaaaatgagttctgctgcaaaaagaaatatctgataactactcatctactctatcaccctccttttaaagctatggagttttacacaaccatctaaccaatattttggggctatagggacaaagtccctgtcctccttatgcctgtactccagtgtgtcccagaaagctccagtgatttcctaacatcagaataagatctagaacccatttttctaactttcagtctggcctgaagtgacagtgagattgtcaactgagaatattctgaaaattttggcatggaaatgactgtctagggagtgtcttaaacaatggcttctatcttggagaagggacacaaacctcctaacagttattttaagtctaatatgtgggccttgtttggacttcacttctttctcacttataacctttagtgttgagcaaattctcctctcagagtacagtatgtttgttttatagcacagtgtcataatcaacaaataacattacaccaacagcaaaaagtgctcatatgtgcactccttgttattcttactttgactccatgcagttggtgtgacagttatggatgctatccctactttacagaaaagaaaacagaaaaaataatttaaataaaggttacacagcacaagtagtaaatgttccacagaactgggaaacaaagttaactattattacaactggatactaaaatgcaggtaataactgagaatttctctaatgtaaactcttaccactagtagtagtaataattattatgggatgcatggagcggagtgcctgagtgtgtggatttctaaatcaatgaggcctgggttcgaatcctgagatccaccacttttactatatgatcctgataggtcatttaaacccctcccaattgtcttatttgtgaaatggggatgggtgggaggagcaaataggataacaatggtaatatattaagaatacacttagcacagcttttcacatgtgggcaacattaacaacttttggctataataatgattattttataacaatgtgaattcaaatagtactacacactcagtattcacatctctttgagtataaagacaggtgcatctacactgtgtgagcactgtttaaaggaattttgaatcacaattggagctttggttcttacattgtgctaagccagaagactcttattcattgtagtgattttagcacaatgcagttacctgagctttgggaatacacagaagttgggtgctttcttttgaactagggtagtaaaccttcttttagcagcactttggaatagatttaccctgcattatgcttacagatttaattcctcacatttgttgttttactaaggaagcattttggcttacccctcagtttataatctcatatgaatgcatgggaatttatatacattattcatatggtctgtcttcaatggaaaaaaataccctatcttgagtttttagcatggaggaatacctccaactaggaaaactcactgtataagaataccttacttaaacaattaacagatttttcacccttaatcaatggcattcctgagtaaatatttaaaataaatgctgtaaaaatattaaaaatgctctctaaaatgttgcttgaatgtaggtctaatgtggacttacagcacagaacagctgacataatgctgacattttcacacaaaattagaagtgatagaaagttaaaaatttttctaatattttaaaaatacagacatcacagctctacacctttgctgagatcaaaggtgtaataaaaatactcaaaaaataatccaatgtgtaataaaaatttctaactatcaataccaagttttagctcacagcgtatatacatacttccataataccgcttatatgtcaaattatctacatttaactcatgagaaaatcaagtgcatggaacaaagacctgtgttttgttggtgaaactctagtaagttggatatattttccatagcatttatgaaaattttctaaaagataaaatcctaccagaattttatttatacttaagctggaaatgacttaaaaaggatttgggtaaccctgagaattagtccttaattgtttttccttcaaatttgaaagtaagagacttttgcctttattatagcaggcattgctaaacctttcacaccacatggcatgaaaagtgggcaaagtgtttctgtttacctttttggattcttggttcaagaccaaggctggtcctgggcccctgcctctaccctgaccccaaagaggcaactccttggcttttagtttctgtttttattcctttagggaagaattgatggctaacttgggagaaatttagtcactttatcttcttttttcctttctttgctctctccttcttctcattacaggagacagaaatatgagagccccagtggggaattttcccagaagagagaaatgaggcatccgttggtctataatgccagtcatttccggagaggagtgatttttcttgtctggcccttagggctctctcctgctggatgaacccagccctttgtgccatctgcctcagggatactgggagggagacctggagaggagtggtacagataggaggtggacactgcttcatatgagcctcctctacatgactgctccttcttagagagccttcctgtcagggtgcagtcaacttctctaactttaaatgggtggctgcatataagtatctaatttactcataggctctgaggtgttacagacaaaacggtaaccctgggtgaggcagaaagcacatttagaaaggaagaggatgctgcgttggcagcacagtcattggtaaattttgaacaccccctgttattttcccttcagcatgatgttacaatatgttttgttcaagcctaaatgaaccttttcatcttgtaattaacatttttacagtgtttctcctaccaccatatatttttgtttagaaaattaagacccagagccaaagtcaatgagtaaaagtgtttgttttgcaaagagtatgtatttaagcctgtaagagatgattagagaaaatcaacaataatttaatctaaactttcttgatttcctcatatatcaatatttagattctactgtatttctttttattttattttattttgaggcagagtctcgctttgttgctcaggctggagtgcagtggcacaatcttgactcactgcaaactctgccttccgggttgaagggatccttctgcctcagcctctggagcagatgggactacaggcacccaccaccatgcccagttaattttcttttcttgtatttttagtagagacggggtttcaccaggttggccaggctggtctcaaactcttgacctcaagtaatccacctgcctcggccttccaaagtgccgggaagtgctcagcccttccaaagtgcccagcctgctgtttatttcatacttaaagttttaaatatattgatgaaatagtctttttctaacattaagtgatagataccacggagtgtgtttagtggcatacctttcatgacatgcattttgacatatatgaagagttgactctctgaattctgtggggcaaattgacatccaaatcacaagttagctgaggaattccttgattctaatcttgattctgctgtctctaatctaaccctctagggtctctgagttttcaagaatgttttattcattttaattaattaattacttaattaaaataatgttttggcgctggcttgcattagaaaatacagaggtatactaaaattaacaataattatgtgattctgtaacttactgccaagcctattaaactctcaggaagctctattttttatgtatatgtcagagctagtttttaatttatctgaagtggtttgtaattattgataatgctgataataaaatttatattgtttggatcagaaaaaaaatttaaagtagactctgccttttattaaatacagtttggattctaaaatttgcttgctggcacaacaatctgcgtattgttggtgtgatcctgtctgccctcctctcatagaacacaaaaaagcagcccggatgaggagtcaactcacctctttctaaacgctaattatttgctgtaagttaaatggtcagaggatgtcagtgtgactgtctaggtctttgttcaaagatctaaaaggtagcagggaaaagttaactcaggtgtggcaaataacttttcagtagtaagaacctctggaaggctgtgaaaatcagaaagagagagaggtacttatctgcacacacttttctcctggtcaggagaaaattaaaaatgactacccatttaacgtaatgtctgttagataagctgacaaccttaggtttaagtagaaatacaaaaactctgcattttaaaaatatattattttaggaggaaagaacacaaagtaaaacaaaggtttcagtgtatttgtctgactctggaagctttggaacacagcaaaatattgtgcattcttggactggacatattttagtcaatatgctgactatgggatccctgggctgaaaagaggatctggcccaggcagtggtagccagttggtatacaatgtcccgtccatgcgtacacactaggccacattatgaatactgtccaaattttatgacttgaacatactcattcctactcactttctaggtcttatcaaagcacctactcccttcactgtgttctgtatccctcattatccaggattgattttagagatacttcatatatgttttttggtgatgtgtagcacacataatgttgtttgtggagaacctttgcatacgtactgtgtgcctctggcagagtgcacacacagggaacaaaggaagctggttggggtaatttctaagtgagtttgaatattccaaggaaagcatgtaaaaggtgccctctgataatttgagcatttaccctgagccaaagtttaattaatttttcactaccttttggcctagtaaacagtggagaagaacttggggagagttggcagctctggaggatgagatgatcaatctggctccaataggaagattagattgaaggaagataaagggatatcagggtgattaaagctgtgccagggtgaaggttatagaggagtcaaatctaatttaggcattaggttctaaaggtagaacagtatagaaggtgccacttgagtattgttgaaaacctctttggaagaagccatattgaagacaaacatcatagtacgtcccacacaggcagtttacccttcgacattgaattatgcagttctgttgagctccagattccattgttggcttatgttttaagggccatgttgcattaaaaaatgtgtccatgtgtcattgaactcattgaataccatagtcttactcaacttggagagttcatctgtggatgagagccacacaagaactgagttggccccttgggtagaagatctttaggctgatttagggtaaatacttatggagagaattagaatggtaaatggacttctgcccactatttaaaacaattttcttatctatctctctgtctcatgcatatggttaaattcttataagttagatgcttgtatgatgcagatggattgtccttgtggtcacttggcaatagtaaaggaaagaagcttcccttagatccccatactctggcccttggtggatttagcactggaaatataaacattcatttaaatgaagtatttctcttttctccatggatcaactctatggaaataggctactgttgttctcacaaaatctcattcaccaaagctttgaacatgcaaaagttttgagatctttgcttaacacatatcagtctaaaggtgaagtactgaagggtgtttatttgttaaacatctgttggtgctttcaaattataagacattggtcctgatgagtcagtatatagcaagaaacacatatttcaggtcttgaagggatttccatttttggccttgctattgtttacatttgatatttcttaaatttgacctccctttaccttggtttaagacccctgggagtgaactcctatcaatggtacttgtgctgaaaggagaaaatgctttcccctcaccaatgtcaaaacttttgtattcagtatcaaaaacaatgttctgaaatttttactgcttttctgtggatataagatttttattaagtcttcaggttcatatcttgaacctagtcagttgagtcaagagaagaatttggaattaggtatagaagaaaactgaagatgaagaagttagcttaaaatatggaacttaaccctgcctcttctgtggtctataaacctacatcagaaggaaatacacgtttcaaagaggcaaagacaattctcttgtttaagataacacatttttgagttagtcataatttgttttgttactgaaacatttgaatacaaatctctgatacccaaattaattatttctcaccattcctcccttccctgggctatttatttcttgctttgttgtgtctccaataaagcaaacataaaatacagatgtaaaatgctacagtagaatttatgtaatctaccttgttattgctgttattataactgctattaaattgtaatagtttataaagcctgagtgtctttaatgacttttttcatatgattacatatttatttaaaatgtcattgcgttattcttaaggatagttccataagcttctcagagcagtgactcgttgcaatgaccaagaacatcttaaatggtaaagaaggtgttcaagaggtctcgatgaaacatttggcaaatattagaccttagaaatgaacacaagcttaaacatttaatttaattgaacaaatatttattaagtattatgtgtcaggtactgaatcatattgcccaatagaaaaatctattagcaaaataaatagaatttaaaggagaaaagtatttgctgtctactgtgaacccagtggcatgggaaagaaggatttgatgtttcagtattattttgcaaacaaaagaccaatacctttatttcaaaattctaagtaaaaacaaatgtgaaaaatgagcttcatggaagcttcttaaatttcacgcaccatcctttgttctgaaaacaattgaatctaatcaggtgtggtttgaactttttaaggcaaatggactcagactctctttttctttattcaaccaaaagctcctttgattgaattactaaatctatgtatgtgctaatgccttaatatagcccaaagtttctatattgtctgtttttattaaaagatgtctatttacttgaatatgtgaaatattttatcattaaaattagtaatataattgtatgttgtaaaatatttaaatgtgggtcttattaaaaaagttccagggagataattaggcttggcacctcaatccatagacaaatagatgaattgacatgatgcgaaaaggaggggcttgaagggacggttacttggtagagcaccaaatgtattttgacagacactaaatgctttttatagacaataatgttgttttgggaaaatcagtttatctttttataagttttgcaatctacttgaatgtgcttaaagaatatattttatatttctcctgcccccgccccatctctttgtctatactgggaattccataatgtaacacccttaaatagaaaacagttacagctaatcctatttaaaatggttgctaagggactattcataggagcttagaaatgactcaagatctccctttaaggagtaaagcaggaaaagtaaagaaaagaacacttctaggaagaattttaacatatgggtttgtgtcatgtggtttctggtatgtaggatgtaggaatcatttcccaatctgtgagttccaggccttccattgagccctgaacctaatgccagcacacttctctctcctcaactcctgaggacacccctgggcaaatggggctacacagctggggttagggtaagaaggacacttcctttctctacaactcaggtatggtagaaagtgaccttatgatagctaaaagagtatctatagcactactaaccaactccttcagaagaagagccaaagtagtcattggggtgtggtggggaataaggatagctgaccagctgtactccactctttactgcccattttaggaaaggcagagtcctatttcattgtgctctgaatgtatgacttctgcttttcctgtttcaggatgaatgtgcaatatatagttttcccttcatctatgagagtgacttgtatatttctttgtgaataggaaaatatgatcccagggtttgccatgtaccaggcagattatgcttctactataaacaatgttttctctctttttttttggccagttgcaaatattcataagcttataagagaaaacttagaatgccaaaccagatattccttctgacaaacaggaagttagagatttcttttttccacaaaaaatttaagagtggatacaaggacttctttaaaaattaaaacttggccatagagtttagaacaaataacacagtcagaaatttctaattctaactaacaaaaaggttaggttgaattagtcctcaaaactaaaagtagaattagggtgtgattaaatatctaattttaatgataaatgcctcaagttattcttagatgtttatgttaagagtaatttagatattttagaatttatatttagagtaattcagatatgtttataaacctatgttagctaacacttactgattacaaaacacagacttcttattctataaaaccaccgaatcgagaaatcattgtagtctccattgcactttgccaaaaggctttgagatctatctgaggcaccataattttatttgttctttacagggcaaagttaactcttcagggataaatggcctctgattacaagcttctcaaatccaaacaaatcaaatgttaagaaacaaaacatgctacaaatttagggcctcttttgctggctttaggttgcatgagggtcatagtcatcctaagttaacaagcgttgtgctgcctacatcactatcagagtaccttaaatacagtggacactcagcaaatatttgaatgagtttaagtataaaaggaaatgtactattttgatttaattctatttgaggagcttgtttttttataatgatgacatcaatttccacatggcgaaagtatccctaaatgttgcatacagacccaaggccttctattcttatttgtgggtattattcaatgttttcctatctgtctaaatcctgtacccttatatattgacaacttttctatttacagttatactgactaatgatatgtatgtatatgttttctttattttccatatattactttttatccttccccaattctgtcacatatacttttcacttttatctccactttccaactatggtcaggctgatccagaagaaatcagtctagtgacatatgagataacctgcctttctttaaataatagttctgaatgtaaaaggccagcatcatggaatgtgtttgctctgtgtaggtggtccaagctattttctgattgttcacatgccttctttccacacacctgtgaatctttttcacttgagaacacctagtatcccttgctccacaaactctgtttcttctccctcacatataacaaatatggctactaagaatgtcagggagatagcagagcttaggcaagtcacttagctgctctctgactcagtttcctcttctcacaggattgtttggaggattacatgagttagtatttataactcatgttatatatataaagcatttaaaacagtgacagacacatagtgagtacttgtattagtctgttcttacaccgccaataaagacatacctgagactgggtgatttataaaggaaagaggtttgatggactcacaattccacatggctgggaaggcctcacaatcatggcagaaggcaaaggaggggcaaagtcatgtcttatatggcagcagtcaagagagtgtgtgcaggggaactctcctttataaaaccatcagatctcatgagacttattcattatcatgagaccagccagggaaagaccctcccccatgattcaattacctcccaccgggtccatcccacaacacataggaattgtgggagctacaattcaagatgagatttgggtggggacacagccaaaccatatcagcactctcaaattctttgataaataaaatgggtatggaggaaaattagtggtgagaaaaatggcaatatttagaaagcagaataggaatttctcacttccaatgtgaagagtttaagagttttgtgggttaatgcttgaaaaagctggaatgagctcccaggataggttttcactcaatagtcaagttgtttctagcaaaagccaattagagtaactagcattcaaaaagatcatttcattgatgagagtgtttgtaggctgtttccaatgttacagagtattttctcacagactccatagctgaaatcattgtcctacgaagcggtaataaaattttacttttctctatctcttctaaaaatgtactgcctgctctccttccagtggttaatgagtcacctgaaccaactggtatttgtattctaagaattcactctatctttgagtaattctaagctgattttaaaattacccttataaaattattattgctctggatttctgagtatataattaattttgtaatgtggagatcattcctttctagaattatagcgaaccggaatacttttttgaaagatgccttgagaattcaaaagggatattgctcagttagtaaattttatcttaaagacttgattcataggcagacttgcaggctcacactgagctcgtttattctaacttgtctaggttgtgatgtaattaagtaagtcagttaattagttagttattgccagttaggatgggaagtgggacaaccagaggctttatttcttcatttaatatttattaattgagtgcctgtggttcagaagatattacagtaatgacagccaatgttcctaccctcacagagcttgcattctgggaagtaaatgtagtattatggaattggaggtgtttatattccagtgtttgaaaaaagacttacattaccattctgctgcctactgtgtgaccatgacagatttttaacctctctgtgcttgtttctctatatgtaaaatggtaataataaaattacttacttcgtagggttgttttaagattaaatgagttaaatacacataaggagcttaaaacagtgcctgtcacataagggctatgtaaacactggctattaccattaattagttatgtatcattatatgaggtaagtgtataaagggaggcagaataaagggatagagaaaaataggagctgctgtttcaggtaggattgtcaggaaagccttccctgagaacaggataatttgagccaaaacctgaatgaaacagagaaatgaacagtgctaacatctagtggagaagaattccaggcatagggaacaagtagtgaaaatggcatgaggtagcagagtgcttacatgttgagagtagctggtaagtctgtgtgatagaagttccatgagccagggagaaaggattaagctaagagactaaagaagagggaagaaggtcacctagggcttggttggacaaaattttcagcaaggaattataaattctaaataacgaaaagccagcagaggctgaatcaggggagtgacaggattctgtctgaagaatatactgtgaggagacaagtgtggaccttaagagaccattcagtagtttattgcagatattcaggtgagagacggttatagcttgaaccaaccaaagcagtaatgaggatgggctggtgtttgagcgattgactacaaaacatatttcaaaagtgaagcgaaaagattttcttataggtttgatttagtgttagtagaacaaaggagtctatgatgtttccactttggggcctgggcatctggatgactaaggtaccatttgctgtgatggtgttcacttggagaggaggtccaattgatgggtggcattttgggacatgtaaactttgagatgatgattagctatgcagttggagatgctaagtacgtagtcgaatattcaagttggggagtttagggaagtatttggggctggggatataaatttggagtggtcagattgtagatgttttaggaagccacggaacttgaattagatcaccaagactaaaggagatgaagaagagaggagaggtgaagattagctgtgggagtgctaattattaaatggagagaagaggatgcagagccagtagaggagatagagagaggtgatcaatgagacagaagatgaccaggaaagtgtagagttctggtagccaaatggagaatcatttttaagaagggtagaattaactaatcctgccagatgcttctgaggaagggagtaaagatgaaggttgacagttgcctgctgaattagacactgtggaggtcactagtacccttgtcaagagcaagacccttgcaatggtgaagacaaaaacataattggagtggattcaagaaagaatgtgaaattgcaaagatggacaatccttttaaagagtttggatgtagaggggacagcagtatggggataatttgacagggtcatgaggtttaagtttttcttttaaatgagaaatatcacagtgcatgtgctgttgagaacaggccaattaagagtttaaaagaaaaatcttgatggtgtacagaagaaagggcataataatgggatcaaagtctttgcataagccattgtggatgagcttgagcagaaaagaggaagaaaagactatagagccaggacagttcatgcattgaaactgataagaggtaaattaaatgggtacagaccaggagggtagtagatgttagagtgaaaggcgtttgcttggcattagcatccttctatctgactagggccagagagaaggctgggcaagaaagagagaaggctgtagtcagatagaaggatactaatgccaaggaaacgcctttcactcttaggcagcaaagattaaagcaaatcttaaaggcataccttaagtttttaaacaaaagaacaacgtagttagatgtgggtttcaggaatataaattatgcatcccagtgtccattattggaggaggaagagtttggggaaaagagtcaagttaggaggtattaaaatagcacaggcaaagggcactttatatttgttttataacttataagtgcccactatggttggtgctactagtgatagtgtcagtggggagagataggtgggaaaaattaatgaaactaatagagattcagtcaataaatgtggacgactgattagatgtggtattgaggaaaagataaatgggggtcaggaaaatggcaaaattttgaccgtggctaacctgggagagcatggtataataaatataaacagaggacacgggaaggaaaaaaaaacaattatgggtgggaagattatcagttcggttttggcatattgaaatgccagctggcagtttgaaatgccagctagcatctaggtaaagttgtctagtaggcaatttaaaatttaagactggcacttgggagtcatcaggatactgcttatggtgaaagtcatgagaatggataagcaagccatggaaagggtgagtagaagagagaagtaaataatgtcagtgatgcaacttcatagcctatttacattatggaaggagaatgacgtggagtagccagagattgaggtagatacggggcggtgagagccagctaaagagtaagccctgaagactgtaatgttactgaatccaagagaaaaatgagaatgttttaaagaatgaaaggctgttcaatggtatcagaaaatccaaagaggttaagaacgagaactcaaaatatgttgctggattttgatcctttgcaattgatggatgatagccaaacaacataagtaacaacaagcaccacaactctgacttcaactccaagcttcaactctgactatcatgaccaacaaaacaacaatattttgccaccaggggaagaaacagacaataaaaacaccataaacatgagaatatactcaaatgtacaactgtctggggccagttaatataagattcaaagagtgcaactcatttcaacaaaccctaaaggaatcagtaaattatggtttagtataattgatgcttataatgttgaaacatgagtctttcagagaagattcattcacattagaaattcttggtttaaaaatcagttgcactaaaatgcaatgtagtatcctgaattggattctggaactgtgaaaggacattagtagtaaaactggtgaaatccaaataaagtctgtagtttagttaatagtcatatagcatggttgatttcatagtacaatatgtctggtaatatataacattaagggacacagaatgaagagttatgtgaactctctttactatctttataactttttcgtaaacctaaaattattacaaaataaaaagtttaatttttaaaaatgaccaaaaaaaatccagtgacaaatgtaatttagaaagattttctacccaaataattaaatgaacaaactcttggtgcttatgtaggtaaaatttaattagtgggtactctgtttatgagaattaactcattccatcaatgtttttatacaaatgaggtattatgtcctgagactaaataacactatcaataaattttcctataagtcacctgctttctccagttgacttttagatctgtagcttaactagccagcattaaatgagcctatttacacaacaaaatgaactgcagttctgcttttgtatttggtctttccttacaaaaaatagtcaatcatattccttgctaagaacaagaaagagaaaggtacccactgttaattaaacaaaccaacaaataaggtgttgtaatatttttaaaaagtacttattacttatttgcccttcctgagacatatatcagatacttctaatgggtgattatttgcacatgtaattcatattaataataaccaaagccattcttctagaagtcctggataggaggacatctgtgcagcggaggcagacatgcctctccctggtctcattgaagtcagtgaggttgttaactaaaactctggtcttcaatacaagccattattttattttattttattttttgagacagagtcttgctctgtcacccaggctggagtgcagtctcagctcactgcaacctctgcctcccaggttcaagcaattctcctgcctcagcctcctgagtagctgggattagaggcacccgccaccatgcccagctaatttttgtatttttagtagagacggcatttcaccatgttggtcaggctggtctcgaacccctgacctcgtgatccacccgccttggcctcccaaagtgctgggattacaggcatgagccaccgcacccacaagccattatttagctactttcttgtcaaagggaagctaaagttccaaactcccattttccaatgcaagtattaaactttacagacaattgttctgagcatagtgattcacaaacacagacttgatttggcctcttgcacaatcatacttactgaattgcattttggccttacaggaagtttgcctactgaattagcaagcattaaaacaaatttgcttatgaaaaagagatgacaagtttttgaaggcttttttcataagtagtgaatcattcaaaatctaaactttgtatatatagcatacttcctctagtgggaaccataagtgtaaaaaaaagtagtcatttaatacagatagcaaccataaagaaacctatttttgtctttattacgcaaatgcagttgaggaaactggccaccacatcttgaggtatttcctttatgggaatttctgatgacatttctctctggtttctttaccagcacttatctcaagtgattgttctggttgtcattttgtggatattgtaaatttttgttttggttgccaagaaaaccagaactaaatttgcatcttacctttaatcactatatagaatccagtggcatacatatgtatactcacccagcttcggtctatttccctgttcttatttccacatagttccacttctcacatatacataatgctgtttttacatttcttagttcttcctcaagtcatttttcattgtgctaatatatatataacataatacttatcattttaagcatttgtaaagtgtacaattcaatggcattaatacactcacagtgttatgtgatcatcatcagtatctatactcaactatatcttggtcctcaagaaaaacccagtacccaataaacaataacttgctcttcccctctcctctcatctcctggtaactctattatactttctgtctctatgaatttgcctattttaggtacctcatataaatgcactcatgccatatttgtctttctgtgtgtggcttatttttgaggcaggtggatcgattgagccttggaggtttaggctgcagtgagacatgaccccatcactgcactgcagcctggacgatagagcgagatcctgtctcaaagacaaaacaaaacaaaaaccagaatgttttcaaggtccatctactttctagcatatgtcaaagtttcattcctttttatggctgaataacattctcccaaaatcctttttgaatgaagtaaggtataaaaaaggaggaggaagaagaggaagagaagaaaaaggaggagaaggaaagctcgtatagtttattcctatgagaggagtatttaggttatgtgttagcagaaatggagtaggatgttagtagatgttagcagaaatggatattgctgcctgctaattatgaccttggaaaagtcatcttattttctcagcagtaatttcttgtgctcaataggagcagtgaccagactccatggaggaataaataaaataaaatatgagaatatgcctaaggtgtacatgctccataaaaacgatagcttaaaaaaaattagtgtttaattggctggcacccaagatctgcctgtgggctaacttgtgagataagtgaaattgatatttaggacttttctcctgtccactgtcagggcctctctctcctcccacaacttccatcctactcttccagatctcaaggcactcatgttccatttgtaatgttctacagtttccgcagataggtttctatatttaaaacagtttctaaacagttcacaacttctttagagttcaactcctaattaaccttaataggctagcatgtgatagattcatgaggggcattaatatttaataacaagcaaaaaatcatgcagtgctctttgtttgattgaaaggcgttagaattctcatttagaattctgatcctacaactgtcttatgtagtgcggattttcttcaggatacaaggtggttagatgggagcactgtctttctcagtctccttaagccatattaaatggaaaggggcatgcgtcactgtcatctccaccctgtggtaaagacatgcctgttgataatggttacagggcaagttccacacctcagcatgctgcctaatactatacctctttttgtgacttttcttttttttttttgagacagagtttcgctcttgtttcccagctggagtgcagtggcgtgatcttggctcaccgcaatcacagcctctcaggttcaagcgattctcctgcctcagcctcccgagtagctgggattactcatgtgccaccatgcccagctaattttgtatttttagtagagacggggtgtcttcatgttgatcaggctggtcttgaactgctgacctcaggtgatccacccacctcagcctcccaaagtgctgggattacagatgtgagccactgcgcctggcctttgtgacttcttaaaatggcatttgaggaatcacactacctagatatattttgatgctttttctgcttagaaaagagggactgattctactcttgttttggtaattagctaatcatgttatacattttccctgaaagatcttagtaaactatctttccttgccattgtattctttttgccctcactttctgctaaattgtttgtttgattgtagttttgtcttattaggcacttgcatgtttcacacttgaagtagttttattttgctattggataaattctaccatcaaaatatctggtaattgggacctaggttagagtttataatatgaggaagaatacaaaacacatataatgtcctcagctctctacaaaacgtttggtagacaggctgaaagaagattcactatttaaaaaagaacaagtttctatttttgcctctaagggaaatgagctttgcccacccagtaaccagcttggtaatatcatctgcagggacttaccctcaggttagttccagtaaaggaatttagggacgtaaagaggacgtaaagattgtgaactaataatttatcacaagtcaataaagatttgttcctgtctctgcatttttatctttctttatttgttttaaacataagaaaatagactgggcgtggtggctcacgcttgtaatcccagcattttgggaggcaaagaccgactgattgcttaagtccaggaatttgagaccggactggccaacacagcaaaaccccatctctgcaaaaaaaaaaaaaaaaaatgcagaaaattagctgagtatggtggtgtgtgcctatagtcccagctactcaggaggctcaggttggaggatggttttagcccaggaggaggaggttgcagtgagccgagatcgtgccaccacactgcagcctgagcaacagagcaagaccctgtctccaaaaaaaaaaaaaaaaaaaaaagatttaagtgtaagaaaatattgctaaaaaatctctttgagggtgttgccttcaccaacagcatgctacttcgaatattaagatgttacatttcttcctttacaagaatgttctgtaacagagtctgggttcctcagtggtagggactgtgcagtgctgtcttggcatgtgaattgcctagtacctagtaggtggtgaatgagcactcaagtgcatacatcaatgtttaaataactgcttattggaaattggtatatataatattttcctttcaatgataatgggttaatgaggaataatttggaaagaatactaatttcacttttgaggttttctgccctcttttattttggtactattacaccttttgaacaattggatttgtcagtttggatgattaaatgtgactccgtctgaccttatccatccgttgcctgccctccctccctagctgcaatatagtgaaatcagtgtgataaaggctatgacagagctccatttattatttgtaaaatgatggagttgatgagacttcatagagatctcatgagaaaagaaatcaggaaatggtcaggcatacgttaagttaaatgttattttccttttttgtttgaaacaggaattatagaggtaaggctgatgggaaaaatgattgctaaagagcaggtaattaggtataaatgcaattgagaacaatgatttaatagacaattggtgttctactaagttggaatatctatttgatgtggtatataaaatttgactagttagatgaaatttctaaccaccatgttggttgatattacaaattataatgtcatagagcagaatttgtgggaaaggcaaaggtgcaaaatggtccagctgtttaagttagtgactggattactgcagaatctaatttgaataaagaaagaaaaattgagacattaaaataggactttgtaaaaactttcaaaactaaggattggctttagtccaagtgattatgtctttggacaaccatgttgttgtcttaccaattacattattttacaggtattatccctgtggatttttttacaagaaatgtttttactgaaatatacatgaagaaaagttaacatatcatgaatagacaacttgatacattttcataaagtgaatacatccttgtaaccacccagcatatcaaaaaacagaacatttctgctctctccccatttcaaccgttactctcaaaagtcaatacactctttttattgttgttgttgttgagacccagtctcactctgtcaccaggctggagtgcaggggtttcaccatgtcggccaggatggtctccatctcttgaccttgtgatccacctgccttggcctcccaaagtgctgggattacaggtttgagccactgcgcccagcccttctggtgctttttaaaatatcaccaaagattctattatatgtttaatctattagatagagaattggtgaagtgcccaattaattcagtaactttagatatgaactttgaattgctaaactaaaaatatttttctcctctagaaaactttcccatgtttagctgtacaaaagtcttccatctcaggtcacattaataatgacacagatttaaagacccaatattttcaagtatgaaagaatataacacacattaaaatactgctataaagtcatctatataaagctgatttaatttttacatgtccacatagatctctgctcagcattgtacaaacaaacccaaacttgtctctcatttcttcactataatgaaagaccaaatattcctattacttactttggggatatggttgatacccgtcaattaagttaatgaacaaacctattatagaattcaagatataacagcagcccaaacacttctaagtgtttaacttctaagttaacaccagcctagtaacttttgtattagtcatgatgtgaattttaactacataggtacgattcatgatatcattttacaaaatcaggatataatatttgttaaataccacctagaccagcagagataataggcattgtgcggggtgtagaatagaaggatgaataggtgttattaaattcctttcaaatattagaaaacagagtgaagcttatacacccaataaatggcaaaccaagctatatcctgagtctggatccaaagtgagtgttcttttcactttgccatattgccattccaaagtactgccattccaaagtgaactttatctgaactgattagaggtacagaaagaaggcagaaaaaaatttagaagaaatgaatggcaattaataatttatccacatatatattcactctaagacaggaaaatggagagaatagaagaatctttctcaatacctgtgtaccactctactctcttcagcaaccttctattttagattaacagaacatggctacttaatataaacttaacagagttactctgaaggataaagacattcggactgattcacaattttcttacttggtactgcacaattttgtgcaatggtttgtaaaattattacagttaactgcataacataataaactcaaacaatgttgaatatgtataagtgtatcctgtgatgaataaaaaaaagtcacagtgagttagaattaaaaggctagtcttgggtgaataaaggcagatgttattaattgactgattagacaaaattcgttgaaattctcaagggcatacagtatgaaatacatgactgtgaacttgactgtgtgaaaatatgttaggattatttttgattacatagtagggaaatatattattgaattataccgaagattattgtttaatttctagggaaatctatactccttaatattctggccacataccaactaatggttagctcttcttttttgaactttatcattactttgaaaaaagaggaatgtattagcatcagtatcctaaaaccacatatgttaaaataaaaaattaaagacaaatttataatatttgaaaaatagaattcaattgccaggtaggcagaaagcatttataaattgccacttgccaattttatttttgaaactacacaatcttttacagaattctacagttattttatggttgaaatcatggaagagtcttcatatttttcataagctagaaagttagtatggtctgcagaaattgtagaaatcggaatcttacatttttcaaataatagaatgcatgcgcatttttgtaacagatgagcaatatgttagtgtacgaatgaaaagacaaactctttgccctgccccaatcacattctgcagaaaagtatgtgatgattccagacattcattctttgcatatataaacaaatttataagtatttatacgtacatctttgtatacacatataggtacaacagataaataatttcattaaactcttgaaatccgatttttaaaagatttaacagtataccccgatcatccttttattcagaatgtgtagaatgacattactattttaaatgttactgtattcatgtaacaatgtttatttaaccaattctttattgatagtttttccttgtcattatttgaaataatgctcaaagtccatctttctacatatatcctctaaactgattaaatttgaatttattttttccatcttttatctgattatcctatggagggtatattaaaatcagtattaattactgagttttggaaaattttagtttatacctattcttatagaaaagaacatgtacaaactgaaatttcactcaaataacatttatatctatatattctttactaatctatcattttgactaaaaattagctaatactttttttcttcatcaagtccttgaatttctagagagcactgcatacagctgtgtttctcaatcttgactgcatattagattttaaaagtctagattcccaggctgcatcaattgaatttgaatctacaggggtggaacctgggcttagtagagtcatccagatgattttaacatgcagccagtgttgaaaatcattgacacagaatagcttattttgaatgagatgtttcctggggaaaaatagagaggaagcaagaaaaagtttaataaatctcaaaagaaaaattttgccaagttaatgtgtcatcaggaatttactatatgtcaaaaacatgctcacattgtgctattttttggtaagagactgaaaggcttcattttcaggctgaatttggttagtgaaagtaaagagagaaattgcagcatcttgcacctctccttagcacttgtctgggttgcactgtctattttctgtttttctacatcattatttaattcatgtttctcttccctggtagagggtactctccatgagagcagagcttcaggctatttcagttcatgctgtgttcctagggtcaggtatagagccgacacagttggtggtcagtattggctccatgagttaatgactaacactttggtaattcaaaagaaggtagaaggtaatcagagcatagaggtgacagcatgggagcagatagcttttattttgtatttttaaaaactcttatatgccacatttagaacaaagtacattttatttggagaagtcaaatgggggaaagtgtgagaaaatgataataaagaaaattattggagagaaaaaagactatttaacaagttggtgagcacatattttagtaagggagaaaaccagtatatactattctgaaaagcctgtcttgtatttaggcaggaaactattcaaagaggacttggttcccataaagtccattttaatcagaagggagaagatttggaatggaatgaagatacagtataaaagatctgggtcagttcagcactagagggaggttttgaaaaccctaaattataaaaaaacatttttctaaaagttcagttgaggccgcgaaagatatgaaagttatcatgtttaacatctaatattaaaattaatgggactggcatcatgtgagaaagaataagaatgattctaatgtgctccaggactctgtaaaacttggtgtgaaatgtctattccaattgctgagaaaaaaaaaaccagaatatttcagtctagttttgagaacttttatttgtatatttgaggaaataatgagtaatattttaatggtcaatgacattatgcagatgatgacaagtattgccagattaagatagacttggttttattgtgtaaatcctgaaagtcccaagtgaatgggaataagggtgtgaatacatgaaaatatgtatgtgtaaaaaagaaaataaactaggtggcctattgaaatgtttatagttcattatgttgttgtattctcgtttctaccaatactatttctcactctttgccaactgagaaaaggacagaagagtattgtaataacgctaaatggtggcattaagaaaagctctaattaacatttagagacatatttcaagactatttaaatatgatatcttccatcttaatttattttagaatatttttaaaattgacataacagacatgataaacaataaggttattataataaaacctgaaattcaataaaacttggtatcatttttgttatgctagtctttcagattttagaaggtctgaacatttcgtagaatcagatttctgttgctgatggaaagaccctagagattagtcagtctattaccttgttttatagatgaaaactgaagcccagcaggtagttactttgaaggctatgagccatgatcagaatccaggctcctttaatttcttttcttctgctcttctgtataatattttactggtttttgagtgaatcgggtccaagtatatgtcccctatgatttcccttgtctttgacaaactcgaaattccttttcataacgaaaatcaaaactatcttttctctatgctctgaagcttgcctgaagatttacaaatggaaataatgttagcacaacccaaatctgaagatatctggtataagtgtttagattctttaaggtaaaggtcaggactggaaaaatcagaatggattaaaagcagaaccagtgtaagcacaaagaccagcatctactcaatatgcaaagcagagattggcctcatattgacccttttatattatgaagccactaaaaatagaaataaatcctgatataactaaatgcatattattgacactagtgtttttgacacttggaatagatttttgtgttcatagtttcatgtattcctgtataactgctatttaaaacaccgaattcaaatacattgacccttaaggaacttaatgctttccagttcaaaaatagtaagccctaaataatttcatcaaattattttgcatttaaagcggtcatgtaagacctcaggagaaatacttgcttaatgtcatatatttaaatacagggcatttacatccaaactctaatttacatatgcttatgaaatataaaagagaacagcaagaaaatctgacagtaatataagatttgacccgaagaaacacaatcttattttcagtgagtaagctctaccatgtatagaggaatttaaaaatagccatttgcagatatattgaattatctgtcatctaataataataataacaacaaattcatcattagtgatgactagtgagtgtcattcaaggaaagatagcttgacattcaaatgttctacaacatgccacggattttttcttttaagagacaaggtcttttgaaaagtgtctgttcgtgtcctttgcccactttttaatagggttcttttttttttcttgtaaatttgtttaagttccttatagaccctggatattagacccttgttggatgcatagtttgcagaaattttctcccattctgtagtttgtctgtttactctattgatagtttcttttgctgtgaagaagctctttagttttattagatcccatttgtcaatttttgcttttgttgtaaatgcttttggcatctttgtcatgaaatatttgcctgtgcctatgtcccggaatggtatacatgcagccagcaattgtattaaaaaaagctttaacatcactgatcattagagaaacacaaaaatcaaaaccacagtgagataccatcttacaccagtcagaatggctattattaagaagtccaaaaaatagcagatgcaggcaaggttgtggataaaaaggaatgcttatacactgttggtggaagtgtaaattagttcaaccattgtggaagacagagtggcaattcctcaaagacctaaagacagaaataccatttgactcagcaaccccattactgtgtatatacccaaaggaatataaatcatactattataaagacacatgcacacgtatgttcattgcagctattcacaatagcaaagacatataatcaacttaaatgcccatcagtgatagactggctaaagaaaatgtgatgcatataaccacggaataccatgcagccataaaaaagaatgagattgtgttatttgcagggagatggatagagctggaggccattattcttagcatactaaggcatgaacagaaaactaaatactgcatgttctcacttataagtaggagctaaatgatgagattacatgaacacatagaggggaacaacacacaatggggcttttcagagggttgagggtgggaggagggagaagatcaggaaaaataactaatggatgctagacttaaaatccgggtgatgaaataatctgtaaaacaaacccctgtgacacaagtttagctgtgtaacaaacctacacttgtacccctgaacttcaaataaaaagtaataataataaaaagagatggggttttactgtgcactatgttgctcactcaggctagtctctaactcctgggcttaagcaatccttctcctttagcctccagagcagctggaactataggcatgtattatcatgatcccatggtaaaattttgtggagtgagattgggaagtaagttaatttgagaaaagaaacttcataaaagtgacatgtttggaaaaaaattataaaaaaagatagaggagcaaaaggaacataaatttaaaattcttcattgggctcctaatattcctttttgaaatacattttactgagcacatacttttatgtgcaaggtgctgttctaggcattaaaggatataatagcgacccaaactgacaataatccatcccatcaaggaatttgcattctagtgatttgtacttcctattatcaaaggcatatcatcagtgcttcagatatgtataaagaatgggagagtggggagtaaggtggaagataaagagaaagaggatagaacaggaagcagtgaagggtggaaaaattgtgaaacagaagtagattaatttctggggctatgtctgttgtgaaacctcctctgactccacttctacctgaggtatcctctcatgtaccctagtaggtttgtctgttttcacctcggcattcatcatcccactcttttccccgtgtgttttcttgtctttctccccagttgactctgatctactgagtcgttgatctttgtatcacagagtcaatcatggtgcctggcacacagtagatgctctaatctatattatttgttcaacaaatagtaattgcaattatctgacaaagtattcagttattatggagaaatatgcatctatgtatttgaccatctgcattacactggaaacggaaatggacttttttattgatacataatttccctttgaatttttgaagaccaaaataccagtggcagagagaagagatggtgtgagggagaggattttagctgccctacttccctcatataaatgtctatcagctcttcctcaatcacacacacacacacacacacacacacacacacacaagttgtattaaaatacaatatgaaattagcttcaaaagagtttcataggactttcttccaatcagatttccattctaacacagtcgttccagagctgataccatccaattactatccatttgaaataatttcaaatcttaggaacaccttaatatatcttttaattatttaataattttataaaaacacaatatgcaaaacaaaagtccaacctgaacctcttactttgtgggccttactggactaagggaaatccataactttgatgattgcaggtaaaggtatacttgaattagtgtctggagaactctcccacctcctcaagtttccatggcagtacagttttaagttctctctcaaccctgtgcagaagatccgggatgtgggagtaaaagggtgagcatcagtgtgtgcttagttcagttaaaattaaattccaagagttccctagagcacttttatatcagcttgacccaacattacctctggtatttgcttcagcaaatcatttaaaacacataactgttgtctttgttttcaagtttatagtcagagtggtttgaaaactcttggcgcctaacataaaagccagaaataaatacggaacatattaacactgaatataggttgcgatgaatcacagtttgtcagctttcaagtattacaattatctacctaaaaataccctactgtactcagtcaccctccctagctgtttaccctgctcgtcactgtaacttctaatgctgttacacgtttgtttttaggttgtaatgttagcagccctcaatattttatacttaacagttatcttttaattaccatatgtttatcttttgagataaatacagtagttcactaatcacactaattgtaggtgggcattgctagcattactgagatttatagattagtcattgtgggaaggaaggggaatcaatattagcgggattatattagtgctggctaattgaagaggaaaaaaggttaatgcagactttgatcttggactcagtctcctaggaataactctcaaatgacaccaaattcctgctgtttaatattaaatatctgaagcacacctgtgcgattattggagcgctctgccattattatgtttatttataaatgcccctgaattgtatttgtagaaaaaccaccttttcttctagaattaatgtgtatttgtgttcatgtgtgcatgtatgttcacctgtaacaatagaggtgagataaaattcagaattaaaaccctaaaattgaactatttttaacattgagaccagtgataaagtaagcaagttgaataaaaagacaaattaagtaagtgcagtttgagtggggaaaaaatatacagagagaaagcatcatcctaaggtagccagatggatcggtttccttggagctttccttgcagttctgagtgagacaaaaattaacctaaagaattaaccctttcctctcacttctcagaatactaagttaggtgttatattgaaaactcttgaattcaaacagagatgaagagtcaatattttatcaagtcatatggattgatgaggcaaaaggatttcctttccaccccatatctcattctgtaagcaagacaagataatttatgtatcaattaatagtatgtcagacacaatcttacctgatttaagtgttatgaagaatttttctgatgccatatattttcacatatgtgttgttttcattttgataagaaaaaaacaaaaaatttataatcacataattaaaatctgttaaaaatgttttaaaaagcatagggttttcttaagcaaatgtggtttggtgtagatgtggtagctgggcaaattaaaggaacaaaatagcttgttcttgcttttataaatattttccctctggcccgtttgctgttggcctctcttcctatttattgctctgtctgtcctgtctggactcagacccatcctgatatgctcttaaaaatatgtacaaatacgagttgtaactgagggctgcaggaactggctggactttctcctgtgctgtcaaagccatgactaaaagtttaaagtagattctgcgaacacaatttcaaaatctccctctcatgatttctgctgttctctctaaaatattatggacatagaaattttcctgaagtaatctttcaccgggagcaccaaagaatcacaactgaaagtatgaactattgaaaaattaatcatggctgtttatgctggaagctgaccaggtaacttctccagttcatatctcagaaagaaaatactgagaaatcccagtgactgtcctttgggcgctgatagaacacagttttaagcttgaagaaaaggaaggtgtgggccgggcgcggtggctcacgcctgtaatcccagcactttgggaagccgaggcgggcggatcacgaggtcaggagatcgagaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaagaaaagaaaaggaaggtgtgagggatggttataagggactgatgactgtaaagtacgagtaaaagggttctgcacctgtggattagttaaccagctgcctccctacaccacctaaagcaaaactaatcaacaaaaaaccaataaaatgcccacacaaagcagaatgtttagttcagttcttccctttggaaatagtaatttagaacaatgaacagtgttatcttgagaaagaaaataaagcttcctctatggaacatgccctagatttttgtgtttttatgttggaattaagcacacaaatagctgagtttagagaatgatctggtagatgagaggagtcttagaagattgtttttggctttggggaataaaatgccttctggtgactactctttatccagtgccgcatccgttttgtaaaactgattctgaataaggaatctctgtaaagcccacttttgctaaagggggttgtgtgtacagtagaattagaagtcactccccacgtccttttacagttctcttaaccatcagctgaacagtggtgtagtcaaatggctgacagtcagggaagactaaagtattagctttctatcactgtccagttctgctgtaaaactctgggaatctggaggagcttgagaagaggcatcactctctggcttacctctttggtctcaccagctgatggtcggtgctttccttttagccagtgtaactattggcttttctgcttcaacttacctgtgtaggcttaacagaggcaagcacttttcagagtcaaactaatggggaacagtgtcttagtccattttctgctgttatgccagattgccacagaataggtaatttataaagaatagaaatgtatttggcttatagttctgtagatggaaattttttttaatttaattaattgattttttgaggtagagtcttactgtgtcacccaggctagagtgcactggtgcaatcacagctcactgtggcctcaacctcccaggctcaagcgattctcccaccttagaatcctgagtaactgaaaccacaggtgcacgcccagctaatttttgtattttttatagagacagggttttgcaacgtttcccaggctggtttcaaactcctgggctcaagcagtctgccttcctgggcctcccaaagtgctgggattacagtgatgaaccaccacacctggccagaggtgggaattttaagattaagggccacagctggtgagggtctttttgctgcatcataacatgacagaaggcatcacatggtgagagagggtgagagtacatgagacagagagggaaaatgggggctgaactcctgtgataatggcatcagtccattcatgaggacagagcctaatcacctcttaaaggtcccacctcttaatattgtttcaatgtcagttatatttcaacataaattatgaagaggacagttaaatcatagaattctaccctgggtcccctaaactcatgtacttctcacatacaaaatatattcattccattccattagcctctagaatcttaactcattccagcttcaactctaaagtccaaaatccggagtctcatctgaataaaataggggtgagactcaaggcatgattcgtcctgaggcaaatttcctctagctgtgaaatcagacatgttgtctacttccaaaatacaatggtgagacagccacaggataaacattctcattccaaaagggagatacaggcaagaataaaggagtaactggtcccaagtaagtcgaaaacccaagagtgtaaacaaaatttagtcttaaagctggagaataatctcctttgactccatgtcccacatccaggtcacactgagggggtaggttggagttgtgcctgcagtcttcccatgctagagttgcatgctggtggtggatgtactgttctagggtctctgaggtggccttgctttcatggctccactaaacattgcccttgtggggactctgtggcagctctgacttcacatgtgcacttggcattgccctagtaggggctctctgtcatggcctcaccccacaatagtttctgtccatgacattctttgacgtctatgtagacaacactatgcctacacaactgttgcattctgcatgcctgaaaaattagcaccacatggattccgttcatgtttatggcttgtatcttccagagtggcaggtcaagccacacctggacatgcatgagctgtggctggagtggccacagagcactgtgccagaattcagggagcagaaacctgaggtggctctggggagtgaacatggtgggtacgctgggcccaccccctgaaacattcctgccttcctacagctctggacctgtgatgggaggggcaaccttgaatgtctctgaaatgcttttagggtctttctcctattgtcttttgaaggcatagtacctggcttccttttatctatacttatctctatatcaaacagtcctttgatcacaccctcggtttgctctcctaaaaaacatcttttcactctttacatggtcaggctgtgaattttccaaatcttttcattctacttccttttaagttataaattctgtctttaagtcatttctttcctctcacatctcactgtatgcagttaaaagaagccacccagcagcctgaatgctgaatgttttgctgtttaggtatttcttctatcagatatcctaatttatctctcttaaattatgcactccataaattcctaggatgtggacacagttatgccaaattctttgcaactatataacaaagatggcctttactccagtttccaatatcttgttccttagtaccatctgcgatgtcataagaatggcctttgctttccatacttctatcaacattctgatcactcaagtaatctttaagaagttctagacttttcctacagctctcctctcctaagctctaaccaggatcaatcttcatgctctactcctggcaatacaggcttttggtagcccacttctccagtttcttccaatctgtacacatgaccctgttccaaagctgcttccacattttcagatatttgttatagcaacaagccctcttccagtaccaattttctcttttactctgttttctgcagctattacagactatcacagactagataatttattaaaaatagaggtatatttgcctcacaattctggaggctgggaatttcaagatggaggggctgcatctggttaagggccttcctgctgcaacttaacactgtggaaggcaacaaatggtagagaaagtgagagtgcaagagacaaagagggataaaggggaccaaactccattataattgatctaatttattcatgaaggcagagctttcatgacctaataaccgcttaaagtttccacctcttaatactgttacaatggcagttaagttaccatatgagttttggaggagacattcaaacagtggttaatattactaactctaatttggcctcctgagataaataactcaatttgaaataaccaaatagtggtaaatggagctactgggcctggagttaaatacctgctctgttactaagtatctgtgtgaacttagacaaattaataaagttctctgatttttaatttccttatctgaatgatgataatcaccatattcacctcactgtgttgctatgaacattaaataagaccattgtcatgaaggatggtgtctgttccttaataactactcaagttataatgatcattcttattaggaattacagtggtgtttggggctatgggatggcattttaactgagattctggaattctttcttccaatcacatccatatttctgttcttgctcctttcacaagcattactatagtagcatatatccaaagatgaaataaaatattactgtactatcagctggcagaatttttcaaaatcacactggaaattctgctaaacacagggttcacacatggagtccagcaaaaatctaaactctctgcaaaaatttaaaccttaggatattactatatcaatatggttgcatggatggaagagtgaagaagaatgctgaactaccaatctcatggaatgggtcaaagagagtgcttttaaaagcacagtaaacttgcccacaagtaaagtgtggtctgtcaaagaaaaatgtactgtgcagagttaaatgggcaaggaagactttattcaagactattgcaataagggttaaaactattgcaataggggagagagattgaactgaattctgctaaaacaaaatgcagaaggattttcaagtgctagggtgagctcatggaaaagtaatggaagatttggcgaggtaagttggccaatgggattaggccatctgtgtttgataattggcacttaatggaagttaggtttccccattccacagagaagggagttaggggcactatcttctgttaagattacatttcaaagggatggctcccaggtccttgaaaaaagacatgttagggttgtgaaactggcaagaggctcagaagatttatgtctcaaaagggctgagaaaaagtttataattgcaaggtttttttttaagtaaatgctttgagaaatgggaagtcagggtctcatagtcaggaagaaacttgtcgaaaatttagtcaagttgaggagaaccttaaggctggcttgttcaggtctatgattttgacaaatataattcctttttccttatatcatgatgtatcaatgtagttttttttcacccgggcatatttagttcagtactcaccgaataaacctatgtaattgtccatttatcctttttatgaataaatatgtttttctaattataaaaataatttttattgtataaaagtattgtacctaaactaagagaaagaaaataaaatttacccactacttaaagataattactgtttgcattctgttggatttatctatcccatcttttgctagttatacacatttgttttacaaaagtggcaatcataattggaatatccattatcacctgcctttttacatagaagtgtgttataaatattgttctgttattgtttcacattccatgttttatttacatttctttacttgtccctcatttttgatgattgatgtagcaatttgattttattttttgctgtggtctaatatgcagggttttcttccccttcttatgccatcttctgagttctctcatcctttcttctgtttcttgctgcacagaagtcagccctttcctccacaatatctccagctggtggagctagccttttgctccatattatgtctgctttgaatctacttgtcacattcctacttactgcttctctgcccagattcttctgagtaaaacttggcttgaattgtctgcttggttttcgtgggacattatctttcagaactcatacattacagcttttgaccaggtgctacaccaatccagggcaagcctaggcttcgtgatctggaatagggggtccaggaccatacaggaaattaacagtcacttcccatcagtactcttctaatttgatgccagttttacaagactgtcttttctgccagttgacagcttgcctttgaaagaacaaatccttggtagatgtaggtgtaggcactgattggtcaaattatcttctttccctttctttctgggttttctagtactatgctttagaatgttgaggagtgacagtatgcaccaccatggtgccagagtggagactgagagcactttcttttattctgcagatcttcatggaattccttgtcacggccttaaacatagcatatggcaatcattgactccgtgtgtaaggccagtataggtaactccataactgctaaaactgagtcaggcaactaattctatgttcattgctgtgccattaatataagaattaaaaatgaactgcttaaatcctcccttgactagactccatagagaggaatcatttaggttgtaaatgacacctaaaattgatcactctaaatttagttaaatatttttagtagaggtcattttccttggtttatatagatattatacatatattctggcaattggaattttttatttggatgtcaaaatattcaaacatgtatagtaaaatactttgttatttttccacagcatattttatgtacattatatattatggttatagttttatgctacgtttaattgtaacatttgttaagcaacacagagatacaggtagctcttttagattcctggagggttttttgtttgttttttaaaaatgtataacctgttactatattatcagaagttacctggtattttgtaaagagatatcaaaagtgacaaaaaaattagctttgaatcaagaataaaaaaagaatatcacatataaaaattagatgcttataaattataattttttctgaatctctgaatatatgtgtttatccatggacaatttatctaaacatgcactaattttgagcactacttttaagtgaaaaatgtgtacaaatattaaatgtaaatttatataaatattaaaactaaccataagtatttaacgacttgtgctttaaaaagggaaaatgagtactaaaagggaaagacatgtattaagataagatgtaagtcaaaatatattataacttgtattttaaagagtcaagataccgtccagtttatttgaatatgttctcacataccatggttactactaaaatagtactggcatgtctttatgaaaagaaagaaaaaatatttttacctaccactgagttgtaaataattaattttcatttgtagcttgaactatttttaggtgacattgtaccctcaaattttaactataattttctaatttggttaccataatttctgactatgcttagctatttgaaacccattatactggtgatcaatcagaacaagattcctttgggaacaatttgttgatttctgttaattttaaggttgtctaggagggatgactttatatataatttcccactggattatcccaaacactttttgcccaaagactcatcattctgagtgggttagaatttgtgatttctgtgaaaaaatgttcaacatggatgaggaaccagtcactctttgagaaggacaaactttcctctttaatttgttgaatttttacctgtgcttaaatttagcactgctttaataatcagtaattctaatgatgcagtgattctgtacacatcaaaggaccggctgttagtgtgaatgcagcataatgcaagctggttactaaagggcagttaatatataataatataggcaataagcattttttcctttcaaaagcagcagttaattattataaatgtcaaaattgtagctgtcatagttattttgcttccaaatcatttcagcgtatcagctttccgatggcgtattcgaacactaaagttatgatccattctttgagtggaagccctcacatgtaaaattgccaatccaaagtctttaatggcttcagtctattaagtgataggaacttacaaactgataaacttaagttattctaatattattcaacagatacaaattgtttagttagaaattttaacgtgtaatataggaaatcaaattcctttaaaactttttaattaatcatttttacttaattttcttgaaacatatcatgcctacataaaatataatgcctaaaatagatgatgcctgtcaaactctttaaacattacatctattacttggtaaaatactattatggttaatgtaaaatctaagatgaattaggtattattttcatcttcataatgcgtcttattacaaaaattaactaatgagatgtttagtatttaaaaataggctacatacatgtatgtgattctgtattgcttaagacttgtaagtgaatgctgtgtgcataattttgagaagattgttagaaaatagatgtataagcatagaattgtgtagagaagaagaggcacccctttctcttgaggttgtagcctcctacctggggcacagtgttgggagtggaggacaagccggcacttgtcggggcataacgtgcaaccattctgggaagctttgcttaactctgatgtgagagagggattgaaggctatgttgaggaagatggagtaatattagaaaatgtacagttggtgtgaagtgggtgttagagagaagagaaagggaagttgccatcctggtgtgaggcagaaaagtagtgagaccattgagaagtgagagaaaataatgggaaataaggctggagaatttttatgaaaaacaggctaaagatttcataacattatcaataaaatccatttgtaacattggtgtgtggactttatctcgtgatctacatagaaatcatgtgagatgtcggccgaagagtactcaactaaaatattacaatgtatgcactggcattcagatcatacattgatatttatctagattatagaaaaagctcttttttgacaatgtaccactgactttcaatgaattatttagacattgcgttgttatcttaaaggtagtaacaggggtctagatagtaacagaggtggtaaagggaagggtcctgcagatttggccccatacagaaaagtataacatctatgttttcctgagttactatgtgcaaactttcaagacctctatctaaattatctcctgtactagtagggttctagtaggaaagagatggcatggaaaaagtggtaatttggacagagtttaataaaaagactagctacaaaaatgtgggcagcacttacgacaagcagcaaaagatggtgaagtaattcagagccagtaacagcagaggactgtgcctccccagtcctgaaagaataaggagaaagaattctgaaagacagaaagacagctatggggaaaaaaagagatattgagggttgcagctctcagtaaagggacacagcactggagggacatacacatggatatgatctaaaaggcagggtgctgtggggataaatacctcatccagctcactcttcaccttctagtttgcctgtgtgtccctttcattggcaagaccaatccagagctagagggaaggaattctattgacagtacaaataaataagcctcccaggcctcagagtattgaatacatgaacacaataaagatcatgtatgacaagcccatagctaacatcatactcaccagtgaaaagttgaaaccttttttcctaagatcagaaacaagacaaggatgcccactcacaccacttctattcaacataatactggatgccctagccagagcaattaagcaaaagaaagaaagaaaaggtatccaaattggaaaggaagaagttaaattgtctttgtttgcagatgatgtaatcttttttttttttttggagatggagtttcactcttgtcgcccaggctggagtgcagtggcatgatctcaactcactgcaacctccgcttcctgggttcaagcgattctcctgcctcagcctcccaagtagctgagattacaggtacctgccactacgctcagctaatttttgtattttttagtggagatggggtttcagaaaaccttaaatattccaccaaaaaactgtttgaactgatgaatgaattgagtagagttacctgatacaaaagcaaaatccaaaagagaaatcaagaaaataatccgatctacacttgcttcaaaaaataaaataaaatactgtggaataaatttaaccaagaaggtgaaagatctatacacttaaaattataaagcattaatctatgaaattgaagaaaacacaaataaatggaaagatacctgtgttcatgggttggaatgatttacagattcaatgcaatccctatcaaaattccaatgacattttttaagtaaacagaaaaatacaattctaaaatccatatgaaaccacaaaagaccctgactagccaaagcaatcttgaacaagaagaacaaagctggggccatcacactatctaatttgaaaatttaccacaaaactgtagtaatcaaaacagcatagtgctggcataaaaacaaacatgtagatcaatggaacagaataaagagcatggaaataaattcatgcatttatggtcaatttgtctttgacaaagatgctaagaacacacaatggggaaaaggcagtttcttcaataaatggtgctgggaaacctagatatccacttgaagaagaaagaaattaaaccctcatttcacaccatatacaaaaatcaactcaaaatgaattaaacacttaaatgtaagacctgaaactctaaaactattacaagaaaaacttagaggaaaagctctgtgacattggcctgggaaaataatttttgggtatgaccccaaaagtataggcaacgaaagcaaaaaaaaaatagacaagtgggatgatatcaagctaaaaatcttctgcacagccaagagaacaataaacagaatgaggagacaacctagggttttagagaatatatttgcaaaatgtacatctgataagaggttagtatccaaaacacaaaaggaactcaaacaactcagtagcaaaaagataaataacctgattaaaaaatggacaaaagacctaaacaaacatttctcaaaagaagacataccactggccatcggatatgtgaaaaagtgctcaacatcactaattctcagaaaaatgcaaattaaaaccacagtgagatatcactttacaccgttaaaatggctaatataaaaaagatgaatggtaacaagtgttggcaaggatatagagaaaagggaacccttttctctccagcaatgccactattggatatatatatccaaaaaatatgaaatcagtttggtgaatatatatctgtactcccatgttcattgaaacattattcacaatagccaagatatagaatcaacctctgtacatgaacagatcaatggataaagaaaaagtggtatatatacataatggaatactgttcaaccttataaaagaaaatcctgtcatttttgacaacatagttcaacctaaagaacattatgctaattgaaataagccaggtacaaaaagacaaataccgcatgatttcacttatatgtggagtgtaaaagtcaaactcagaaacaaagaataaaatggtgattatcagaagttggggtgagtgagaggattggggagatgttggtcaaatgacataacatttcatttagataggagcaataagtttaagagatttatattacatcatgatggctgccgttaataacaatatattgtataatttaatattgctaaaagtagattttaaatgttcttgccacaagaaaacaataagtattttaggaaaggcatatagtttagccactgcatagtgtatacatatatgaaatatgttacaaaccataaacatgtacaatttatacttgtcaattaaaaataaaattaacaaaatacaaacatatacatacacatatatattatatatgaatgtactatatatcatagtagatatgtttgtacaggcactctaaatttcttagcagacaggcattatatttcataactagttttagtttaacaagtacctagcacactaatctctcattaaattcttactaaataattataggtgaatatattcaaggtggataaatgaatgtgttcaagatactgaagtaatgggattaatttcatgagacatcaattgaaatcaatattattagcaaagagtcacaggttgtgtatcttatacaccatacagtgaaaatattcatttagttcatttctccagcatccatcaaacaggcctcatacatattactaaatgctgaggatatcagatgagttgttctgatcattagtgttgttcatcagatatttttggttttctttcttctgtgcacttgctaggattatgcttctccaatctcttaaattaggcatgatcatgcaacttactctgaccaacaaaatataaaaataagtaacattgaatatttcttaatagaagcacttaggaggcagtgttcagtttgccacctttctctcccttttgccctggcaatttatgatgacactaattgtaaagccttcttgaatgtgaacagtatagaacagagcccctgcctacctgacatggcacatgctacatggctttctgatgatacacaatttctcctctgtaaattagagacaataagaccaacctcataaagatgttgtgaagatttaatgctcttaacaaagtgattggcacataatgagtgtgaaaaacatgatttttataattattactagtaatactacataggccataataatttcattgatggagaggataataggttgggcactggggatgggcacagctaacctagaggagaaggcaggaaagaacactacaggctgaagtgacctgcgaactcctctgggctgtcagaacagggatgccctggggaagtgtaaagattctgtaatgctgacctttccaattcatatccccttatgttttcagtctttaaagattaaggagaatctaagtttactcatcaaacctataaatagagtgagggcataagctaattcaggcctgcaaagcagaggcaagggacaattagcagggcttcaagtacaaccatcatatgtaaaggctgccttgtccctggtgattaaagtacatttcaaactctgctgaatacctttttgtagtatgagaatttgtccatctaagtgcttatgggtgtatttttatgcctttcaatgcaatatgctagtgcagattcaggatatattgaaataggaatgaaagaatgaacataacttgcaactctgatctcagtaccctatattaggatgtataatttttggggacatcacctcctaaattcctggttctgggcatagcaagttaacaagaaaggtcctctaaattatatgattatctttttctcttctttctccaacaatggggagaaaaaagagtgagagagaacaactgctctattcgccatgcatcattaaatacattttttgcaagcaaccaccaattttcttttacacactgaagtaggctatgactgaggctatagaccacctcagataatgtttcaaatttgtcacttgttttgtgggcaaagtcgcccctctaaacttcagttttctcacctgaaaatgaagaataagtataccctcttcacagacatataggaaaaatgaaatgagctagccatgctgataatctccgtaaatgttaaacttacttaactcaaatggctatgagttgtcaagtcatcatgtggtattacatacagtgtttaattataagatctccatttaacagtcaaggacagagtaactggaattcttttacactgctggcaaaaatctaaaatgttatagccattttggagaacagtttgacagtttcttataaattaacatacacttgccatatgatccaacagttccactcctaggtatttactagggagaaatgaaaatatatgccttcacaaagacatggcttcaatattcataacaggtttattcataatagacaaaagctagacacaataaaatggccatcacctggtaaatgaataaacaagtcatggtaaatccataaggtagagcactactcacaaagaaaaaggaaccaactactgatacatgcaaatgcaaataaatctcaaaaaattatgctaagtgaaagaagtcagacaaaaaactacatattagattatttcatttacttgacactctagaaagggcaacattatagagatgaaacagacatcattgattatcatggggtctaatgaggaaaggggaaggaggttgactacaagagatagtagagaagtcttttgggtgatacaagtgttcttgtttttactatggtgatggctacaggactgtgtatatttgttaaagcatctctaaccgtacacttaaaacaggtgaattttattgtatagattttaccttaatctgaaaaaaaaagcagttataatggaaacctctaggtagtaagaacaccagaaactagtcaagaattgcaacccagaaaataattccagaaaggagaaaaccagaacttggatattgagtgtttagcctccctgttcacagtagtagacactggacatttgagcctatcattaggatttggtgatagcaaactaagtcaagatgtgaattaaaagaacaacctttaggaaaccttcagttgcaaagctattagaataattttggaagtttcttctctaatttctgtatgtgtgtctgagaactaagatttgtccaaacatttcaagatttatttttaaaatagcttgtttccctccagaaacatttttttccgactgaggcagcttctacctttacagctagtttttaagtattatggtctgatgcatttttttccaaagtgaagaaataacatgactttctttttaaattgaaaaaaaggaaaactcaaaaggaagaatgcctgaagcatggcttttgtgcatgctggtttttcttatttacgtattttattgggctgccttgacaaagaaagccagcattttaagatgttataacattttagatgagaagacatatactgttaaatagctgtaaatcttggcatttaaattctttcttaaaatcagcatgcaaacatcaaatacactaatggtcagtccaaagttgtaaaattggaagacgtgataaatcaaaataagcacatatggaggttaagatgctgtttttatacttttttcccttttcttacctatgatggactgttcagattatgtttcctttagtggatggataacatggtaaatgaagacttgttttctttaattatttttctacctaaagcttgtatcaacttcaacttggttagctctttattgcgggaggttttgttttgttttttcttgttttcagaatcacctgatgctgacaacattgccatcactgtattaataatgacgacattcactcaactacattcttacattcaaccaaaaattttggagtgcctttctaatgtaacatttcaagtagagtaaaagaccattttttccacttttctttttctttttttttttttttgtgtgtgtgtgtgtgtgacagagtctccactctgtcacccaggcaggagtgcagtgatgcagtcatggctcactgcagccttgaccttctgggctcaaaggatcctcctgcctcagcctcctaagtagctaggtaggaccacagttgtgcaccaccacgcttagctaatttttttttttttttttaatagtgacagggtctttctgtgttgcccaagctggtctcgaactgttgggctcaagccatcccctgcctcaaatcccagcactctcccaaagtgctgggattataggcgtgagccaccatgcttggcctgtttacctaaagttttctactcagtcatgtggtaaaccaagcctcgaactcaagtcttttgactccttgccctgttgccctaccacacttgcctttctttataagataatatccctgctccctagtaaggtgaaaattggacaattgaatgtggatgtgaggttgtcatgctttctccacccaggtctcatggaatgaagtcagatgaagtgttaaaagacagtccagattggtggccctatgacagttccatcatgcatgggcaggcctgaccctgacttacaatgtctaatgtacagtgttatgtactcttaggtggagttgttgggaaacctacgtgggattatttatggaaccctaggaaaagccttgtgaatctccagcttacctcccactgctcccacttcccaccatcactctatgccaaaattctctagtaactctgtcatttgggtgaatgtatcaaagtgacctgctaaatatagtcattatctatattgaaaaaaaagttccagtatgtttattcagttgttcagcaaatatatattgagcacctattatgtgccagacaattttctaggaactagagatatagtaatgaataaaacaaagtcctgtctatcacagagactctaatcattctcattgatactactacaaattcacttctgaaatcgggaaattcgtgaggcccttgggaatctatattgaatgaggtaagtagctgatggaggaaggtggtgtcccctcagagagcagccctagggcaggttcctactgcgaaacaccaggaaaactggaacttgggcatcatgagaatatgctaggaagtttggatctgcaatgggaggaaacgtcttttttgaaatcacatagctggatatccccacagggctaagtaatgattctggagcagagaggagaaatatgaatctcagggcacagcgtttatttctcaggtggtctgtgggacagctggagggtccctgctgatctcagctggggttactcatgcttcctcaggttggctgggtggaagtcacctatgctaggcttggcaagtcctggccttcaagctgcagattgggctcagatttgttccatgtgtttcaggtttgtctcacagtaatggcagtcaagaaggcaagctccaatgcagaagcgcatctttttttttttttttcattttattttttgagacagagtctcactttgtcacccaggctggactgcattggtgcgatctcggctcacttcaacctctgcctcctgggttcaagcgattatccttcctcagcctcccaaggagctggaattaacaggtgcacaccaccacacccagctaatgttttatatttttagtagagactggttttccctatgttagccaggctggtcttgaactcctgacctcaagccatccacccgcgttaacttcccaaagttctggaattacaggtgtgagccacctcgcccggtcaaggagcacatcttaagccctttcttgtgttatttgctaacatcccattgtccaaggcaagtcacatggcaaggcccagttcacatggtgggaaataaatacaccttggctactgtgagtttaaagcaaatggcatagctaaacttggtaacaaagaagtgggacggtggggtggaggtaaaaatgagtcaatatttttgaacaatactttaagcaggggggaaaaagcattaagtgtagagaagtagatccattgatgtaaattgtttttgaaagcatgttaacattctgacttatttctcattatttttccattatttcatatcctcccattaccactgtactttccctttcagaattagtttctttcctaaatataaaaacatacttacctattagaataacagtacattgaaatagcttaatttagtgacttccagctgactctccaggattctcaaaccacttagggctgagttttcaatgaggaagaaagccaaagcaaatgcacctgctcttctgttgagaccactgagttgcaacagctctaataaggatgcgagaattacagctctgagactattttcatgcttctccccagccaaacagactgaattaaaggactgttgctttttacctttagggtcttaaactatctatgcctttagaagagttaaacagggttagaacatagtgatggacaacttccacttatttatctaatttttaaagtaataggagtagatgagactttcatgacttttttttgcctttttaggtatgtttctaattaaaataatttttaaagcctttggtatgagatgttgctgttagaaactgcagctaatgcccatgatttgttagaaaataaatgtccttttccttatcgtaagatatatgatataagacatattttggttctacagagaatgtagataaagcctttcaaaatatcaattttaggattttcccagcaataaatcttagtataatcttaagtaatattttctgagaaatactgaatgcaaatttacctctcaaatcatctacataacaggtaatgcttttttaagatacagtagcatggtttggacttttcctgaactctgctttaaagctcctttaagattttcatgtatatgaaacaattcatcttgatgcaaaattttcctacataaacctgtttcttagctttaactgtatttacatttatccttctgattccaacatggtaaaaagaagtaaattattttctttgaaaaagtgtattaattatttgacttccgtagttgtttattggagtgattgctttccaaagcacattaaattatattctactggcatgaaggatgacatatccttaaattagtagaattttgacgttttttagtctattagtaatttttcttttttttttttacttctttattgagatataacttacgtaaagtaaaatccacagatctgaagttcttagtctgatgagtgttcacagttgcatcagctgtgttaccacaactcaaaccaagctataaaacatcacaataccactcctcagcacacacacacacacacacacactccacacacacacacacacacacacctagaggtgactactttctgattcttgtcatcattgattactttttacctattcttaggctttataaaaattgaattatatagtaagaactcttgtgtctggcttctttgctctaaaaatatttgaaatacatccatatcattgcatgtgttaaaaatatattttattctatgaatatgccatgattttttttagttagttattctattgatggacacctagattatcactaattttaagctattatgaataagactactatgaatattctatggacattttttttttgtgagacagagtctcgctctgtcatccaggctggagtgcggtggcatgatctcagctcactgcaacctctgcctcccaggttcaagcgattctcctgcctcagcctcctgggtagctgggattacaggtgccagccatcatgcctggctaacttttgtatttttagtagaaacggggtttcaccatcttggccagggtggtctcgaactcctgacctcaggtgatcctcccatctcagcctcccaaactgctgggattacaggcatgagccaccgtgcccaacttatgaacattctggtacaaatcattttgtagacctatatttttatttctcttgggtaaatattgagaaatcaattcctaagtcataggataggttgctttgttactgatttatagtaattctttatgtattctggattcaagtcctatctgtgtacatatatgtaatgtatatgtatatgtacatatgcacctaattatatgtaatgtatatttaagatatgtaatgcaaatatttcctctgagtctaggagtgcatatttttaattttaatagtgtctttggggaaaattgttaagattttgataaagtttagtatttaaatttttattgttagggaaagatcagtaattcttaactacttagtgtcaaaactaaaagattacttctaaagtaagggggttattttgagttacatagcaacaaactatgggtgatttgaattgataaagacagtgtcacgtttactgtttcttgccaatgttttaattggctaatttactacttaatgttatatataagaggaaaaggtagaaaagtttttcaatgaggtaattatgtagtattagagacaatgtctcacaaaatttctctataggtaaaagaagatatagttatttgcctaaaaaatatatatatatatgaaatgtatgtatgaacagtagaaatgtttaatctgtaatatttccactctactgttactatgacatatgtagtcttcttactgcaaggattaaattttcccacgtatctaatttagaaaatgcaaaagtactttaggattttaagattgttgtattgttaggttttaatctttctctttctttctttctttccacaattctattttgcttctctcgacaggatttcacataaagccttaacataatataagttgaaacttacaaccaagaaaaaattgatattattaacatgtttactatgtaaacagagttattatagtaaactttaagttttgctctgagcttcctttgatccctgaccaaaacaaatcatgataaacatttgtaatataagaggaatatcacttttcttggtgttagattttgaaaaaattaatgtggagtttattagaatggaatcaaactgatgcagtagtcagtgacttcaccactattttacagtaaagacaggaaccgacttcatacagctatttcttgtatcgacctctcataaaagctgagggtataacattaaaatggagttcatggaaagctcttttatgaccgactatgataacgtggtccaagttatggagtcctcttgtggtttagcttcctctaaggaaaggactcgtttcatctcgttgcgcgaatgaatggctcattcttcaacagcagttcccaaacacctgcttgaacacattagagtcacccaggagagctaataatgtgaaaatttctgagcccaaatcccagctctgtaggtctgagctgggacccaaagaagtctttgctttaaaagcttctttagatatttctgatatatagccaggtttggaagccattcatagataatttgccctgaatttcatttctgtccgttggcctttgtatatggcctggttattagagaagtttgtaaaatctgcatttgtattggacctagagtaaaaatattgcacaacaaagggagtcaacttttaagaaagttattaaccaaaaacttctctagagtaattaggtctctggaatatatgcctagtgagagatagttgatggactggtgaaaaacagaagtgaagagaggataaaggggaaacaggaccactgaatttaaatttatgcagagatggtcttttagaaaagcagcaaacttactctatgcagcttttcaagagcaaagttataggagtgatgtgtgaaagttacataaaggcagatttcagtaaacatttttaaaataatattccaatagtaaggaatttttaacaatagagttgctatcccaaggctgatgaattctctgtagttttaggtttgcctgcagtagaagcatgaatgctaatgaacaagttaatgactttgacaaaagtggtgacaaatttcagtcttagagtttgaaaccctctgatgtttttctatgtacatgaatctataaataagtacatgcaaagtaaataccagggttaattagaactctggaagtgacacactgaagagcaaggtgaatattagttatatgtgataatataattaaaattattttacaaccctcaagaacactaaatgacatgacagtgtatagacatattaaaagtataataaactaaatttttagccgataaaataaatatattttaaatgacattttaggagaaaaagagtcagcctttattatagtattaattcaagattcctatgcttgatcttgttgtttttatctgtatttggatataattaaattttaattaaaaattaatttaagcaacttcaaggaaataaaatggtttagtaataaaataagagttgagcttgtgaatctaatgctatggcaacttatacagggcagagctgtataaaggctttatcaagatgttgttatttaaccttcttaccacatagagttgctttgaggatcaaatgagttaatgcatataaagagcttaaacgagtccctatcatagtgcttaataaatctaagttattattattgctactattattgatgaatagagtgacttgtttttggttggtgatcataacatttgtcatggtacgtggcacagagcaggtttcctgtatttgttcattgattacatccaatcactatgtaaagattcgatgtcataatcatcagggtttcccagtgaagctgtggaacacactaccatttcatatatttccaatgtagacatttcttgaactttttcccagtagttggattgttgctattaaacaaattctcttatgcctatataagaacgtgtgcttcctgaagaagttggtggtggataaatgagagtactcagtctgaaattatttctggagttcattacatttgagttttgaaaggactaaaaattaaaggaatgggagaagtggtcaggtaatttgaggtaagaaaagtaggatacggaatggagatcaaagtgacaaaatgatgttctaaaactgtgatgtagatttacctgacttaggaaataagatataataggaattgtgaatttttggtagatacagatttaatacatgacaggtaatgggaggtgaagtctggaaatgacagttcaggaataattagctcaggtgaggccataaaaatgacagccctatcaggtcaagggggaagcagatgtcttagagcatgttcacctttgtcagtgaggagtaagaaatcctgtttgctagattatcttttcaaatgccatactattcatccatttttccctaaatgtttgttcatatttccatcaatttggatgaaggggatgaaaaagttatttacaagatttatttgcttttctcattctacatgcaaaagatagacaaagaagcaatcatattccagtattaaagttgccatgtaagtgtcaaattgatttgatttcctttttttggtcatattttaggaaaaagaggcctgtgacctcttgacaaaataaagaaatattcattcacaatagaaaatgaaaggtgtatatttctcatgtggcactttaatatttttacaaaagtaaaagcccaggtaataacacattttcatatctcattggctccagtttttctctaactttctaggcaggtgaatcagttgaaaaaatagttacaattaattgaaagtagtgcctgaaatagttcattaatgcttttccaagttccattttcccattttattttagctatttaaaatccacttaaatcccaccaaggaaccattgtgggacctctcagtagatatttattcagctattgggctcccagatgagggaggaaaatgaatgctttgtggggaaaagacatacttacatacatagaagtatctaaaaacattattcaaagagctgtggttttgtgatacaaatagaaaacagaaaactcatagttgtaaaatagctctggcaattatccttacaaatggcatcaatttccccctctgctaccaaatttcatttttttatcctttttttttttaaagtgtggacaaccattatctgataactatctcttactgttttacaacgttgcaatatgggaaggggatgtgaattaaagactaatgcttacaactcgaaatattctattgtaattttgtggctcctgctacatcttgaatgataatgaaataatttatttgctcaacacaaaatacttcacagatatcaggtaattttgaaatgatgaactgtgcttctaagaagaaactatggtatttcacaaataaattttgtaatttgggtgacattatcctttttaaactcacaaagcaccagtcataatatatgatatgtgactatgtgacatgaccaaaagcatgtgggattcggagcatggttccaggcccactgtaggtgccagaaatcttagctggtattattaactgttgttttcctgttttgttgtttattgcttttcatatctaaataggtttacatttcttgacattcatcttgttttactgaatttattttttaagttaatcaagaccatttttagttatttgcttctctttgagagagttaatatacctgtttaagttgatgttattgcctactaaacaatctctcacctctctctcaatgaagtcggtgattgtttcttatgatggagagactacacacagcctggcttgggacaaagccagcaggtgagactagtggttttcaatggggcacataagttagctgtgaggggtgctggaattttttactagtagaaatggaaatactaaaagctataaacaattttatctttaagataacctatgttagttccaagattattcctgtaatactgtcattttcactttttgatcaatatgctttctttagtggaaaataaaatgactgggacttttgtttatacaactaaagcccatgatgatgtttcacacagaagcaccttctgtcatgggtcgtggaacaaaacaggctgaatctgtggatccagactatgtttcctaccttgctggaaatattagatgtccttgtagtttttctcatgtcctctctaattactgtagattgtcattcccaaattagttttctttttttaaaaaaactcactctaaatctaaaagactaacccttctaagcaggcttcagatgtgtttacctaaatattcaagtagacatgggttagtgagaaagaaagagagttagctagagttagaagcctggcagagtctgccctacccaggcctacccaagagcgcttcctgtagagaagctgggtactcaagaagaagtgaaaaaaaaattttttttttgcacccaacaagccaaagaggaaactgccaatttcttcctgcagaagacatagtgaccccactaaatagtgaaaacataactattagtgaatgataggtggaaagagagagccctctcagatgtctcccttcttccccacctctggcacaggtacaggtgggaaagaagtattgaggcaaagtttctgcctctaggaactgagttagaaatacgtgaagaggtagagaaataattttcattctctaaacctttccaaaatgaatctaatgcaggattgtcctgcatggatctttctggaagaaaatggagatggccattatggtcaaatgaaaggtgacattttgagaaataatcccttatgtgtttatttcatgtaatctgcctttacctcctcagcaactttgtttcgtcactaaactcttctcctcttctctccgtcttccccttcctcaccctaccgcttgcttccacttccccttctctcctctctttctgtatctttaacttctccctttcccatgggtaattactcacctagatttgtacccataagtaaaaaagaccatcttcccttcattataccctcttttctcagtacagctttcatctatgtttgtagcaattatcttcattttctctttattttcacatcaccctatttctcttcagcccactgcagttccacttgagcttcacctctttctccttctggagagttcaaagcatgatttcagacctcatcttatttgatacctccctctgatacactgactattgcttcctcttctagaaattccttacttctcagtggataggttttgttttgttttgttttgttttgttatgttatcatatggaatgaacaggttttcctttgcaggtttagtggcagaaaatttctggcattctaagtttttcaaaagttgtgttggatttgcaggcagcacacggtttttggagaatgaatgcaggttagtaagtagaaaataaaagcaaatgggagaatgaatatgtagggaatgatggcagatataaatccataagtaagtaaagtaagtattacattttaagaattgctgaatggagaaataaactgattgtgttaacagaaaataatagcttgagtaaaaagaggttaattggacatgttgccaaaatcttggagacaatatgagaaacttatagaatcaagcctgtttttattctggagatctaaaggatgataaatggggtagacttcaatgattaagaagaccagagactttactttttacctattattttcttttcttatcagtctttgaaaaaatggatttccaaaacttaaaatctcttattaatctttgtagtgaatctttagtttattatcacttttattttagactcctagacttttcatattgttttgtgaataatttcctggcctcttcaggggaaggtcaacatttctcatcactcactgttaaaaatggccagctggtttcccttgccttataactaggaacctactgcacctatcttccatgccttttgaaagtaaaaattactctgataaactcccgaagcttccctgaatgcacactggtggtgtaacaggacctgatggtttgtgattagtacatctggctttttgaaatgtcaacattcacttttcccttatggtgtagaattttcactgttccatcttcatcttatggataacagtcatcacgttcatttgttcactgataattgacatgaatatacaaatttttatataaaatgagttttaaaataatattcttcagcttttcttcatttagaatttgtgaatggaaatgaggttgcttttaaagacctcctttaaaatatatatttgaagatatttttatcaattgcattctacttgtcttgcaaatgaatcttttgtcttttcacctttatttttttgtattatagaaaccctttctctacgtaccagataatttgtcttgcatttcacatttcatagtattccagtattgccattggtcttaaggtcactttacacttctagtttagccagctcaatattctgatgtcaccattgttctgcttttatgtaatatttcgtgaatatggtctggtaatactagaataatgtttaaagaacattgaattatgtaggatgatttgaatactttcatcaatatacctatatcaggaaatcaatgatattgaaacacgtctgaggttgctggactctgtaacttcacagttgatgtttatcagtttccattcatcttttaagtattaaagacagagggctgcctggaatggtggaaaggacattagttttaataccaaaccaaccttgattaaaatcctgacttcttaaggtatgaacatttgccatttatcattggaaaaataatttaacctcttagatccatactttcttcatcggccaagtaggagaatcatatgccccggcagggtggtaagaagaatacgtgagatatgctgtgagtattttggtacatgataggtattaaatatgtagaagttcttcttattttcctgctctctttagaaaaaatcagaaaaagaggattaattttctctttactattaagaaatttccccatatttaattactttaatgtcttatttgataaaatattgatacatcagatgttaaatagtatttcactggttcaaagcagtaattggatattaaagagtcctttccactaaataggtcatattctgtgaaatactctttttcttgtgcagaaagagagtgaacgttactcaaaccatatgaacacaaatttagtgaagttaatcaaatcataaaactttttggttatttatttttattttataaatattttatagaaacttgctataatatgacaaaaactattacctagaatctgttttaaatcactgtgttttaccatgttaaattagttactgaagcttgaaatctatagattttcattctttttatcttctttattcatttaacaaatatgtggtgagttgctattacatgtaagacactgttctaggctcttagcatatgtcagtgatccaaacagacaaagatctctgatcttgagtagttcgtatttcagcagtaggagacagtatatctcagaaaacagtagagcaacgtgaagggtgcatggaaatatctggatgtggtgaggggagcagattgtagtagtaagtaggataattagggtaggaaccatcaaaaactcgacaattgagcaaagactttaaagaagtaaggggtttagtcataccagtattgggaagagcattccacacagcaggaaaggttggtgcagagatttcaaggcaggaaggtagatggagggattagtgatgggagtcctgatgctatcctaaggactctggcacttccttgtgagtaaagtagggaactattgggtagaggtggcaggacctgatttatctttcaaaagagtcactctggctgttgtgttgagaatagactccaggaggagaacaatagtaaatgctgggtgaccagttaaaaatctatggtgagaattcaaatgaaagacaatattggctcaggacagggtggcaatagtggaggggctgataagtggtcaaattctacataaatttagaaaatacgtccagtctggtattaggacacaggatgtgagagaaaacaaggagtcaagtctaaagattttcacttgaactgctggagaaatgtagttatgatcagccacggtggagatggttgctggagaatcaggtttaggggaaaaaaaaaatgaaaagttctattttggaaatgctgattttgagaggtctgttaaatacccaagtaaaaatgttgaggaggcagttagatgttagagttaagaagaaagaatcaggtaggaaataggaatgttgcatgtatttggggtactttatggttaatgtcatgttgaagaatggcatgaagcactgaatggggggtgtagaaggaaaggtggccagctacagagcccctgaagtctcttcttgtctgtttctggttacttttaatcagtgatcagcaaatcagaaaattgtatatttgaaaaacatttcattttgtcaacctcatattatcttaactgctcctaaggtctcttaggaccaatgtggaccctacaataacacttgggaagtagacacaaacacatgtatttccccaacactatttggagataattgtctccatttatgataggaaaattcaaaaaccgtaacattaagaacagaaatgtaaatgtcctatagtctactatttggccgcttcctgcacagtaactagtttcctgacattaaagataaaaccatttaaagttcaaattcagataaagtttcacataaaatagtggtggtttttttttgggagggagggtagaaggtagtgattgcaggcaccaaaatggaaagtcaaaagagagaaagtaattatgtaaattgtgtttcttgaaggcatttagaatttttaattcacatactcttaagtatctgaaagcacatttagttcctgtttggagagatgaaagccttgccatagcttcatctgcaggcttgtggcaatgttagtttctcccgtgtgtacgtgcactgaagagtggaagtggctgagtgggcagttggcaaccattcatcgcattgattgcagtcattcataaaacccagcagcgctgagggcggagtcaggaggagcattcccctgaggcggttgcagaatgtcttatttgcataaatcttcagtgatgcttcagtgatgagggaatgctcacatgcagttagaagactgtcgaagagccccaatctgataaatctgagtaattaaagactttgcaaaaaataagaggtcaaactctttgaattcctagtccttcaatccgtggtaattctgggaagtcagcattgtggcagcttttgtggtctccttatgtcgggctgaaggagtgaattacagagacagaccccttaaaagctgcaacatactgaaatatcattgttgtgtctcttaaagtattaggggtttatattattataccaagtctaatgcataggagatagtggaaattgctgaggttacacagtttccatatgttaaaacggtcaaaactattaaggttttatccttccaaactatgatccaattcaattataattttaaagaaatggtaatccacacaagcaaacaaaaatcttgtgattagaagcccccgaaattgggtaaatgattagcaacctgaaacaattagtttcctcccttcaaaatgcagattcaatagctagctacattgctctattcttgaatatttgtcctgtggccaggatatatcttattatggaaaatgtgttgttttcctgttatattcagattaattctaaatatattgcttttgaatattaatgtgtttatttttattattcaataaaactttaaaattcaaaaaattgaatgaagtttttatcagaaagattctataacatacatagacagaaacagtatattaacttgaaattttaaaccaaaaccactgggacttgagattagacaagaattttcttacaaagatagggccctttttaaattgttattttgttttatttttttatttgagttggagtctaactctgtcgcccaggctggagtgcagtggcacgatctcagctcattgcaacctctgcctcccagtttaagcagttctcctgcctcagccttctgaatagctgggactacaggcataccccacacacccggctaaattttgtatttttttagtagagatggggtttcaccatgttggccagtctggtctcaaactcttgacctcaactgatccactggcctcagccttccgaagtgctggattacaggcgtgagccaccatgcccagcagatagggccttttagtcagaaaaaaaaatgtttgcttacaaacctatctttagtgttgcttaataccttatatttgttagaaaatagttacttcagcacatatttttaaaaactcttaagtagtagatttgttttatttgaaagctttgtatgaatacctaagacttgaggggaaaaaaagagatgaattaagatttctcatagatttaattctttagaatttttccaagttggtgatattccagatattttcacaaatcagtgcatgtagattaaaaatgctgcggccaggcgcagtggctcacgcctgtagtcccagcactttgggaggccaaggcgggtggatcacgaggtcaggagatcgagaccatcctggctaacatggtgaaaccccgtctctactaaaaatacaaaaaattaaccaggcgtggtggtgggcgcctgtagtcccagctactcaggaggctgaggcaggagaatgacgtgaacctgggagatggagcttgcagtgagtagagattgcaccactgcactccatcctgggcaacagagcgagactccatctcaaaaaaagaaaaaaaaaatgctgcatctgctatttttagttaagtgagaattgctaaagattttcgaatgctttgaagtttaacttgctggacattttagcttgtgtaagttatattaaaatttcagagctcagaaatcctaggacattacacttccctagcaactgcattcctgaatgttttgaaggctgatgcatgattggccttctcccaccacaccggggaaagaacacaaggctttgtggtttctgtggatgttgttgactcacatctcttgaccaattcatcgaaagtttagcatcaactcttgatgaacaccactttttaaaacttttatgcaaagggaaggtgtgttgaggttttgaaatagcaccgttttcttttcttgtcatgtaacatattgatttcggcatcttactgaccttgtttggaatgagcagtgtgtgtgtgcacgtttctgtgtgttgtgtccatgttttcctgtattatttctttcagaagtggagaaatttgccatgcagccttaagctctgggaaaacagtttatctaccactgcctcaccagtgatccacttctggaataatatgactggccttaaatatgagcagggtagtcaaatctccaagaagcctccatgaaagctcttaagaaccagattcatatttgaagccttctggatcctaaggggcattctgtttagcaaagactaagatgtgaggtctaagttttataaccaagccttctctattcaaagccatgtttattttaaagcttttgagaagaaggaatatctgggccatccatgttcatcctcagatggaggtgttttctgatttctgccaataaatgtcaccagtgctctgtaagccctgttttcatgaaagtaggagtatctcctcctgctgccctttggagctttgttatattgtctaccatctgcatttattttgtgatgcatgacttaaggcacaaagacatttaattactttttttcacattttggaggtatcttttcttcttttacacacacacacacactctttatatatgaacatttctttgatcttttcctcccctcctagcatgaggaaattttgaacaagggggatgccttgaggcctctcagatctttttgcataaacagaaagacctgtgtggtgattgatggtgtgaaagaaaagtctgtattttttagtaaaatagcaaaagtcacagaatatcctgctcaaaatttaacatatcaacgcaacagctgttcctatttttaagctttcagacatcttcatatggtcatgccaaagctttcagtagcttttctgctatgggaaaagctgctgacaatcatgttattgatgctaaaaggaaagtcaaatacagaggctagcacagattttattcgggtataattgagcttttggaagcctgagtcaaaggtttccaactccaagggctttgctggggccccaaggttaatgttgaaggggctttcaaagactttcccttagagtgtttttcagtaccgtgtttaatttctagatgtgttctaccctttttataattaatagtgcgttgtgctgtctatcatgcgccccaggtgtgttgtcagggacatggcgaagcctgctgcctgcaaaacaccaagaaatgctgaaaaccagccccaccaaccttcaccgtgagtatggcattggttttattgactgaaaatgtcgtctcttacacagatcatggttacagatttattcacattgcatgtgagagtagatactctggctgctcttgtatatgtaacaaaaaggctactgttgaattagataaaattagctgagctctggatttaatatttttgttaagtgatgtttctaataccatattgaaaggattaaactagttgaagaaaagggacagttttcttagggctctaaaatgacagcaattcttttttgtttgtttgattgttttagatttggaatgtgtatgagctggaatataacacctcagagaagtatggaggcaagatacagacagggtgctgagtgggggccagtgtgtttaagggaaatgcataggtagtccattatctaaccctcaacatatattatttaaaggtaactgacaatttttaaaagttgattgtcggctgggcacggtggctcatgcccgtaatcccagcacttttgaaggctgaggcgggtggatcacctgaggtatggagtttgggaccagcctggccaatatggtgaaaccccgtctctactaaaaatacaaaaattagctgggcgtggtagtgggcatctgtaatcccagctacttgggaggctgaggcaggaaaatcacctgaacctgtgaggtggaggctgccgtaagccaagatcgtgccactgtactccagcctgggtgacagagtgagaccctgtctcaaaacaaaaacaaaaacaaaaacaaaagtggattgtccatctagtttcatttttattattgaattcttaagtgtagatcctaatgattaattaaatgaccaacagaaagagtttcattcacatttgaaactcagagttgactgatttgatttcttctctactccctgctttaccctttatttggtcattgaaatgcttatattttgtatattacatacagtaacatatcatttaaaattatttatgttttaggatatgaaatgtggtaaatttcaggaggcttaataggtgttataggttttaccccaataagtatacttgaatatcatcttccacatttaatcagtattttccaagaaataaaaatagttttgaattagcaatagtaaaaatgattgataattacattttaaaaagtacaaacttggaagaagtactttaaatgatgttgtcatttttcttttgcctatagatattctgactgtatgtaaagccatttttgtatgatggaactttttggataattcatagaaaacttacatccccagttttcatcttatattctaggaattagaaaacattttatttattttagaattcaaattctttgaggaattaacattgattttaaaatctctttatattccacgtatcgaggtttcattttaattggtctcacctattccaaagttcattttaaattacacattattagatatgaactagcatttgccatcctccaaaacaagacattagataatttttctcttactttgttttcactttcacagttgtagaaatctgtcgtcactttaattgcaccttgtggaaacttccctgtggctctttgagtttagtggccgagaagaagcaactatagattctttggatcctgctttttgacagtctctttgctcactcaattcttttctgtttaaaataatgaacttctctgccagtgacttgaagaatttaaagtttgctttcattccttatgatagctgattctctgtagagagtaatgtttgtgaatggaactctccatagccacataaatccctttttaggttaacatggaaaggacaaaaataaattgggagggggtaattgaggacaggctttagcttatagatcagtatttttaaatttgtaatttatgattttcagtgggtctgaaaatcaatagaggctagtgaccagacctcttttaatattttttttaaaaataaaagataatagaaaatatgagtgccccccaggttagtattttaggacagaacttagatttctctatatggtaactgtgtcaaaatataaaatttaataaacattgcagttatgaggattgcattaatgggttttaattagaggaatggcataatcagatttgctttatcagtggatgtgtgtgtatagataatatgtattatttgctttgagagaagtagggaaaatggactatgaatgtgaagtgggcaaaactagagacaagtaaatcaattaacaaactattgcaataggtcagggaaagataataaggtctcaacttagaggaaggagtagtagaggttatgagaaggagacatttcaagagctaagtgagaagtaaaatgggcaatgcttgattgccaattgaatatgggttttaaggaaagagtttagggggattaccatattaatggcttgggtgactaagagccactaccaagaagttgaattaaagctgtaaaccaaatctaggcatagatggtgtattagcctgttttcatgctactgataaagacatacctgagactgggcattttacaaaataaagaggtttattggacttacagttccacatggctggggaggtctcacaatcatgctggaaggtgaaaggcacatctcacatggcagcagacaagagaagagcttgtgcagggaaactccccctcatgttatcatcagatctcatgaaacttattcactatcatgagaacagcatgggaaagacctgccctcatgattcaattacctcccactgggtccctccgccaatacatgggaattcaagatgagatttgggttgggaacacacccaaaccatatcagatggacagtggtgagttcagattttcatatagtgattttgtaatacctgtaagttatccaagcatatatatctaacaagaggttggctctgttaacctttagcactcagttaactggggaaatagatgacatcaccacaggatacatagaaaaaaaaataagagcgagccctaggtaaaagcaatgtttaaggaatgagtaaagtatgagggtcccccaactcagccaagaagtagtaaagaaccagaagccaaggtagtagagggattcaaggggaatgcccaacagtgttaaatgcagcagaaaatcaagaaataagggatgaaaagtgtgctttggttttcgtcatatagaggccattggtggcatttaccatagcattttcaatatataagtgggtggaaatgctgtacttctgtaggcttgaggaggaaatgagaagtcaggaaaaggagagggtaaatgtacatgactttctctaaaagctcaaccgagtagggaaaaagaaaaagagtagttggtagagagacaggaagcagggtgatagtactcatatcacttggtgtattctattatgcaagtctagactgatggatacacatgtcaatatactttatatttttgataactatgtacataaactatccaaatgttccttttaagttattgttaaaatgtcactcagtcatattttaagcatgctgcctgagttgtcatcacttaatcaaagtaataaatatatcaagatattactggagttcaatgaattgagtcatatgcctgctattccttgggtataagatagaaaaatgagatatataaatgagatagaatctttttcttaagagtttcttctcaagttgggggaggagaagatagataatcaaataaattataatactgaataataaatacaatactaaaatgcgtttaaaaagagaaaatgatttattctgtttgggcttgatgtggtcagggaaggatttacagagctgcaacagtaatacggattttttgtttgtttgttttttgagacggagtcttgctctgccacccaggctggagtgcagtggcataatctcagctcactgcaacctctgcctcccgggttcaagtgattcttctgcctcccaagtagctgggattacaggcatgcgccaccacacccagctactttttgtatttttagtagagacagggtttcaccatgttggtcaggctggtcttgaactcctgacttcgtgatccgcccaccttggcctcccaaagtgctgggattacaggtgtgagccactgcgcccggacagtaatatggattttaaagactgaatagtttagtaggtatgtaaatttaggtaccatcttccagaagcagaaaacaattaccctgagacccagaacatcaggttgtgctggggtaatttaaaccatatactgactactggaatctgtatgcattgtatttttcttatttggtcttaaggtctctctcaacagtggctataaactctagccctgtgtcaatggggctccgggtgggtggtcatggatgtttacagtgtgcctttcatggaatagttcttcatctttgtgaacggcctaatgctaaagtgactgacctgtgaccaaatgcccctctcaaaggaaacttgttcataatggcagatacccctgtggctcttaactgacctgtgtccagtttattcctaccaagatgtcaggagagttgtccaggagagccctggctaggaggagagttaggttcaggtgtgtcagtcaagtgagacacagaggaggcaacacaataaaacacatgaaataacagaagcagtgtgtcactgatagatcctagcgagaaggggccggcatacctccaagggccaataggaagctgggagctgtcttagaaatacacgtgcaactagctagtggagagcaagagagagagagtgagggactcataggccagagcctttactggtgtccaggctcttacccacgcaggttttcctcatggagttctaattggtcagtgtagatagagcaagggggcactagctcagtggagtcatgctgtactgagaggtggtccctgtggcatatctggggaggtgttgggggtcagtgggcaaatcacatatcttgtaactagctgtcccatgggaagttgtttcaccaggaggcagttgtatgaggtagatctggattgatcaccttaaggaacagggaggaggcagagaactggcagctgtgccaatggttgctaaactctgcttctggtatgagaacgttcaatttatatttaaaatggatgccaaggtaacataaaattataggaattcactgcagtgtgtgtgtatgtgtgtatgtggtttcgtgggtgggtgggaatttgtgtgtgggcatgcgtataggtgtaagtgtgttaaagagggagaaagatcagaggcaggaagtgctgcatcagaagaataggacagttatctaatttggagaaaataagcaactcgtaccttggctttggttttacttttaatactgcgttttattttgaaatttgatttaaaataatcttttttgtgtgtttttcagagttatcatggatttaaaaagtccgagaaagacttggctactcttcagtctcaggcacatatgttagggggaccaggtaggagaggcaggaggtagagaagatttgagaaaatttcatgtgtggtataattagaatatagtgattcattagatgtgataagaaaacaaaggaggcaagataagtcattttagctcaagagattaaatggatatgataaaatcaagaagagagctaatttaggcactaaggcaggtttacacacagcattagattcgagtattagtagccaaggaaatctccaattgcaacactcagaaaacagttggctattctatttcaaactcaggagagacttagaaaagatacattaatttgtaagcaattaccttataacataaaccattaaaacaagtgaaatagcattgggaggaggtgtagagataaaaggaaggaatataaacgggtgatgggtgcaccaggttctcacaaatctccacctaaagaacttactcatgtaacccaaataccacctgtaccccaataacttatggaaaaataaaattttttaaaaagccagacaccagtgatatcgagacataagtgttatgtcattgttttgcatagactaggtgataaacatcatgttattaaaaattctgtcaatatataaacatttcatatatacaaaaaataaacaatctatagtgggtataaccagtacttaaacgaggattggaggacttaagaaaattatgcaatgtcatgcaaaaacaaacttgtcccggtttttctggaactttccgtattttagcactaaaactcccatgtcctgagaacttctgttagacctgggcagactgaatggttggtcaccctagaactaataaagttagaatttgaaggtgaaaatccagaaagagaatatgatagccaaggaaaaactatgcttagccaaattatgtttgcttttctgtggaaggtgacattatcaggagtaaattgaatcatggtacatgaatcagtaaattctgatgttttgttttgtttgtagtttttgctggtgattacctgtttttaaaaaattgagatacaatgcacataccatacaattcacctttttaaagagtacaatttagtggttttcaaaaagctgtgcagccatcatcactatgtaattcaggaatgttttcatcaccctgaaaaagaaatttcataccttttagctttcattaccccattctcctcaaaatacagcatctgaaaccattactttctatatttatgagtgtgcctattctgaacatttcctataaatggaatcatattatatgtgtctgtttatatctggcttttttcatttagcataatgttttctagactcagagcttgtatctgtactttatcccttttattgcccagtgattgtatcgacatatcaggttttgtttattcatccatcagttaatggacatttggattgtttctactttttgactatattattaataatattgctattagcatttaggtacaagtttttggggatatggatgttctcaattctcttgagtatatacctaggaataaaattgctgggtcatatggtaactgtatgtttaactttttgaggacctgctaagctgtatttcaaagtagctgcattattttacattcctatcaataagagaattccaatttccctaaattcttgttaacacttgttattgtctgtcttttatattatggacatcccagtgggtataaagtagtgtcttactgtggttttcatttgtgtttccctagtgaataatgatattgatgaacttttcatgggcttattggctatttctatatcttctttggagaaatatctatcaaaatattttcttccgttttaagaataaaattgggttttctctaaggatgatctttcaaaatatgtgttatttgtcttttttatttttgagttataagtgttcttcacatgtaatggatagaagatctttgtcacagaaatgatttgcaatattgtctcccatttagtgaatagtcttttcattttcttgatagtacttttgaagcacaagtttttaattttgatgaagtctaattgatctattttttctttggttatttgtggttttggtcttgcatccaggaaatcattctcatatcaaatgccattaagatttccccctgtgttttcttctgagagttttatacttttagatcttacatttaggtctttgattcattttgagatagtttttatatatgatgtatgtgtttttatacatgtgtttgtgtgtatacttttcccatagcagattaggaaatatatatttttatgcttgaaaatatgatttcttatttataatcacatctcagatttatgtcttacatcaattaaaagattaaacaaaagtgtgaatgggtctttgatattgtgaatagttggataaaagctcttgtcattatttctctatgactttaagctctgcatactagacatgatcttcagactgcgtggtctagtgttcacaactctgtgtcctacaatagcggatggcagaaatgtcagggacaacacaaaagaatggataatccacttgtagactgttaccacctcagacacatccccatcatgaatataatttctctcaatgtctgggaaagaccctataaacattggaaactggcccacctttctctgttttgggagctcttgcacccttgctgctgctgagccatgtggtctttccttcactgctaaaacagctttggctgagaagatagcgttaaaaggaagagaaatgaatttcttcaacaggtggaagagtatgcagtagaggaaacaattcactgcttttatgcaatgaattggcctatttattctctcttcaacaaatatttagtttgtactgtgtgcataacatattgccaggccctggatattatcatgaacaaagcagagtctttgtccttgtaaagcttggagtatgggaggagacaatctaaacaacaaacaaaaatagatgataaaacccttctcttttaacaaaggcctaacctgaatgcaatgaaagagagctacactgggaaaactatttagaaagactgctcaaggaaggctctaagaggaggtgacatttaaaaagagacttgaaagatagaaatcagccctgtaaagagccaggaaaagggaattccaggcagaaaggatgatggtatgtgaaatggtccttatgtggaaaacagagtatcatgtttagggaagtaaagaagcccagagaaagcaagtgagtagaaagagggcaatggctgagacaagcaagggttccatcctagagctcttgtgggtctttggattttatctaagacttatattgagaaacccttaaagcactttaaagaagggggaatcatgatccagtgttgcgtagcaaacgggttgtaaggaaagagaacttttaggagacagttgtggcagttaaggcaaaatataatggtggtctggactctactggtggcagctgagatgaagcatgtggaatttggccacatgccaaaagtcatgaagttttgaaagcagtgagggagaacagagaagaggaacttctgtgcactaaggggaggaggctctaatcgtatgtctaatctctaatatgcttaagagggtcactgttctttgaatgcggaatgcatatgtacatattttctcatgaaatcctaagcatcctactatggatgcaattgtatcttaaatggtatctattgttgaatactttagaaatctcacttgtattactgtaggtatacttatatagcacttcaaatattgaagacaaaaattatgtaaaattgaataaaaattgaaagactgctagatttttccacttatttaaacttatttaaaattttttattgtgattttttttactctgatagtctgttgggacagaagattcaataattttctaggtgtttggatacccgtgaagaaactgatttttaaaatatatgctagatacaaatattgcaccttttaaaaatatagctcatttactgagtaaaatccagtcaagaagaaaaagaatatgtcatatgcaaaggatcttttagtcatatattttatcatgaatgaagttatttttctgagacaggccttctctgtactatttttagccatgtttataacaaaattgcattgagtcttaatttcttgcttcgttaaaagttgttttcacataaaataagagatgtttaatgtcacaggctatagttgtattaccacctgcagtagggatcaatatcaattttctattgatattagaaaaaatgtccaactaggaaaaaaaatgttttcgcattttagaataaagtcagtagagccagtaatttgaaaatagagaattctaggaacactgacatttccaattcatagttataattaggaagtgacagaattttaaaaaattgtgtggcttttatagtcttcattctttttatatgatttgctggcttatgcaaatcgttctatgccaattcacaaagtcttacaaagccccttgttctgccatagctattttaatgataatattgtgtttttctctttctgaatgctcagagaagatggtgccctcttcaatttcttgactattaaaagcatttagttctggaagagtagaacttaagtagttctactatgtatatgtgtgtgtgtatgtgtatgtgtatgtaactaaggtcatgcaagcccaagcagacttttgattgagtgtatttaatggcagctttacattaagccacatgatgtggcaacagctgagatttgatgatgcttgtacttggctggcatatggaagacaaaacatgacctatgttagtggcttgccccagggtcacccagcaggacaggggaagataactgaactctagacctgaaaatccgtgaaattttagtcatatacatgacagcattgtgtattccataaagtagtatataaatattgtccatatattctactcaagtagcagtgaaaaatctctacattattcatttattttgttaatttaacaaatatttaccatgatcttacagtgtacttgacacaatttgagaataatttttttggtcaatcctctcaaaacatagactgtatctttatctctgtatgtttcttattcaggggaatgatgtaaaaatgcatagaatcactttttagaagtttatattccatgacatactaccccattatgtatcaaatgctccttactatgcatgagtagggtagccaggaaacgtgtatttggaaaattttcctaagtgattttggcatattctcttgatttagaatcactgatatgtaccactaatatgctcagtaaaaatgaagattagatgggatgggtgataattttataagtcaaaattaatgtgaatatcactgaattggacctctctttcaaaactcatgtacagatattgcaaggataaataaatattggcaatattattattagaaagttgctgtgcctcagggctcagcctggttactctgtgaatcactgctatttcctctgctcttctacagagtcatttgtccaggatgagaacagtctgcccgtgccaagaaaatagttggttgttgtgaaaaaacaggaagcttatagccaaaggaggcaaaatataatggtggtgtggactctactggtggcaactgagatcggtacccactggctactgcactagtgtgagaaggaagatattaaataaaagaaaaagataatgcctaggaccttgggcaaagcatgcagtgaattaatgtgtatttagtggaaaatgataatggtgaataaatgaatgcactcatgtattatatgtataacaaatcttaaacattattaatgtgggtaaaagttcaggagtcagaatgaagccatcaggcaagggggacattgaatatatagtctgatttgaaaagcatatttggccaatgagttggaggaatacaaacctgtgaaaggcagttgaggccagtttatgaatgtccttgaagtccagctttgataaatggattttactctgaagggagacaccaaagtatctgaacatggagctatctagttgaaaggaaagtttcaggataatgaatttttcaggaatatgcatgatggatgagcgtacggcattcctggagaaaaagggaccaattagtagatgattaaaatagatgagacatggctaataatagtaagaataatggcaatgactccagaaaaaatggatgagagagacatttgaaagaagaaactggtacgccttaatgacaagtggatgtagttatgaaagggacaagtaagagataagacaaaaattttctgagattttgggactgggaattaccaaaggagagttaataaaaaataaggatagaaaaggcaagtacttctagggaattacattcctaaagtatgcatttcttttctgattcctgagagaaatccacagaaaagaagattctgtggcacagtggagagaatcattccatatgggaacatcaaaaagaaaaagagcacacatctaaattttcaaaactgctcaccagtctaagttctgcataagattaaagcagaagagtgtctaattttagctttttgctgattttctatcaactctggtaacaataactgcaattatatgctgttgtgttttaggcactttatgtgcatttaaccctcatgaaactttataaagtattgttactgtctccattttacatatgaggaaactgaggcacataaaagaaaatcatttgctcatgttcatttacccactaataatcacattcatttacccactaacttctggttattcattttaactattcaggtcaggattcattggcagcattcttcttgctcaatcttgggctaggatctagtggggttagaagacaagaataccataggattcttaattcaaataattcattctaatatggtagacataatatataatcagtgagtaggtcacactctttgtggtattcaccccacattagaaaaaattcatagaaaagatgaaagttgacagagaatgtacaaaattgccattggtaatgttttcatctaagtttccttatttataaaccatgaaggctcttctttattttgcttgcagaaagggggtttaatctctaatccggcaatacttttaaagagcactagtcatttggcagtaagtcgtatgctatcttgggatatgttttctctggttgccttagtttatttttttttaaatcattcactttttcatttcttttgccttgtctccccacctgcagtgttcacctcttgaagaaagagactgtattgcagggaagtcattggtgtactataatgcatactactaagctatgccattggaacttgatataaattgcttttttttttggtttgaactatgatttgatttgatttgaatactgaatgccaattgacaaatgatttcaagatggattatattatctcccttattgataatggcaaaccaagccgctaaacattatggagtagaggatatggaggatcagggaggagaataaaggcatctttcattttatcactttgatttttctaactctgcatttccatgcaattccagggagccatttccaccatctattatcctttgaagcattaaaagtgttaaaatacttggactggttctttgcagtcttattttactatgagaccttgttagtatgatacctcagctgataatcttgggccacatttatgagaaatgttcaggcttggaaaacgtgtgactttgagttctatttcagggtgtgtgtgactgtaggtattaacacaaaatttaaagttcttgccttctacagtgcatgctactttacacataagagtgctcaaatattatgttgtttgttccaagtttaaatggaactgaactcagtatttccttccacatcacaccccaacaaacccaagcacagtcacactcatgcatccttcttcaccttctctcatctatttatgacatttccattctcacagtcacacagatgggaaacccctgagtcatcttcagctccccacttccttgtgtgctccctaagtgtaatcagtcactatgtcctgtcaggtctaattctgaatctctgaatcgtctcacatctgttccttctgtcagttctcactcccatcctcatatttcaggctctcctttttgcatggggttggataccccttggccttttgtcttctattcctttactagtctaattcatcccacccagctttgctcagagcacctgccctctctgaaggcctttaggtccaatagtccatgtataaattaagtcctgcctgcacagtgcctgattgtcttctcttcaacactaacttctctggtctaaatgttttacaaaaccacaatattccctactcattgaagatgtccttcccttctatttctaccccgagcttttgccactgcttgttttaatatctcacccactcctctttttccaccaatgataatcctgcctgtgactcaagtctctgctccaaaacaatttcctccaaaacgtacttgaccacccccttcaccaaaattttttcttccctgagctttggttatacctgccttcctagagcacacattatgttctatttgtgtgtttcttggatctgctgtaagtttatgagctctattttagttctctattattttcctaattgttgtaaaaaagggtcaataggttcttaagtgggattgcataccagaatgaaaccaccaagagcgtgcttatgctctcactctcacacttggtctctctttctatttctcatttaaatattaagtttagagattaagttatacagggaaaggcccagtcagtattgtataatcagaaaaaaagggttttttttattattgacataaacttgatttttttttcttttctttcaacattggcatagggactatgacttttttcttttgagaaaatttgagattgtacagccagcctaagtaaattctcagttaaaagtaaataagtcatcagatgtggttaccagaagagggatgttgcagaatacacaacaagagaaatgactacttgccatcttctttgtgttttctttccagactgtcctgaatgctcagatgtggagcacagggactgatttatgttttttctgcacagattttatgtctactaactacacaaaacttgggggaaataaatcgtggataaattttaagtacaaatatgaagaagctacttacatagcaaaccatcttgtatatttaaaagatgttctttcttaaattccatttttatcatattactgtctgattaaaaaacgtattttggtttgctgttgcctattatgtgaagcctaaattccaatgtctggatttcatggcatttatcttatctttgctaattgctattatgtgtttatcataggtttccacatgctttcagtaacattctgtaacttatgaaatatgttaatttttacttattgattgatttatgtataatcaattgtaagtatagttggttatttcaatagctataaccagaatgtattagagacaaggaaactgtatttttaattgaacattggatttctctaatatgtttctatcagcctgagaagaatgcaaaaaggcttaaaaaacatctctctattctgaaatgctaaataattcttagatgaaatagaaggaggcacagaaagggaaatgggaagtaaaggttgtggacatgcctagagggactcaaagctaatgttaagaggatgatctttgaaggaaaagaaaaaaaaaaactgtactgctggagctacactgtgacaaatagggctgtgtctctaccttttacagaagcagcaaatgcacaatcttatgaaaaaaatgtagaaaccacagtgttactaaaattttttatctggcaatttataatttacaagccctcaacacgttaaaccttagttaatttttttcccagagaagaaggcattattatattatactttgtgctttgagaaaattaatgctcaaactggttgccagtacttgatggagctattactcagacgtctgtttccaggtgctctttttatttcattgcatagaaacaagcagaacattgtaagttgagtcctgtaagttgagattgtaaaccttcatatctatgtatccatctgtgtatgtatgtatgtatgtatgtatgtacatatctatctatctatctatctatctatctatctatctatctatctattatgtttgtatctatcatcattattgcctatccatctatctataagctgatgagggtggtataaaaggaaagtccaacatcctccccttccctattccttagcactcctacactcttcctccttcacacaagcactttgtactccaccaatacagattgtagttcaccagcacacagcaatgtacatgagacagcccatactagcttgggagagtcaactgttagatattcaaaaagtttgcaatctagtttaaatagggctattattaaaactgaattatgactgggcatcatggctcatgctcgtaatcccaactctttgggaggccatggcaagagaattgcttgagcccagaaatttgagactagcctgggcaacatagtgagacttctgtctccaaaaaaattaaaaaataaaacattagccaggcatggtggcgtgtgcctgtagtcccagctactcgggaggctgcggtgggagggccacttgagcccaggagttcaaggttatagtgggctgtgatacaccactgcactgcagcctgggtaacagagtgacaccctgtctaaaataaaataaaataaaatagataaattatattaaaataaaggtaaatgctcaactcaccaacttcctaattattttgatacatgtcacggtccatgctcttgagttatgtacgtccattatatattatatcttcatgatggaaatactgcactaaacatcttttaccaattccatgttaaagtgacatcctatttaaagtttgaaatatgtcttgggtgggagtatttacaccatggaaattgacaaaccctataattcagtaattggtactttcttttttcttttctgtttttatttagttagtttttgagaaacagccgttaaacatttatcagcagaccactgcaaacacactctgttgagtctctccttcttgcctttgtaaatgttctttcctctgcctggagtgcccctcgctatgtctgagacatacatgtatatgtatggacacacacacacaccagtaaacttcttttaatcactttaactagtgtcatttctttccaaaagctgcttatgcctcctaggcagggttagtctctctactttgtagtagttctatactttgaatatctttactttaacatatgtcatcctttattacacttagaattgctagatttagcaaataaaaataccaaccctcatgaaatttaagtttcagatacagttaatatttttttcataaaagtatgtcttattcaatacttgggcatacgtatactgaaaaattatttgttgtacgtcagaaattcaaacttaacttgatgtcaagaaaccatcacaactttgggttttgttttttttttttttttttaatgtttcaccctcttagtagagagatactaggtcttttctcatggtgtccataatgtctagcacaaagaatggctcataataggaagcttgtttgtttgttttaataatatgcataccatgatttttcttattcctcgtctgactgaatcatttctaaatatttctggtggacaaaatcaggaaaatggagatggtggaattaggacaaccagatagaaggctaaggcaataggccagatgagtgatggcaatgtgtgatcaagaaactgatgatgccttgtcgtggggagaagagcatggattataaataagaatctagtgcagaaacaactagacatcatgactggatatagatgttgaatgaggagaaaatagaaatgactctgaagtttcttatttgggcaatggagttgatggcaccattaactgagagagaaacaaaagatgtgtagttgataagaagcagtagaaataattgagggattccatttgggatattctaaattggatgtgttgtgaccaggcatgatatgaaaaatatttttccaccagtccagtgtgggcattgccattagaatgaatatcaatcagttggaatgggcaatagcccaagggtgctgctgtgtgagagtgcttttgactcagtaaaaatgtccaatagggaatcataactaagggtctgaaactctgggcagaatttgtgtctaaaaattttggggctcctgacttaaggtgacactgatgctcagggtgtagatggtagcgtttacagagtatttggagaagaggataaatgatggagccatagagaatatttatatttacatgacatacagaagaagtaaaaatagtcaaggagaaatatgcagagtggttagattttatatatggtagaggtgatggattatcttgctttcatgtcaagctcctccacatttttttggtagagcaattgttacgttataaatgatactgtataaacctaggggcttctgtaaaatgtcatcttagttccaggctgctattaaaaaatgcttttgactaggtagctttaaaagcagacatttatttctcatagttctggaggctgaaagtctgagatcagcgtgctagaattgatcaagttctgttgaggaccctcttcttggtttacagacagctattttcatatggtgtcctcacaggcggagagcagagatagaagaagcaaactctcttgtgtctcctcttgtacagggcactaatcccatttatgagggctctgcctcatgacttaactctcaaaggtcccacttcccaataccatcccattgggtattagactacaacatatgaattttgggacggtacaaacattcagttcacaacaaatatcaaacaccacagatacctaggggcttgaccttttgtgctacaataagactacacttggctggatctagtggttgatgagagatacacaatatcattatcaatccagaagggtcggctacaatagaaaacaaagatatgtagactgggaggaaggtggacttattagtcaagggtttgaagttgattggctgagtagcctttctggtttcattttgtgaagagaagaaagggctgggaatagagagttgcctgtggtgtgtcattgattgtgtccttagagggcttttgctgttgtcatatttctcaaacttgataataggagcaattttgagttgatgagaaggcatttgcatttgaacagtgagtgttgttctagttctgttactcaaggagtttctaaggaaagtaagactgccaaagtccatatggtctggaaaagaacaccatgctcaaatatgtgtgggtcagcagactgctggagtttttttttttcttccaattctgaaaggatgcttaatcatttgtcccattattgaaaatgtcacaataataattataaatggttctttgcttcctgtagcagcaaatctaaattctttcagttgacatcaagattcatgctagcctgctttcagtaaccaatttttcatatctaattgccccaaaattataccaccagctttactgagtctgaatcctgattgccacatgggctcatcttgttgtttcctattgccatttccttgtctatcttattcttttcattcaaaattccatccagtttctgctttgcctatccaagttctttggggtccatgagaactaaattcaaaatccgaaattctttacttaggaattaaaaaaaaaaacttgtgtgttctcattgagctagtaatcccatttctgggaatatttcaggcagaaatccgatgtcagtatgtaataatatatatacaaaacgtgtttactgtgataaattggaaaaacatgaatgtctacccataggaaaatggctgaataaattatggtattgccctgctgtgaaattcttgttattcttaggagctcctgaaaagaattgagcatcttcaactaaacaatgggtgaacctagagagttgttggaataattaattaaactatacaattgtgactggcccatagcaaactgtaatacagagtaactgttattacaactattggtaacattatttttttattttttattagaaaacataggaatgggatatttttatgtgaataaagtaatttgtatgttaccatctacatgtgggggccatttgttaatacaacagcatcatatatacatgcctaagtgggactgattcagattattaaacaatttttaaacaacttgtaaggaaaaggcacagcttaataaaaggtacgctagctctgagcagctggattgccaacaccagtttgtagctagctctttaaaaatccaacaccaaagactaatgtataaacaatggaagaagtatggaagtatatgcataccattgtcaatagtggtgcattatacacatgggaagggagaggaggagatcattctactagaacactgctcttgcctgaattgctacaataagcatatattactttctaattaaactgactcaaattaaaaataatgcttctttagtacagtgactagcacataacaggtgctcaatatttgctaactgttattttcattataggcagtcattattactgcctcaagttccataaactccagaaatcttcactaacaacatctcccctatcctttggaatgaaacactgatatgtgcagcttatttacaaagcacttaatttcatgggtgaagcttcactcaccagggggtagcctgcattgaagttttgttttgctctaagggcataattttatttaagatgaattcacattttgtacttaatttgtctcatctcaaagcatgagaaaaattacaattacaattagttacaaacaaaatattggcaaacagttgcaatcaatttattccaaatggataagaatgtaggtgctacagtttcttgattacatttggtcgtaatcattgatcgattcattaattcagtagatatatgttgagcatctgctacgtaccaggtaccgtgctagcaaccaggaatagaacagttagttagaaagataaggccctccctatcatggaataggagctattccactgtcaaactcgaaataagatgcacagtctttgctgtgtcctgcatgacctggcctaagcctgctcctccaaccccacctcaggccacactaaccctcactcaaagtgttccagggacatatggcttctgatctcagagcatgctgtccatcgtgtcagggacacccacgtcccagcttctcccagactgtgtctcctcactgttcagcccccaggtctctcatggaagccatctctgatttctgtattaaagtaggcccctctgctattctctaccattgcccctattcatttaattcctacctcctatcacagcctctatttattttatgtagttatatatttacaaatatagatttacacagttttatttgaatgtcacccagaatgacataaactccacaaactccagagatgttccataagctccagaaatcttcactaacaacatcttccctatcctttggaatgaaacactgatacgtgcagctcatttacaatgcacttaattgcacggtgaggcttcactcactacagggttacaggcattgaagttttgttttgctccaagggcataattttatttaagataaagtcacattttatacttaatttgtttcattaaacaaattgaattaaagataattaaataaatacatttaatgaagccttgtaagactgtggtcagctattattaacaggtgatattatttgagaatgccactatcaaacttgaaataaaacctgcagtctctgtgtgccctgcatgacctggcctaagcctgctcctccagcctgcagaggcccagaggggcctaatttaataaagaaatcggagatggcttccatgagagacctgggggctgaaaagtgaggagaagcagtctgggaaaagctgggatgtgggtgtccctgacaggatgggcagtaagctccgagatcagaaggaacgtgtccctggaacactctgagcgacagttagtgtggcctggggtgaggctggaggagcaggcttaggccaggtcatgcaggacatggttgagactgtgggtttcatttcgagtttgatagtggtattctcaaataatatcatctattgataatagcagaccagtcttataaggcttcataaaatatattttaaaacaattaagataacagaattctgtcacatctaagaaggcatatctaacaatgctctaaaatatgtttatgtacattagattttggtctcaaactatatttgaggaaacaaaatgaatacagaaagatcaatggtttttttataaggtcaaaattaccagcctcagctatattctatttattttatctaggacttgcttcactaagccatactgaaaggaatatagtaaccactttatttttataaatgccttcctttaaattgcagactttatttttgaaattgcctctggactatatgaatcacttgtctttttaattaaaaaaaaaaactttagttttttaacagcattttatgtcgatttccccagaacatctgaacatgtcttttaaaaatgcctaattctatactgtttactttatcatttacttggccatattcttttttggtagcacatcctgaaacccagattctttccgtatttttaggtcatacaaatgactgtgatcaacaaatattccccaaactgagtgtagtttatttagtattcatttagtcattgaacacaagcacatgctgtatacaaatcactaggttaaatattatgaaagatatcagaccggattcctgctctaaggatattctatttcataacagagtttcagtctagtgctcaaatgaaatgcagagtcctttatatgttacattaacaagggagaaataaagtactgtagtttagagacttcatatatctagtgggaagtacaaatgtattgttatgagaacttacttatttaaaaaattacttgtatgttaacccttaaaattatataaaataggccgggcccagtggctcacgcctgcaatcccaacactttgggaggccaaggtgggtggatcacctgagatcaggagtttgagaccagcctggctaacatggtgaaaccctgtctctaataaaaatacaaaaagttagccaggcttgttggcaggtgcctgtaatcccagctacttgggaggctgaggcaggagaatcactttaacggggaggcaaaggttgcagtgagctgagatcacgccactgcactccagcctcagcaacaagagtgaaactccgtctcaaaaaagaaaaagaaaaaaaaaagaaattgtatgaaatagagaagtcaggattttagagctaaaagaggttgaaaggatcatctaattcagctcccttgcatgacctgtaatgccactgaggttcagagacgtcacattagaatatcctgcccagtggtacacggggagtttgggtggggttttcctgactgtcagaggtacttgcctccactgcagtggaatcattggtgccaatttgcaccaggaatgttatgcatgacagccaaggcctatctggagaatatagtttaatcttttttcctttttctttctttgcttgcttctttctttctctctctctctttctttctttctttctttctttctttctttctttctttctttctctttctctttctttctcctttcttccttccttccttcccttctttttcttcttctcctcctcctcctcttcctcctcccctcctcctcttcttcttctccttcttcctcttcttcttcttcttcttcctcttctccttctcctcctccttctccttctccttcttcttcttcttcttcctcttcttcctcttcctcttcttttttccttttatttttttgaggctcagttttactctgttgcccagtagggagtgcagtagcgtgatcacagctcatggctcactgcagcttcaacctcctgggctcaggtgatcctcccatctcagtgtcccaggtagctgggactacaggtgcacaccaccacacctggctaagtttttgtatcttttgtagagatggggtttcaccatgtttcctagatttatctggaactcctaggctccagcactccactggtcttggccttccaaagtgcagggattacaggtgtgagccaccatgtctggcctttgtcttttttaattttcaaataatcacatttcactttcagaggactgctaattggaatttaaatgagcaagtgcacttcaatcaggttctttttatctaaacacacacaagattgttaaggaaaaattggatttaataaaatcagttgagatgttgattagttataggtaaagctgcttcttgatgttcaggtagttataacaccagaatgatctgttaagagaggtttttaagactcagtccccatcattttaaaagagagaaaagaagactgttttgtctacaggtcccagacagtaactggccacaaagtctctcaaggcccctctgttccgtgactttatttaaattttcttttgttttgttttcaacactatgtagagaggaaaagcttcaggtggaatctatgctcatttctgtttgttctcatgcccaaagttcatgacatgcaaagcagaaacataaacaggaacattgctattttggtgtgattggcattttgacttggcatatttttggtgtgattggcatcttaaattggcctaatttttaaatgggaagacttccttggtagaaattaaccatggagtgaaaggtctctgtttcttctttctgtcttcggtacataaggacaaaacaaccagaaacctgaggacaaagcaacagcaatccaggtgaacatgtccactcacagcatacagacagtgacagctctgtgtgagtttcaagttgaacctacatcaaccgtttttattcttttctaggtttacaattattttcaaattgcaaagtttatagagtttggtatataggagattctatctagatttcatatagtggtagggggctatttccttatgattttaaaaactggagttctttcagaaattatggctcagatatgcacacaatatatttttatttctattaaatggtcacaaattgaagattttttaatactattgttggttaaatgaacaatgtttaagcaatttcgatagtcaatattctcactgtgattttttgcagtgctttattttctaaaaatgtatctttgtgtgactacaattcaagagcattgtactcttaagtcagtgagagtggagaatgatcagtgatggttatagtttgttttatcaagacagctcgtgggagatggtaatgggaattcccctagctacttttgtttatttttatctcccttgtcattttcaatatggaggatttatgtggggaatttagtgttattactttaaaattgatcttcagaaagataaagcaaaaatcatttggggtttggcaaaacattttattagaaaagaagagaaaatatttccagcaaatacgtgtagtagaaaccctcttggcttctttaccttaccatatgttgataggctagctgttgttcaaataatggcatgaaactactagataattgtcattggaaggataaatgtgccaatagaaagtagctgccctcaagaagcataaaacataagacacagcatggtattggtataaggcattttaagagcactctttagacaagtcattttgataatataatggggacattttgtcacatcttaaatatagttttttaattgcccaaggagtctcaatctattcctgagccttatccaaatggtatttttctacttagctgcctcagaatgcttcaccttgtcatcatagctacccaaaagaatgtgtcaatctcaccagctattcttttgaataaaggaaaataaactgaagtggcagtccagttttgctagtggaatgaagattgtattttatacatattaaaaagatgagttataatttctcccttaaattatgtttgttgccttgcatgcttctttctctaaagctgaaccatgatactaagtgcctggggaagggaagggcgggtatactgcccagaacacaaaggccttgttttgcttttgcatctcaaagccaactcttttgttctagtcttcagcaaagaaattattttgaaatattgcctttgttagaaagaaatagatgttctgaattatgtgagatctattaacatatcaagaagtaagctagcatcacagaattcttcatagtgtagatctaacactctttctatcatgaagggtgagccatgtttctctgggaagaaaagacatgtgatgtaggggaggtccattgagccactcctcaggaattatttataaaaaacagagagaagttgaagcagaactttaaaagctgagcttatgtctgaaatgcactgttcaaaactaaaaggaaattaatttagaaatgactgtttccaaattgaatttccaaatgttaagctagttcctcaatcatttctgcctcagactatattttctttgtactcttgaggataagtaaattgtaaatcactatccccttttacagtgatgcagtatgaactgaggcaagctgttctgtctctggtttctgattattttaatctgtaatatgacgtgtgtgtgtgtgtgtgtgtgtgtgtgtgtgtatgtttgtgtctgggtctgtctgcttgtttgtgtttgtttgtgtgtgtgtgtttactggatgtgttctagattatcttctttgtattagttttcttgggctgccataacaaaagctcatagactcagtggcttagacaacataaatatactttctggaagtccaacatcagtttcttctgggttttctggtaagagctctgttactggcttataaatggctgccatcttatgtcctcacatggccttcccttggtgccttactgcacgcaaaagaagagagcttgagctctctggtatctatctattcacatatttttttttagacagagtcttgctttgccgctcaggctggagtgcagtggcgtgatcttggcacactgcaccctctgccttcccagttcaagcgattctccttcctcagcctccagattaactgggagtacaggtgagtgccaccatgcctggctaatttttgttattttaatagagacggaatttcatcatgttggccaggctggtctcaaactcctgacttcagtgatccacccacctcccaaagtgttgagattacaggcatgagccaccactcccagacatctattcttttaaggataccagtcctatcagaccaaggcatcatttaaccataatttaaccatctcttccttagaggcaccatctcccaagtatagccacgcaagaggttcggacttcaacatacaaaatttggagagcctcaaacattttgtctataacaccttcaaacctaaaattttgtattcaacatataacatgacgttaagtcaatcccatttttatatgatcaaattggctataaatagcatctatgtctaagttcaaaaccttattaaaaccttgcctgcctactaatgctaagtgcttgtgttttatacctttacactctatactttcactattatgtttttcaaatttataactagcagaatcaaacttacaattgctaaaggaaagataatttaatggagagattcaggggtatatcaagacctaaagctctctttcctaatttgtactttattcctttctctttgaacggatattttctctgcactacttataaagatggcagaaaatgacaagctcgtccatgagcctacattatctcccagtcatagtgcctgtgatcacgtcactgatgtctattgtctttgtacagagggactgtgaaggtacacaccaggggttcttcctggcacaacctctgtgtagatagaggtgacaaaaacaaggcaacacaaccttggagatccatcatgctgctggaggagcatttcctggggaaaaaaaggagtcttactgcaaagatactttatactctgcccattaaaattgcactggatttgattaatgatgcaagtttcaaattaaaaatgaaattaatttgtagattttataattgataggtaataactaatcagatgtagtaactgctctataatcataaagtgtgcatatggaatgacagatcaattttcatcagtgtggtcttattgatattttaaatttattttgataaatctctaaagcaataaaaacattttgtctgaaacatttcttaatgactactctgcacagaatgtataatatgaagtaacttaattacttttgaagaaaggcaaagttcactttcatgtaattttagaatagggataaaataaactttttcatattaatgaagaactccattacctgcccctaaaatgattaaaccttgacataagttttcaaatttagcttcattttagaataataagaactagaaataaatatatttataaactagatgataactatatgcagcaaggtttctttgaatacagtatcaaaattcctggttatagaaagcaagccagctaaaattcaaaaggaatgcaaaagccataaaataaaatagccatttaaaatatttaatgaagtgtgaacaaagctcatgtgctttaaattgctgtccctttcattaatttcttctctaaagcctaaacaattaagctgaaatgttagaaatcatcacaaaatttaaatagcactttggggaatgatgtgttttgaaggaggtgttattgcataagaactgcaaacatgaaaataattttatctcatcacagcaagttagatgcgtgttctatatagaatggtaaaaagagaaaaaggaaatgttaatgcaattacaggcaacaggaaccattacaaatatgcatgttcttataagagaagctggctaatacaggctcctattttagaatctcagagtttttaaaatgctaaatgaagttgataggaaaacaaaataggtacaacatatccaggtgacttttttaaacctatctctgtggttactactgtgccactctattctagagaaaaacaagtaaattagcttgctcttcttaaaaacttttaatggtggaataatataaaaatgtataaaaattgaaggaagttgtccagcatgaacaaatgctggacatttgttcatgtccagcattgccagtaaaaaatattggcatctaaaatgtttaatgattactggcaaagattagagaagcttctctcaggatgggatctgtgggtctcctgccactgccttctccctttcaatatggtattatgcttagaatgtttctcagcactttattatttaggaacatttatctactttatgtggattttcaatatttttgtttctaaaatttagaatattattgtaatcagcctcagtggtcgactcacttatttactgctctcctggacatgtgcatgggtggctgtcccctccactcttcagtttcctgtttcctttgttcagaaggagctttcctggtgccttcatctagagcagcgctagagcagcactgtttctcgcgcctcttccttgtgctgtgctattattccttatgttgctcatcactactttagctgagttgtgaatctgtttgtttatggcatgtctcctccattagaatgtaaactccaagagaacagggaactttaatctctttcccactccctgttcaatatttagaataatgcctagtaagttgttgttgctcaataaatctttgctgaataaaaggctaaataagtaaatccatatcatcgatttgaaattgcacatttgtcatatgtctatctgcatgccgatagtttttagagtctctttttctttcagatctatttttgaatactatattgtgttcatcaatattactttaaaatacactttcatacttaaaaaagcaaagagcaaggagctcctcatttccttgccacttcaaatacattctgactattctatatttattttccaggaggagctttagaataaatctgtcagattccaatgaacctctcattcattaaactaaatttataaatgaatttgcctctttcaatattgtcttctaattccagatcaagactagcattaccctttttctcatttatttttatgtctattggattagttctgtagttttctatgtaggtcttttgcaattcaagttaggatattgttatgatgttttttctactttttaatatgatcccttttacaatatttttctctgactatagaaatatctttattttaagatagattataactgatcacctaatcaaaatctaatttaaatacataattttatttgtctgttattctttcaagatagactatcataccaaatgttggtaatcttgctttctcttttctaatttttagatttttaattttatgtccatattgaaatacattggaaaggactcccagaagaatactaaatactaatgatgatgacgatgatccttgttttgttcctgacttgaatgagaatgctactagtgttatcaatacacataacatacatagtcctggctattagttggtgggatgaacaaaaaaatacacaaagattcagtcaaagataaggatatgaaatgattatcttttgttctacaaattatgtatttgtgctatctttgttaagttttcctttcagaattctgttgattctgcaaaataaattggcaagaatcctaaccttggatggttttaatagtatataaacattgacagcttgaaatttggtctcaatctggccttttgaggtaagaaggtgtaattctttggtaattaaaatcgtccacctttaataatatttaatgcacacctcttttaaattaaacgatgtttactagtgtggcattaagcaggcaggacaattacctgaattttctaattactttttgttggttgtggggtaagatgtctttagtgaagtattttcatcttttgtagtcagcacatatttccagcctatcgttctcataattggatgttgattttttcataatttcttccagttcctgtgtcattgtactgttctgaagaaggatagttgaatgtcagattccaccatcttattacactttagattgaaatactctctaccagatagttctcaaaatttaagatattaatctgttgttcatatttttagcattgatgaacttttcttctctaatttgttctttttagtcattttaatcagtttctgagaatggatcaaatgagggaaaaaaaacagtgtaaacttacaatttaccctatccttcttggatatcagtatatgatatgatatattaataacataaatcttatatgatattaatacatcttataaatcaagtggaaaaacatatcctgattcacaagtgatgcaaaaagttcttgggatatagtataaaataacaacccaaattttctcctgtaggtaatttatttttcatcaactgagttcaagatatgacaacatttcaagttacataaatatattcctcaagcatatctagcagatttataacactgtttttggaaaataaatgactaataagtttatcacctctgagacttagtgtaatgattgctactacattctttcattttctgtttctcttctctacaatcttttctacaacccataatcacacttaaatactcttaccatttgcaaataaacaagtggatgagcctttccctaatgcatctaccccacttctactgctgttctatcttccttctcttttctaccacacctcatcaaagggagggctgcttctaaagtcctaaagtttgactgctgctcttgccattgcattcaagtctgccccatctagccacaaatacatttccagttaccaactctgttttatgtttattgtcatcagacttcctcagctttagacatttgccattgtttatagtcctatcttttatgaaattctctcttctcattacttttacagctattaaccttcccacatcctcctcaataatccttccctcaaagtctttttctgtcaaacctcttctgcccacttctcaaatttttttttaactactattatgttgcacatacagagatacattatgttgtacattctgtcaactaaatattgctgtctttgtagtctgtggtcatcctaaatttaaaacacctgtaaaaaaattcataaattcatattctctgcttctagtcactgtttctcagttcaattaaggtcatcaatttcactcattatctgaagctgaaaatatcagaattacctaaaggaggaaacttgatctccttagcatactatatatgaccctctagagcctgaccacacactacatttccaggctttctgtcaccccagcctcactgcacattcttatcatgctcttccagtcttcatcctcatgcattcttacacatcgatatattttactttgttcttctcttgtcctgaaacgaattttccattcttctatatatgaaaaaacgttactcagacattagattgcagttcacatataatctcatcctcataattggcattttgttctctatgatccaccattcttggacatgttaccattttagaactaattatattagtatttattgttactgatgcctttttctctcttctccctactcaccccctgccccatatacacctgaatgtgctctttgttagggaaggaataatatctaatgtgatcgtattatataaacaacaaagttttgctaaataataagcataaagaaggatgggggaaaggcaagcatttattcctataggttactatagactaaaactttgactaatctaatactgattttgattgtatattgtatcaaacacgacatattatggttgtctgcagcagtataaatagttttctagggctaagttttaatgaatttgtattctttgaggtttcatgactgtcagtaaccagggacatccctgtgatattttggatagtagaaggatcttattctgcttaaaatgtggtacagaacattccacaaaatagataagtaaatgaatgaattatgaggatgaggatatggaaatcctcaaaagagcttaaaatgttcattttatcttcatatctctataatgtaagctgttcaaatgactttaaaaagtcattaagttaaaactaaggacatggtaggggagaagtttgttaaagtttgccactgtgttggtaagaaagccaaagatgagatctcacactccattttctggctctcatcagtccgtcttgctgctaaatgcatgctgagttattacttataaaaaagttacaaatggcagtaggttaaggaacataaaggaaaaaaatgtcaaaaaataggaagtatcagaacgtttttaaaagttgcttgaactctgtcctgggagcagctgttactaaggctccaacaggaggaaaagatgttattagcaaaaaaaaaaaaattacaaagttctaaaatgtatagaatatgaaaggtgatgtagcagccgtggcactattattgtcagacttggcaacaataccccagaagtctggaaaaggggaaaaaaaaggttcaaaatagcatcctaaagataaaatgtttaaaaatacctcagtgggactggagagaacaaaagaccaaagatgcatggggtaggagtgtgcagacgctgccacagtgctcctataagcacatcatcccagtcagggaagcatgcgtggcagcctgaggaggtggcagtgacaaagttggatttcactgagcaaaggcaaaaagcttgtgcattcagaaacaagatcaccagtgatgcctgtggaacccgcagagctgtgtgaacggggaactcagggcaggatcaggcaggatgtaacaaaaataggattgggtaggatgagtgatgagtagatgaagttgaaagtcagaagtacaggaaaaaaatagaactcacctggagtgttgtttaccctttcatccaatgaaagaaaatggctacatcccatgtcagaaatcccataaaggaataaagactcagtggagtaattgtccttttacatagcagaatctgtgggtctgaagctgctagtctccttacttctgtctctatctcctgcaccagtggggtcacaggtatgctttctagccactaatgaaatatccatttttatcttttctccagagcagtcagcttacagggtggccagattataagagaattaccagaactccgtggctgaagtaggggaagagatgagggaggactcaaaataacacttagggtgattatgggggtgactgtgataggttgggtatagagggaatgatctcatcgacaccctgatgtgcttagagatctcttcattgtcagatcttatggctcttttcttgccttagttctccttaatatttctgtagcactggacacccttacctaaacttttccttcttgaaatgctctccttttctatatttcttggtatccgattttaagttccatagggcagtgatcatgactgtcttactcaccacagtacttcacagaatgccttcctgcttgcctgagtggatgaatacatgaatgaatgaatgaatgaatgaatgacagttgagccatcttcctcactattcctttctattttctctgacacctaattttcagcttactcaagttaacagatttagctagcaatgggtttctgggaaagaaaaaataataaagttatcgatatacaattttgcttgcaggtgtgtgtctgtgtgtgtgtgtgtgtgtctgtgtgtctgtgtgtgtgataagaatttacgtagactctctacctaaagtatccctgctatatgactgtgtccaaaatgtatgtctccaacaaaagtggtcaagtcacctactgaatatagctatgtacttttaattaactgttcacagtggtcgttctttttcttcaattcaattttaagcaatttgaggaatgaggctaaagatcatttttctttttttttcgattttcctttcttttttttaattattattatactttaagttttagggtacatgtgcacaatctgcaggttagttacatatgtatacatgtgccatgctggtgtgctgcacccattaactcgtcatttagcattaggtgtatctcctaatgctatccctcccccctccccccaccccaaaacagtccccagagtgtgacattacccttcctgtgtccatgtgttctcattgttcaattcccacctctgagtgagaacatgaggtgtttggttttttgtccttgtgatagtttactgagaatgatgatttcccatttcatccatgtccctacaaaggacatgaactcatcattttttatggctgcatagtattccatggtgtatatgtgccacattttcttaatccagtctatcattgttggacatttgggttggctccaagtctttgctattgtgaatagtgccgcaataaacatatatgtgcatgtgtctttatagcagcatgatttatagtcctttgggtatatacccagtaatgggatggctgggtcaaatggtatttctagttctagatccctgaggaatcgccacactgacttccacaatggttgaagtagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggtcagtgatggtgagcattttttcatgtgtcttttggctgcataaatgtcttcttttgagaagtgtctgttcatatcctttgcccactttttgatggggttgtttgtttttttcttgtaaatttgtttgagttctttgtagattctggatattagccctttgtcagatgagtaggttgtgaaaattttctcccattctgtaggttgcctgttcactctgatggtagtttcttttgctgtgcagaagctctttagtttaattagatcccatttgtcaattttggcttttgttgtcattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcagctgtgtcaaagatcagatagttttagatatgcggcgttatttctgagggctctgttctgttccattggtctatatctctgttttggcaacagtagcatgctgttttggttactgtagccttgtagtataatttgaagtcaggtagcgtgatgcctccagctttgttcttttggcttaggattgacttggcgatgcgggctcttttttggttccatatgaacattaaagtagttttttccaattctgtgaagaaagtcattggtagcttcaaagtgatttttcttttctttaccccttaggaactaatacagagctgatcagtaagtatttgctgattaatcaattgctgggaaacaggttacttattttagcttaaaaattatttactgtttgagaaaattgtatttgctttcccttaaattcaggcaaataaatagactaaaaccataatcaggtaccaggaaagacactgacttgcctctattacagtacttctggaattcaaaggcctgttgtgctggtaaagaaggctgtttttaacagtatttgcttattcaactaaaaaacatgctggatggctcttctgagcttcatactagagataaagtaaggaattcgatagtttgatctctcctgacatgggacatgtagattagtgggaggcaaaatatggttcagaaaccaagtaaatgagatatttacgaaactggagttctatcaatgtaacacaacatatagtaaatggaaagactgaagtcttagtcaattcaagttgccatggcaaattacgatagagtggttggctactaaactacagaaatttatttttcacagttttggaggttggaagtccaagataatggtgacagcatggttgggttctggaagtgggggcttgcttcctggtttaccgatggccttcttgctttgctctcaagtggtggagagcagagagcggaagcaaactctcatgtccattcttatcacagcaccaattccattcataagggctctgccctcatgatctaattacctcccaggggatccacctcataataccatcctattggggattaatatttcaacatatgaatgttgcaggggtcccaaacattcattccgttgcaacttagttagggttttcaagaagcacctatttaggaagataacattaaagttgagacttggagggcggttccaagatggccaaataggaacagctccagtctacagctcccagcgtgagcaacgcagaagatgaaggatttctgcatttccagctgaggtactgggttcatctactggggagtgttggaaagtgggtgcaggacagtgggtgcagtgcaccgagtgtgatccgaggcaaggcgaggcattgcctcacctggggcaaggggtaagggaattccctttcctagccaaggaaaggggtgacagatggcacctggaaaatcgggtcactcccaccctaacactgcgcttttccaatggtcttagcaaacggcacaccaggatattatatcccgtgcctggctcggagggtcctatgcccatggagccttgctcattgctagcacagcagtctgaaatcaagctgcaaggcagcagtgaggctgggggaggggcgcctgccattgctgaggtttgagtaggtaaacaaagcggccgggaagctcgaacttggtggagcccaccacagatgaaggaggtctgcctgcctttgtagactccacctctgggggcagggcatagccaaacaaaagacagaagaaacctctgcagacttaaatgtccctgtctgacagcttggaagacagtagtcattctcccagcacgcagctggagatctgagaacggacagactggcttttcaagtgggtccctgacacccaagtagcctaactgggaggcccccccaagtaggggcagactgacacctcacatggctgggtactcctctgagacaaaacttccagaggaacgatcacgcagcaacatttactgttcactgatattcgctgttctgcagcctccgctgctgatacccaggcaaacagggtctggagtggacctccagcaaactccaacagacctgcacctgagggttctgactgttagaaggaaaactaaaaaacagaaaggacatccacaccaaaatcccatctgtacatcaccatcatcaaagaccaaaggtaggtaaaaccgcaaagatggggaaaaaacagagcagaaaaactgaaaattctaaaactcagagtgtctctcctcctccaaaggaatgcagctcctcaccaacaatggaagaaagctggacggataatgactttgacgagctgagagaagaaggcttcagacaatcaaacttctctgagctaaaggaggaagtttgaacccatggcaaagaagttaaaaaccttgaaaacagattagacgaatggataactagaataaccaatgcaaagaagtccttaaaggacctgatggagctgaaaaccatggcatgagaactacgtgacgaatgcacaagcttcagtagctgatttgatcaactggaagaaaaggtatcggtgatggaagatcaaatgaacgaaatgaagcgagaagagaagtttagagaaaaagaataaaaagaaacaaacaaagcctccaagaaatacgggactatgtgaaaagaccaaatctatgtctgattggtgtacctgaaagtgacggggagaatggaaccaagttggaaaacactctgcaggatgttatccaggagagcttccccaatctagcaaggcaggccaacattcaaattcaggaaatacagagaactccacaaagatactgttcgagaagagcaactccaagacacataattgtcagattcaccaaagttgaaatgaaggaaaaaatgttaagggttgccagagagaaaggtcgggttacccacaaagggaagcccatcagactagcagctgatctctcggcagaaactctacaagccagaagagagtggggaccaatattcaacattcttaaagaaaagaattttcaagccagaatttcatatccagccaaactaagcttcataagtgaaggagaaataaaatactttacagacaagcaaatgctgagagattttgtcaccaccaggcctgccttaaaagagctcctgaaggaagcactaaacacggaaagaaacaactggtaccagccactgcaaaaacatgtcaaattgtaaagaccgtcgaggctaggaagaaactgcatcaactaacgagcaaaataaccagctaacatcataatgacaggatcaaattcacacataacaatattaacgttcaatgtaaatgggctaaatgctccaattaaaagacacaaactggcaaattggataaagagtcaagacccatcagtgtgctctattcaggagacccatctcacatacagagacacatataggctcaaaataaaaggatggaggaagatctaccaagcaaatggaaaacaaaaaaaggcaggggttgcaatcctagcctctaataaaacagactgtaaaccaacaaacatcgaaagagacaaagaaggccattacataatagtaaagggatcaattcaacaagaagagctaactatcctaaatatatatgcatgcaatacaggagcacccagattcataaagcaagtccttagagacctacaaagagacttagactcccacacaataataatgggagactttaacaccccactgtcaacattagacagatcaacgagacagaaagttaacaaggatacccaggaattgaactcagctctgcaccaagcgggcctaaaagacacctacagaactctccaccccaaatcaacagaatatacattcttctcagcaccacaccacattcattccaaaattgaccacatagttggaagtaaagctctcctcagcaaatgtaaaagaacagaaattataacaaactgtctctcagaccacagtgcaatcaaactagaactcaggattaagaaactcactcaaaacagctcaactacatggaaactgaacaacctgctcctgaatgactactggatacataacgaaatgaaggcagaaataaagatgttctttgaaaccaacaagaacaaagacacaacataccagaatctctgggacacatttaaagcagtgtgtagagggaaatttatagcagtaaatgcccacaagagaaagcaggaaagatctaaaattgacaccctaacatcacaattaaaagagctagagaagcaaaagcaaacacattcaaaagctagcagaaggcaagaaataactaagatcagagcagaactgaaggaaatagagacacaaaaaacctttcaaaaaatcaattaatccaggagctggttttttgaaaagatcaacaaaattgatagaccgctagcaagactaataaagaaaaaaagagagaagaatcaaatagactcaataaaaaaatgataaaggggatatcaccactgatcccacagaaatacaaactactatcagagaatactataaacaccactacgcaaataaactagaaaatctagaagaaatggataaattcctcgacacatacaccctcccaagactaaaccaggaagaagttgaatctctgaatagaccaataacaggctctgaaattgaggcaataattaatagcttcccaaccaaaaaaatccaggaccagacagattcacagccgaattctaccagaggtacaaggaagagctggtaccattccttctgaaactattccaatcaatagaaaaagagggaatcctccctaactcattttatgagggcagcatcatcctcataccaaaacctggcagagacacaacaacaacaaaaaagagaattttagaccaatatccctgatgaacatcgatgcaaaaatcctcaataaaatactggcaaactgaatccagcaacacatcaaaaagcttatccaccatgatcaagtgggcttcatcctgggatgcaaggcttgttcaacatatgcaaatcaataaacgtaatccagcatataaacagaagcgaagaaaaaaaacacatgattatctcaatagatgcagaaaagtccattgacaaaattcaacagcccttcatgctaaaaactcttaataaattaggtatcgatgggacatatctcaaaataataagagctatctatgacaaacccacagccaatatcatactgaatgggcaaaaactggaagcattccctttgaaaactggcacaagacagggatgccctctctcacagctcctattcaacataatgttggaagttctggccagggcaatcaggcaggagaaggaaataaagggtattcaattaggaaaagaggaagtcaaattgtccctgtttgcagatgttataattgtatatctagaaaaccctattgtttcagcccaaaatctctttaagctgataagcaacttcagcaaagtctcaggatacaaaatcaatgtgcaaaaatcaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatattcatgggtaggaagaatcaatatcctgaaaatggccatactgcccaaggtaatttatagattcaatgccatccccatcaagctaccaatgactttcttcacagaattggaaaaaactactttaaagttcatatggaaccaaaaaagagcctgcattgccaagtcaatccttagccaaaagaacaaagctggagtcttcacacttcctgatttcagactatacttcaaggctgcagtaaccaaaacagcatggtactggtaccaaaacagagatatagaccaatggaatagaacagagccctcaggaataaagccacacatctacaactatctgatctttgacaaacctgacaaaaacaagaaatgaagaaaggattccctatttaataaatggtgctgggaaaactggctagccatatgtagaaagctgaaactggatcccttccttacaccttacacaaaaattaattcaagatagattaaagacttaaatgttggacctaaaaccataaaaactcgagaagaaaacctaggcaataccattcaagacataggcatgagcaaggacatcatgtctaaaacaccaaaagcaatgacaacaaaagttaaaattgacaaatgggatctaatcaaactaaagagcttctgcacagcaaaagaaactaccatcagagtgaacaggcaacctacaaaatcggagaaaatttttgcaatctactcatctgacaaagggctaatatccagaatctaaaaagaactcaaacaaatttacaagaaaaaaacaaacaaccccatgaaaaagtgggcaaaggacatgaacagacacttctcaaaagaagacatttatgcagccaaaagacacatgaaaaaatgctcaccatcactgaccatcagagaaatgcaaatcaaaaccacaatgagataccatctcttaccagttagaatggcaatcattaaaaagtcaggaaacaacaggtgctggagaagatctggagaaataggaacagttttacactgttggtgggacggtaaactagctcaaccattgtggaagtcagtgtggcaattcctcagggatctagaactagaaatatcatttgacccagccatcccattactgggtatatacccaaaggattataaatcatgctgctataaagacacatgcacacatatgtttattgcggcactattcacaatagcaaagacttggatccaacccaaatgtccaacaatgatagactgcataaagaaaatgtggcacatatacaccatggaatactatgcagccataaaaactgatgagttcgtgtcctttgtacggacatggaggaagctggaaaccatcattctcagcaaactatcacaaggacaaaaaaccaaacaccgcatgttgtcactcataggtgggaattgaacaatgagaacacgtggacacaggaaggggaacatgacacactgggccctgttgtagggtgggggaaagagggtgggatagcattaggagatatacctaatgtaaatgacgagttaatgggtgcagcacactaacatggcacatgtatacatatgtaacaaacctgcatgttgtgcacatgtactctgaaacttaaagtataataaaaaaaactgaaaaaattatgaagttgaaacttgaaggattaataactagtcattaaaaacaaataacagaagtggagcttgtgggaaaaaaaagcaacctgggtatatgttttgaggcatagaagagaacttgatgtatgctgggacctaagaggacctgagaatgctcaagggaatgatgccacaaggtaagggtggagagatgtacacagcaaggttataataaagctgcttggcattggtaaagaatctagattggatttggaatgtgatgtgaagcctttgagacctttaagctagagaatcacatgacttaaattatgtcttagaaaagaccactctgttatatttctggtattatgggctcaggcagtaaattagaggtgtttgggttaaattgtatgttgagaccattcattttgtgaaagcatgcattctagggttatttggtcttagagcatgttttgcaaaggcatcactgcatttggaatcaagacacctgtgtttaaattatgcctgtctctatgtctatgtaggtgacgctgtgcaaaccactactttagtttttggtttcttaaacactgctagggtggattttatcccaatgactcttaaagtcccttcaagcaccataactatataaacctattcacatatttgtgtgccaatcacacatatattgtgccaattagacctatttagagaatgcccagaaaataaccccaatattgcctacgcctgtctggagacagctaacaaatctctgaacattggtctttgcccatgaaaaaaacagcaatataatttataaatattatgtcataataagtacaggatttataattgagaatgttttactctaattctgattattctgaccttttattcaccaaccatcttttgaatgtccagtgtatatattaactgtgctaaatgccatggctatgtagatagtataagacaaaatatgtgatccttacaagtaactagagaaatgaaaaagactgaaaaagactgacctgggaacatatgatgacaatatactgtgattgttgtgtgaaaatgtggactaagtgtcctgaaaatccaggagagaggcaagcagtttgcctaaggagacagcagtgacgtttataaggctaggtctgtcattttacttcttggctcagtttctccttcatttcaaatgctagatttaggaaagcttaaactgagtagtcttcttttaaaataacatctttactgatatataatctacatactataaaattcgctgtatgaaagtgtgcagttcactggtttttagtttattcacaaagttgtgcaaccttcaccactatgtaattgcagtacattttcatcacctcaaaaagaaaacccatacttattagcaattgttccccatgtattttacacctaatccttggtaaccactaatctactttctgtctctgtggatttgctgaacctagacatgtcacataaatggaatcacacaatatatggtcttttatgactgacttgttttcacttagtgtattagtccattctcacactgctaataaagacatactcgagactgggtaatttataaagcaaagaggtttgattgacttacagttcagcatggctggggaggcctcaggaaacttataatcatggtggaaagggaagcaaacatgtccttcacatgacaggaagagaagtgagtggcaagtgaagggggaagccccttataaaaccattagatcttgtgagaactcactcactattaggagaacagcatggcagaaaccacccccatgattcagttatctccatctggtccctcctatgacacgtggggattatggaaactacaattcaagatgagatttgggtgggacaccgccaaaccatatcatttagcataatctttcaaggttcatccttgatgttgcatggagcatatataaatatttcattcttttttattgctggataatattccattgtatggatataccacttttatttatccggacatcagttgttggacatttgggttatttccacttcttggctatcataaataatgttgctatgaacattcatgtataggtttttgtgtaggcatttgttttcaattttttttgatgtataaatagtcatgtggtaactctatgtttaacattttgtggaactgaaaagccgttttccaaagtgactgcatcactttataatcccacaggctatgaatgagttatctaatttttccacatccttgccttgtcattatcagtgatcttgattttagctatcttagtgggtgtgaagtgatatctcattgtggtttttatttgcaaatcgctaatgaataataaggtcaagcatcctttcatgatatatcctctttggagaaatatctaatcaaattccctgcctatttcttttccggctcagattttgtattaggttatttctctttttattattgtattatattgttaactgctagagtatagaaataaaagttgaatatcccttagccaaaatgcttgggaccagaagggttttgcattttgcatttttttttattttggaatatttgcatatagacaaggagataccttggggatgggatgaaagtctaaacatgaaattatttatatttcatatacacattatgcatatagcctgaaggtaattttatacaatatttgaaataattttttgcatgaaacaaagttttgcctgcgttttgactgcaacacatcacatgaggtcaggtgtgcaattttccaatgtggtattatgttggtgctcaaaaagtttttgatttttgagcattttgaatcttgaatttttggatcagggatgtccaaactgtataactgattttttgtatattgatcttatattcatcacccttgctgagcttgtttattaatcctaacaagttatttgtggcctgcttagaattttctatatagaagatcatgttatctgcaaataggaatagtattctttgttgctttccatcttttctggatatcttttatttatttttcttgcctaacttcccagcctacattctttagtacaattttttaacagaagtggtaagagcagacaatctggtcttgttaatgtcacaggggaaataacttaatatgtctctgctggccaggcgcggtggctcatgcctgtaatcccagcactttgggaggctgaggcaggcagatcacgaggtcaggagatcgagaccatcctggctaacatggtgaaaccctgtctctactaaaaatacaaaaaattagccgggcatgatggcgggtgcctgtagtcccagctacttgggaggctgaggcaggagaatggcatgaacccgggaggcagaggttgcagtgagccgagatcgcgccattgtactccaggctgggtgacagagcgagactctgtctcaaaaaagaaaaaagtatattaggtgcttctcatagaggacatttatcaaattgagaaagttctattttagtttactgattattttattatggaagatttggggttgtttcaaatgctttatctgcatcttttggatgaccgtgtggtttttatcttttattctatgaatgtgatatattaattaactttcagatgttaaaccaaccttgcattcctttgataagttatatttggtcatggtgtacataatcttttttacgtgtggctggatttagtttgctggtaatttgttgatgatttttttataaggggtattggtctgcagtttcctttttggatcatatgtttgtcttttgatgtcagggtagtattgttttttactctccatttcatttatttctgctcatgtctttattattgtcttccttccatttgcttttggtttagtttgctcttcttttttgaattccttctacaagctaccttctgggattttagtatttacagatactttgtttcttggggcagctggttttgaaggctgttgtagataggaagaaaggaatggaataagtgaaagtgaaaatagcataaaacatactgttctttccatcttattcagtatcttttcttgaataattgctccttggattgttgaaagcttgtggttaatttcaaaagttctcaaaaaattgattttgacaaattttgccagtgttcttattgcttttatggaggatataatttttgaaggcccttattttttattctagaagtgctttttttctgtagtcttcttttaactgtatttgacagaaagagaatgatctgcaatattttgaggagacagttgtacatttatgtgaacacaaagtagatgatgatatgatgtagatgagaattaaaattcccttcaatgcttataatagggagaataaaacattctgggtagtcagtttgtgagtatgtaccattgacatgggaccctggcaattcttatacagtgggaatcctgattatctttgctctggtgaggaaatggtaatgtgctaatagacataactaaaatatttcatattattagctgagttcagtccattaaatctttaaaagattgcctcttgagaaaagcgcatatgccaacacaccctgtagggtctactcatgatggcccgtggtatagacataggcagagacaacatgtgttcactacaactgatgtaagagaacatgcttccatctctttctcttagtgtttattccctatttttatccctgctctatcttaatatttacatattttgattcagttattaatacttaaatttcattttaatgggagcacattaaggctgaaatatattgccagtgaaaacagtggtaataataatttgctttttttgtaaataacacaaatgccattatggtagtttgataaaaactatactttgcttcttgagatggtatacagtgcctctgtagatgtgactctttccattttaccaattggatgtgaaagagacaaatttctttattttaaataagaaataatgcacacaatggagaactgatattaaaaataaagtaaggtaaaaacattagcatggtggatgtacacagtgcatcacaatggtggcatttgtttatttatttaaaaatatttcagagcatttattatgtattggaaactgttctggattctagagatacagtagtaaataagaaagataaattctgttaaggaagagtcatgataaatagatgcagtttaattttcaaaaatacttaaggagaaaattttcaaaataaagagaataggggcagggagtattgctgcaacatattgcaataatatgtaggtacccaagaaagggcttaactaagaaagtgacatttcagtaacaacctgaaagaattgtgtgtgagccattctgggcagaaggacatgcaagtgcaatatccacaaaatggaactgtgcctggatcactggggaggcatgtgtgcttgcagcagaatcaagaccaaagaggtttcaaagtggcagatctttattagccaatggaggcactttggattctgctttgtgtgaagtagggagacacttgaagagtttggcctgagaagtgatatgatctgaggtacctttgaaccatatcactgtagctgctgggctaaacaacccataagagtgcaggctagaaacaaggatattacttgagggctattgaagtaatatagatgagaggcaatgactttgctaagggtagtagcagcctaggttttaagtattagttgaattttagatatattttggaagtagaattgaaaggatttcctgacagataaaatatggagtgtaaggaaaaagagtcaagaataattaagtttttttggtctcaacaaacataaaaatggagtttccatttactgagatggggacgacttttaaagaaatggatttatgtgtttgtgtgtgtgtgttggtaggggtggaggttgaaatatcaatagcttgattttagacacgataaatctgaggtgcctattagacatcatagatggagttatagaataggcatttatatacacaaatctagagtttaggaagatgtctgagctggataaatatactgagagttatcaggatacagatgtcatttaaagccatgggctgggaagattaccaaggatgagagtattgggagaaaatagcaatgatcccaggtgtgagccgtgggacatttctccatttagaggctggagagaaaaacaggaaacccagagagtgtagtaacctggaagccagtgaagagtgtctcaaggaagacagtgagcagattaggattgagatttggccatttggttcagcaatatagaaataattgtttgattgagcagatattctccccaagaatgtaaaatttataatttcaaggaattatgtgccatatcttagactatagtgctcaacattttaatagatgttagaaaagatgctgagttggaatgcacaatcatagccattagggaagaaggcctccactggctttttagatgacctgcttgattagataagaaattgactaagaggcggcagtgtgattcctgccctgtgttgatgtatcatggagttgttttaagagaagtgcaaaccttatggctcttactatattttcatactaaaaattccttatgtggtattacttcatatttgaggtatgataactccaaacccataggatgaaaatacttatatgaattttgaatgaaatcagatttgtaggtgtttgtacatgtatacacgtgctgtcagtatagtgtaattggctttcaatttagaagtttatttaggcattaaactgttatatctgagatccctttatagattgcagtcaacacaaaccttggtcagcaaatgaggtcactaatatttactgtgttcacttgccagtgctcaagtgaggatcagataagaaaattaaaaggagaaaatcatgtgacattgtcatgttatgaataacatgtgacaatcttttcttacatataaaaacctttgcaggtgttatagcgatcactatagtaaaacccttttacattttctatttgagggaatttgtgatagagataatgcaaaacatagactaatcaaatgtggatttatattttggatttttgtaatgtaatttgaatggctgtagacttaacattctggaaaattatttcaccttgataatctgactaaaggaactaggaaattatttaaatatattttccctttcctgttcttcttggtttctgtgctgaatcttggctccgtgggaatgtgggtcctatgtctttggagggggatgagagtgatggcattttatcagtttagtttttgaagtctggttaattgtagtttttttccccacataggcatgtgaatttacatatattgtccagatagttggtcctaatgtggtattcaccattgtcttgtaagatccttgaggattgagggcatgtcttgttttgccaagctataccagatattctataactctgagaactgatgtaacaccatcccaaagagcttaggcttcagaggcagaaaactggggttcaaatcctgctctgtcacttccacaacaagtcactcaacttctcagagtgttttcttatttgacaataacagtaattacacttatttggaataacatatcaaagttagttctacatatagtcagttcttactctttttaatatagcagtcaattagtattaattaataattgctactaatactataatgataacattctatgatgcaagtttgtcctaccttctttagaggtactggagataataaggtgtctgcattgcaaaatccttttcaaatagtctgcacaatagccgaagtaaacccttaaaatcacatagtttttcctgcttaaaacctattggtgttatctttgtaaaaacatcttcacttgtttggaaagccatgttctaaacccaagcccttggcccactcagcctctttgcaccatgtaccagcagcccttgccttctgctgctttcttatgccaaagtcctttatgcctcagggtcactgcctcctaggggtcttctcactctccttccttcactacatctgttggtcaattcctgctctccttttatttctccatttgcagtgcacttgatatttcaatggtatttgatggtttgtggctggagaagtcagaaatgttggactattcttcccatgaaattctcaaagaacaataatatatggcaaagaactactgtctctttagtgggatagtgctgggaactcgcaaagagtactttggtgaagcaagttggagaacatggcttagactggataaaagagtgcaagtaagatgcccagactccaacaaggaatctgactgaatttacccacattttaaatgtgagcattcttttctgaaactaaaccctgttagaatactagccactcttttaatatgttatcactgagtacctgctatatgtgatactgtactgattactgtatctgttttattttaattccaagatattccatattcattttctaactaaagttgtagtgaatgtgatagaatagatgattcactcactctctaatttggctacattcataagaacatgcccatagatagataaaagttaatgatcttgccccatatttcatcataaagagttggctcactttagattgaaattgtctcttacttctccctctaagaaggcattctatgtgagaccataatttttttaaacaataatcttaataaatgtgtttccttctgttgaaattaaagaattcacatgtttgtactgaaataaattgttgtttagtgcaaatatactagaagctttcaaaatgtgattataggggctttgggtattgaagctgacagttgttgatgaacagtatttgccagtgatatactcaatttggtatacaacaactctttaaacatttatcagatctatactattttccatatgcttggagtatacaagggtaaatatgatgcaatccctgtccttgaggtccttatctagatgaacagataatagcagcagcatgtagtaagttatgtgtaaaacttaagcccagtatacctggtgcacgaagaaagaacacagtgtcagttggggttatatttgtcttggagtagtaataacaacagaataccccaaataacaagatcaaaatttatttttctctcaggtctaacaaggtatagtaggaattgtgtggtgcctcaccaggtccagagctcaggcttctctcctgtcctgttactctcctgtttgtggctttcattcccaagttttctcatggtcccaagtggctgctggtatacagataggtctgcatggagccatcagaaagcaggaaggggagaatgcagaattcaccctcacctttgaggagtaagtcccagaagttgtacatagtacattggcacgtatcccattgactaaaaagtggcccatggccatccatacctgcatatactgagagtttgaaaatacaatttttcttccaagcagttttatcctcaagtagaatgataggttatcttgttatgaaagagagaaagaatggatattaggggacaactaagtataataaaatcccacccagctaggagtgaaagtgaaaagaactatgaagtgttaataataaaatgataatattagtgtgtgatgttttaactttaagctatattgttttccaaaaaatatttacagaaaatttatagtttaattgaaaactcactgtaacttgcagccattgacagcaaaacgtttaagttgtttacacataaaggtggagcatgctgcaggggtatcttagcagttctcccaacaagatggagtcccctgttccccttgttcaaacttgggcgttatcattattatatttgccaaattattacatgtaaatgtttatgtgaatgtgaaaaacttataaggagagtaggtgatccacctttctaacatattctaatacattaggtacatttatattacatatttgttgtagtatagaagaaaaatattcaataccttagtgtatggttgttaacttcagacaaaatatgtaacctcattaagcattaaataattaggcaattagtgtcttaaatgctttacattatgcagaaaaccttggtgaattgttaagtatgtttaagaagattttagtcgtgttcgatgaaattggtttgagatttttggataggctttaaactctttatcatttttttcccatttaaaatattgaaacaaagactctctctatctgaaaacttactatcaaacccattttctggaacatattaggtgcaaataaagaggaatgcctctaatgaatgaatcctaaagcaggaggacacagtggggaggagactgactagaaaggcagaggctttattcataatgtattcttaatgtaatatgaatattgaaagatgatttttataagtgacattaaacacacacatccagatacacataaatgtacagattttagtcctttcattcccttacctttgactgcttactcgtgcatgagttctccatctgtggaaacagttgagaattgcaggctgtttctgtttggagtgatttttgaattattttgctttctacagagaaattcaacaaaggaaaaaaatagtcatttaatcttaactgggaagcttttcaatgtgatttaaattacccaaatcatgcaaaagactcatttacactctgaaagagcaagaaaaatattgttaaacgtttgatttgatagctaacatatacattttaggtctgatttatgatatagaacagtgtcatacttacgtgttgtaaataaatagcacagtagctttctaatgtaattgaagtttttaacacacttgatagttttaaataattcatatgtaattccaataacttaaattgttacaatattttgtagttgtagggtttttttgttattaaagtatctaaaattcactctcaagaaatctagatttacatatatttcctgtaggaaaatgtgtccttatttgataaaactttttttctagtcaatgtttaaaaaatagagaaagagaaaaactttcagtaagtatgatgttatttgagatatgggagacatagctttgtgatcttttttaatttgtaagttttttttcattcccatgctatttgtagctaagtcaagaatttcattgatttggattagacagaattgttacatagtatcgttgtactatgcaggtatcttgtttgtgtaaaatattgaaaccaaatttatttcatgctgaatttatagagatatttacttcatagagatatttacttcatagagatattaactcatagagatatttaaataaatacactttacatgtactaaatattatttaataagaatcaagtgttttgcacataatatgtttcagacactatactgaaaattttttgtaagctaacatggaaaggttgactccttcaaagacatgtccatctaggaggagaagactgtgtcttaatgaggtgaaactacaaagctttagtgtctcaataacttatcacaaaaatcagcctataaaacatgattttaatgtactaattagctttaaaggaaatctgcaggtgaacttacgaagcaaagttcctttacttgcctctcaagcatttctcttactacatctctctttctgcctactggttttttattttattttcttagctctttcttccttcttggcttctttgttcctcattgtaatgtatgcccatcttcttctgttcctagggtttctctacaaattctcatttttactcttattgtagttttctctagcaagatgcactcctacttctgaatctaatagactttgactttatcaaaatttacacatcatctcttagtcttagtctcttcatttgtgaaatggagatgccaatcctgacctcataaagttattatgaagattaaatgaaataatgaatgtaaagtgtttgacatatacaaggcactcaaataatatttgttatttgtattaaaatttagctcccaggatttcacctaatatcattgtcaatatatttagtcagcaatggcttctttacattttctcagttttcaggggtctgcagatgatcactaggctacaaataatatctccaccagctttcaacttaataaaaccaaaataacttaaagtaaaatgtaatacttacaaagcctactctataacaagcaaatattgggcactgtcccatatattatcaatttaagtctcatagtactttcctattttttctgaatagaatagtaataaattgaaatttagaacaactgacttgtccaatgtcacataaataatatattaaataatatatagtagagcagagatttgaactcaggattcttaaaatctgtgggtttttttttttttttttttttttgaggcagagtctctctgttgcccagcctggagtgcaatggcactatctcggctcagagcaacctccgcctcctgggttcaagcaattctccagcctcagcccccagagtagctgggactacaggcttctgccaccatacccggctaatttttgtatttttagtagagacagggtttcaccatgttggccaggctggtctcgaactcctgacctcaagtgatctgcccgtcttgctctcccaagtgctgggattacagacatgagccaccgcacctggccaaagtctgcgttccttttttgccacgtgctccttatatttgttttagacttttacagacatttgcttctttgagtttggtttttccccaaggatccttctttgtgatggtaagtagggcagcttcacactcacacatagtgtgaagaagtgaagggatttactcacataggtggaagagctgaaatttaaaaacaggttaatctacttcaatgtcctgcctctgctgcttctctaaaatgaagctagtagtttgcaaaatatttatatattgctagataatactcttaactataatgcgatataagtaatataccacacaccattattctacctataatggaatgtgtgtccatactgcacacatagtgcacacagttgcactaattttccaaaataatattttgtctagtagaactcccagttgagttgatggctaggacctttttgtactagttatctattgcttcactcgcataaattacccctaaatgtagtgtctcccaacaactataatcgtctcttgtatctcatggcttctataggtcaggaatttgagaaaaatttctatgagtggttcaggcttggattctttcatgaggttacagtcagatgttagctgatgctatattcaactaaagacttgactagtgctggaagattcgcttccaaagtgattcactgatatgactggcaacttggtgctagaaaaggtcatccttctacagatggatctctccatggagccacttgtgtatcctcccaagatggcagctaacctcctctagagcaagaaacccaagaaatcaaggcagaagctgcaatgtctttatgacccagacttagaaattgcatactgtcacttacttcatattttattagccttacagaccagccctgcgtcaatgcagagaaggcctacatagagcccgaattttacaggtgtggattttcagtggctatcttggaggttggctaccacatttcaagaaaaacagcaacattttattatttgttcagcatagagaggcagtgtattgggcctgaaagagcacagatgttgaatctgatggctctactttccacctcagatttatcacataccagctggtggcctatagtatattatatctaaattcccttttacaaaactttggtgattctttattgtcaattgaacaatgtataaacaccatagcctggcattgtagactcaaaaattctgtgcctaatgtattcttctcccccagcaccgcccccccccccaacttttttttttcaaactattctttttgactagggaagaatctaccaatgtggagtccatttgggtttttggaactcttcaaacctcacaaattatgtaaaataacatatataggaatatgtcctttgtttctagagaaatttgcccagatgttctaccattcctttcttctaggaacaacttaaatgaaaacttatacatgaaaaccttatctaatcaacagatagaaagatcatttccaccatcacctcacacaacccctcaaaaaattaaatagtattttgttttcactatgtagtggcactttttgtatactgccttgtatcaccattttataagttcatttcatatctcttcaaaaagcttttaaagcccttgagggcaaaagtcatttctaaattacttctgattctcccaagacttttgatcttctaattcaaataaaaagtgttcatattagaaaatttggaatgtatagaaaatcagatgggaaaatcattttcttccatcatctgcagtttaagctctaaattcagtgagaaaaatgaagaacaatacattaatgaattttaatcatgtgtgcatataaatatgaatgatttaaaatgtactaatatattaatattggcaaaattatttggacaggcaagactttttttattgtgtaatgtgaccccttaattttctatgcattctaagaccaaactggcattcttctggtttattggctgctacgcaaactcaatcttacatcggaaatagatgaacccggaacctgagcccaggaggccttgtggttcattagcctggaagacttgaattgccaaataggtcatgtggccctgtggctggggcaaacaatttttgcctctctgaaggggcaaccactagaatgagctatacaaaatgatcaatttgaccacatctctaccaccaaaactcttaaaaattaatatgacacatataacaggtacttcttgggaatgccctcagagaatgtaaataatatatatatatcaaagcagatttattatttgctgataacaatctaatataaatattccctttttacatgacctgtagttctatctccctatcaagttcttggaaatgaactaaaggaatactctacacttagaaatgtacacttgactctctcttcatttaaaacaacagccctaagaaatttccttggtctcagcctctttcatagatagcttcttactgtcataaagttatcacctgagactgtatcccatgctttaattaatccaataacaacagtttcaatttttatgggtttttttaatgggagtataggagaaattagaaactcaaggattatcagatatacattgcatgatttagattttggatacttatctaatagattttcatggtagcatcaataataatagtcttgattgttgtcttttgctattctgttgaggcattaagtatattggagacatccgttttcatttccatgtatatttgtttttgctcagtaagaacagtgtgcaaaattacttatctttagaattcagattaaagaaaagcctaatcaaactgatatgtaccaggttgtataggctatcaaattgttattaaatggagggaaacatattctgaattctgactggatgtgttaagtacaatgattatttgatttagccaagcagtcaacaataattggtcttacctagtaatgcaatattaatttagtaaaaagaatcatgtagcccagtgcaattcttaacacttttgtcataatatttctaatgtaacatttctaaaagaatatctcataagaaataaatatttagttatgtttgttaaactagtaaatatatagacctaagaagtctatgtaattatttggttactataacttaactatgtagatatttcttgtaaatatttaatttttaatatctgtaacaacctaagaatttgaaaatatattttgcagtgtgaaatttcatatataatttggaaatctagaatctgccagataggccaacaatggaagctgagtaatgtttgacagtcttgtcctaaatcaataccattttcaacatgatggaaaatgaaatgcttcctttttcagcttctgcattatcacattggtgatgagtcaacacacctttctaccaaactccctgctaaaaagacaaacgaaagcatggatgtctttcagttattttagttgaatttccttagattaaaataggatatttcttaaaatattttagagactaaaagtactcagaagtattcagaatacatatttattttaccaaacatacagactcttaaaatcatctggatgctgaaagaaaagtctgtgtaaagatggagattcaataaacatacatgtattgcgcaccttctgtgtgctcatctttcctttatattctgcagaaccagttggacactagctttacttatagtcagaaatgtgccataatggtactgaagaaaatggataatcaagttgttagacttttgtcttctcatatctgacattaaagtttttattgaagtttaaagagtttgcttggtaaccacagttcatgtaaaaagggaatatggaaaagagttttgcttggaaactctttaagcttcagtaaacaaaatccaagaggaatttttgctttattattttctatgatgtggcttgatcctatcacctctctttctgcattttacgtaccaaagtctcaataaaactattgaggtttttggtcaaatgcagcaaatatttggatcaaatgcagaaaaaatactttgtgatttttataagttagataagtagctctccatataattttcatgttaagttataaataatagtttctacatattatagtctgaatgtgtctcctcacaaatttatatgttgaaacttcattgccaatgtaagaggttgggcctttaggatgtgattaagtcatgaggaattagggccattacaaacgaggctgaatggagggaggtgccttgcccctctgacatgtaaggacacagcaagaaggtgacatccagaaggaacagggccctcaccagacactgaatttgttggcatcatgatattggacttcccagcctctagaactgtgagaaataaatttctgttatttataaattatccattatagaatattttgttatggaagtctgaacaggctaggactttctgcaagttagcaccaaaatctttgaagtagtgagatgaaggtgggagatggaggaataccaaaacatctgtcccatatgctcgaacactctagctcctggcattttattatctccaaaattaagatattaagcaattccaaagatgtagctaatgtaagttactgctgttatatttgttgagtgatgtcatacttaggcaaagcaggtagatacctcaattaacattgtcacataaaaagagaacatgtgagctaatgggaactagaaatggcatatttcaaagaagggacaagatgcatgtagagaacaatctagatacgatttggcctcgagaagtcacatgcaagtaaggacccgagatgccaaaggaagactaaaggaaatcaatgtcaaaagtttattcagggccagaccatgtcatagatatgaatgttctttaatttcaaaatatggaccagtgcttttcaatctttaatgaacatgcaaatcacctcagggttttagctaaaatgcagagtttgattcattaggatgtggtggtgcccaagattctgcatgtctaacaagcttcaggtaatgtgatgctgtgggtctttggactacattttgatgtggctattggttgctaaaattattttacttgattcagagagacttttccctctattagttaataaagagactttatctataattttagcagaatatacttttgaccttttatttttacttaagctgttgtagtgttaggactatcataatggatgtttgaaagtaatgtattaaaacataatggaatctagatgtgttatgttaaaatttataattgcagtgacatttctccatagttttttgcattaatttgccatgtcataggccatcatttatttctatgattataaaataacatgaattttaaaagatacactacacaattacattttaattattataataaacttgagatttagtttttaagtggaatttttaatgttatattcacttttctaaaattttaaatgatgtaaagaaatctttgaattcaaaatccatgtgatctttttaaacaaaacaattatgccatataaatagaaaggcaaaatttaagaaacattactttcaattgctaacttttatttccattctattttcaccaaaatagatcacagatcaaagaaagatttagttcaaactctctttgttttactcttctattgttaggaaagacggcacacaaagtaaagagcacagaaggaattgaaacatactttctatggatttttaactttggttctattatttgtctaccatccctttctaacaaatctcatgtgaaggctttgaggtcttcttgttagaataaaaacaagtaagtaaaataaatacaacacatggcatgacagtttttaacattatatcttgtaattatgaaactttcttttgcaaacctttagtttacctgtgatcactcccatgtgaccaaagattacacagatggtcataaatagcaataagaacaaactataagatgacagcttgaagctacattaaaagaagtgctaaaagaagagatatcacctctgattttctgtctgagggaagtgtggggattttagttccaccacttcctgtatatatttagcagtatataaatgattaaacaatacttctgtcagagcccctaccccattctttatatctcaactcatccacccaagaaagcattttcatttatagcttagaatagcagtttatgcttgagtataatttgctagtgattccaaataaggaagtgttattcttgcaactgggattaaaaatatagaaaatgtttctcaatataggaaagtaattatagaactcagattctcttgaattgatgtaaactaaaatccgggggaaatagttggataggaaaaaatttcatatgagtaaacactcagaaagcaataaaaacaaacctacggcattatggtccagcttctgaagtatgtggtggttaatgccaggcagaggtaaaagctcctctgaatgtcagtatgattcatttgtggtgaaatcctgaaatccttacatttcaacacctatttatttctatttagttctttatttatttattactcaaatatctattacttgaacatttattagatgcatagcaatatactctgtgttattaagggtgagaaaaagcagattagaagagaaaggttttgcctttgaagctgtaataatagagatggaaataataagcatacataaaataattagaatgcataagcaaggttttataatataatgtaaagtattggctttaagagaaaacaatgaggaatatattcaaggaagtcttcttgtagagggtcatactggagactaatgatgcatttatatcaggggaaaggaaggaatgcagagtctaaagaacataagcaaagttgtataggagagagtgagaggtgtgtgtgtgtaggggtgtgtgtttgtggggaggtatgtatgcatggaaatgtgtgcatgtgtgtgggtatttccgtgtggccttagaaacaatgaatcacccgtaattaaacagaaagaatggaatgtgtgagaggactaaaaatacagcaagaactgattcattgtcagttaaaagtactgtcttccacagttgtttcatgtgtgaatttccagactcctcaaatagactttagcttcctggagctctctctgcagtactcacattatactgatatatatgggtttaagtttggcttgtcctagagtactgggctctttcattttagctggaaatgaatggtatctgggagagaagacaggatacccctggcacatcatggatttatatttattcatgagggtttgtttaagaggagttctgtctgtataaatcctctgtaaataaaaatgctctattgcatttcaatcagatttcacccccactccttaagaagaaatgtagaattttaaaaaataaaatgtgtaaaataaattcacaatgggaagcagaccacggaagagtggtatctgaataaaagatcttgtatgtaaaattctatgatctatatgtctgattatttctaccctctatctcacatgaccacttatgcatttattcagaaggatctacgtgcccttatgagtggcataactcctattctcaaatagcatttgccttgtaggggaaaacagacatgtggacacctaactcaatctaataagacactggctatgtgggagtactgaagggtatataaaaagtaccagggagttctaaagaagaaataactagccaggcctgcagggatttatgcagatgggatgacaaaagactgagaaagatttgcagaggagggacactggaattgggtcctaaaagatatgtagacatttttcaggaagtgaagaagaaaatgaacattccaggcttgcctgaccctcccgtttctttgtaactggatgttgcattttccagaattcatctttgtattctttgttcaccttagatctacagttcaaaaaacaaaatcacggctgcctagttaccttctgttcactaaccatccaaattaaagccctcttgacaagttgcatgttacagtatgctgacctcagtggcagtgtggggttatgcgtgggcatcttgcccttattccaccaaataagctcctgcctattgcttgccctaccctgggcatgtaattgttgcatgttaattacctaataaacaatcatttacatctatacttatcacatcgtgtgcctcttttcaaaaacaaatttcagtggtcatctcttccaaaattgccaattttttttccttttagactgagttttgctcttgttgcccaggctggagtagtgcaaaggtgtgatctcggctcactgctacctccgcctcccaggttcaagtgattctcctgcctcagcctcccgagtagctggaattacaggcaggtgccactatgcccggctaatttttgtatttttagtagagacagggtttcaccacgttggccagactggtttcgaactcctgacctcaggtgatccacacgcctcagcctcccaaagtgctgagattacagatgtgagctaccgtgcccggccatgttctttattttgttgtttggcatgaacattcctttctactagcgtaacagtgactaaagaaaaaccattaggaaattaaagaacaactctgagagggttggtttatagaaatttttttaaaaaatattttactgcccatagcctgtttgaatagtaactagtgttataatttagtctttttctatataagtgataatttggtgttgggtaggcacagatgtctacagaatgaggaaaattaaatgataccttagactagcatttctcacatgcatgctcagtggttcataagttctaattattttggttttggttttgtgttttcacctcaaatgagtgattcatttactggtaaaattgccagaaaaaattacaagtacccagtaaaatttaaatttctgataaacaatgaatgatttttattatgtccctaaaacttttagtatgggacatacttatcccttatatagggatgtccctcagtaggacatactaaaaagttattctttgtttatccaaaattcaaatttaactgctgtcctctatacttatttgctaaatctgtcaatcccgcttattaataataaaaagcaaatttctattttgtaaggatgattcacaaatacaagatatttccatggtacaagacctgagtttttttaatcagtatttctcagactgggaaactatggaaatgtgttttgcagctctcaggaattatgttttcctggaacaggtgtggtgctccatacgctagcttttaaaactctgtttttaaagtggtaaactgtaaaattatggaattgcttcctcattatctgagctattatcaagcagatagaacaaatatcaagagacaatagagttctaggaatctggagttgcaagagatattaaatgtcactttgtctaagtaatttttattatcactaagaaatgagccacagcttctgatgttaagtgacttattaacgagttaggttaataaactgagacggatcccaagtcttccagctctcagtctgatgttatacaggtatgtaaatatgaaatatacaggtatgtaaattaattgcataattaagatgcataattgtttggttatttaaatgagcaaattaattgaatacaagaactttgaaatgcttctgtttggacattataagccataataacaatctccaatagtactaattgtttactatattcaactagttatccattgccagttgctgacagctgagagccatactgcttggtttaaatccttgctgcaccaccagcttgctatgttactctgggcaagtaacttttttgttcctcaatgtctttatctgtaaaaagggattatggtaatgatagctacatcaaaggctgtagtaagaatttatgaagatctctgtaaagaatttctaacaatgcctcaaattggtaagggtctaataagaattgcctattattaccttgttattcttcatggtgttgttaatatatcagatacctacaaatggtgagggctgattatttcccaacctttatcagagtatatgtgattaagaatgtgataaaaagctatagtttagatatagatttttagtaattttatggaagactcaaaggcaaaacattcaatgctttgtagggttggtgctttaatgtttttaaagggcattagacccccctcctttaatttagcaacaaagacaaatatccaagtttctgtcttacttccttcagtgataccatgtctgagattcagcccccatttcttctctcatctttttaagattaattagaaaaatgtgcccacagtagaaaattattatttgaatttgtgtgtttatgcaatcctttcagtgactcaagaaaaccagtcctgttaagcctcaggttgccttagtgacttcccaagaggcttaattattcactcatgggaagaagagaaagagtagctttccacttcagttctggtaattccaggtaggggtttataccagcaaagtttgggatatgtttccaaatttagtggctgtagtgtgttaaattctggaaaagccacaggggaaactgatgtatttatctcagtaatacttttggacagaaaagaccaagtaatacttttgaatagaaaggtactttaaaaaaataataatagtaaagtagtactttacctgctttaaatttaactaaagaagtaggtagctgttgtattgttatttggtggattcaaatctattataatactctaaggcacagaaaagctgcatatttttccctgaaatactcaaattcataaaattctgccaacagtttatggcaacatgatccagatcaatttcctttatgttagtctcttagcatgactgtggcaaagagtgaatcattgtgtgttcctagtcctctgtgagacctagggagacctattacttgttgttcttttaagagctggaatttagttaaggagtttcttaattttccaaaagctgtagataaggagaagtgaaatataatacagaaaggcaagactctcctggtttgcagtaatgtcgggaatatctactctggaaaatcatacccattcatttcttcacagaactgtttgtatgtttattcatgcatccctgcacttatctattcattcattcatgcccaaggactatgcaaggcataggagatacaaagacaagtaagtacagttcctgtacccaaagctgctgtttgaaacttataccaaagcctacaaagtaaacagatctacttccatcctcagctctgtaagtctgagtctaaaataaatctaataaaatattggaaaatattttcacttaataactgagctttgaagcaaattataatctccatattagcagcaaccacatatttaacactatatcctcactgtgcatgacatatagtaggtaaatagttgtttaaagaatggagtaataactagatatattcttcaaaaagctttgtgttttttaggttcaaacaagctgaagccatctaaagtgcagagctgttaaagttgtcacgcatgtagagttgttctcaagctagaaatgaaagggggcaacatgggaatttttaatgctatagtgggaggtataacctccactttgcttttagatcaatcagtaaatcttagcctgaactttctcgtagcaaccagaatctctgagtaagtatcacattcataccagaaacaacagctgtgatttgtacatattaaaatgatgaagttctttccagctatcaggcccagaaccctttgccatcaccctttgccattataaaatccttagtgaactgagttatgtatatttacttccttatagcaaaggcggtttggaggttgggggtgggggtggcaggcagcattctattttggcatgtggctgaggtgacgggaggattttagcagctcgtgggtgggtgttcagggagcaggtggcactgggagaaggaagtgactgtcaggatttagtggcatttgggggcgtgtataggcaggcattaaaaaaaagagttggatattctaaaaacactttggtattctcataatgagaaatgtaatccagggcttttgctgttctaaggcacagcattttagtttgtcaccctgtgcagttttaggaaaagagcccaaagggttaaagttaaataagagcagtaaccaatacaaagagtatattaacaaaatacagatgatcccttgaggttttagtttttttttaacagctttattgaggtgtaatagagatatcaaaaaaaccctacgtatatttaatatatacaatttgatgagtttggacatatgtgtagaccatgaaaccatcattacaatcaagatagtaaacatatccatcaccttcaaaagttttcttgtgcccctttgggttttttgttctttcttttggtgtttgtttgtttgttttaaggcagtgcttttgctggtcaatagtaggcttttttatgttcttactttatcagagaacaaacagttttcacctcactcttcctatttttggttgatttgagagacatcaattgcctcaaatgaaatgaagctgtttctgtgtatcaattagaaccacatcaacaactgatgacctttaacatttggtattacttggcatatatgtcctgaactgcacctcgagttgctcatttcttaagatatctgggcactctgacgtgtacaatgaaagcgtttcttcagttattgatctaacctatgatcccagcctctttggaggtatggggagaatcagttttgattcagttctctgttgaacaaacaagcaaaaaaaaaaaaaaaaaaaaaaaaaaaaatatatatatatatatatatatatatatatatataaaatctatgtataacttccccacccccagttttccaaggacactatggaagtcttcagtaaaaaaggttaaacaacagagatatgaaaaacccagatatattaaccacagtgacgttacaaagatatttctagaaatgaatagcaagtctcttttttaagtaggcttttgataatctgtggtaatttgtaaacactgtcatatcaaagccatacaaaagatagtattcaaaatctttgggaaaacagtttttcataattcagtgcaatgtttaaagataagaatacccttcaaatgttcatgtcactttaaagacgtgttagggcttaaacaccttaaatgtagaaattcaaatagaaactgatgtattaggccttaaccactgaacatttataagctcatattgaaatgggaaatagggagttttaaaacaaatgtttacttaaccatttattaggggttatgaaggggaaagaatcaaggtcagttatgcggcaaatcaatggttgtgtggtgaaagtagcgtcagtaacagatagccccaactgcatattttgttcctcaaaggaagagtgttcaggctgcaagtacatcagaaataacaaggatatgtctcgctgttctgcactttgcaagaacctgctgggaatgaagtatccaaggctcttatgtggtttgtgttgggatttcttcaagttaccataatgaggtgttttcctattgccctgaactggctgggctataagagtcttcttgtacaatgattgttttaaagtatctccctcttaggtgtctcctgatgtatttacggtttataacttgaaaaaatatttcttttaattagcagtgataatctgaaaaaaattaaaataggatttcactgacaattcaatattgaaaatgaccttatttgacttttcctaacagttttcaagtggtttttgaatgctcttttgtttgtattcatttcttctccagaaactaccattcattaagggctttccaaaagaagtaccagtatttttcataagtgcaggtgtgaattagcaacatacctgtttcaaataatgttgattgaaacattatagcatattgtcatcattggtgtcaaatatagaaaccaatttaatgattcttatatatttttggcaatgaaaagcaaaaaatatgaggcatatttctcttaatctcacaaatacagagagaaaatgttaatttttttctgaagcagatcttcctttgtacctgacattcattttgacagtatgaagaacctgtgaatggattgatcaaagtgtgttgacattttagtgggttttaaatgattcttggtattcaggcaaggctgatggcttcatctgcaggtgagccatattgttaaaatattgaaacacttccttactgctcagaaaaaggtgcccttcattaaatgcttccaaagtacctctgcctcccaagcaccaagactctctgtgatccaacatccaggggagttttgggacaaaatattttttgtatcggatattctatctggttctgtgatttgggtggagttattggtttgcattttaaaatgtatattcagaaatattaatgggttactattatttttaataccccaaaggaagttttagcccagtgtgtattgtatcagagacacttatctaatacaggtacaatgattcaaagcattcactgtacttaaaaaaaatggtataattaatatggcattctttggtgggcaggcttaataaggcaggagaaagaaatactggatcatacaaattattacaatatttgtcttaacattgttttcactttttttgcataactaaaggctgtaagccagaactggtaacttaaactcacagacactgcaaattagcattgtttacagcacataggtttagctactaacacaaaaaattttttaaataattattttgctactgttaggctctatgatactggatagaaggtacttagtacctagggaccttaactttctcatctgcaaaatgaagagtagaactacattctttctccacttctatactttgtattcttatgtcccattttcccttatgcatgataattcccctggaagactagtgaagatagaacctggtgtccagttacagttttcagccatctgttgtttggacctaaagtgaaagcaataacaggacttaatgaatagtagtcacaggctttcctaggcagcatgatgataatgtgatgtttggaaatgcctgtctagattttgaattctagcatttaggacaatacttttattttacagatgagaaacactatgccctgagagttaagcctgaagtcaagttagacaatttcttgaactgaaatttacaatttgggctagtatatttgggggacataggtaacaacctgaaaattagacctgtactgtttcatatattttgattactattatataaaatatgtaagtagttttaggatgagatgtctcagcaagctacagaatctacaattaaaagaatattagtaccatacactagcacctaatgactaaacaaacttgaaaagctaaaataaatctaaaaaatagtagattgttaggtaaaagaccattttattgtttcactttacttttgtttactcttgatttttctagtattcatttaaatttgaactttaattttataaattcctttcagatgttcaaagatgtaatttattttattaataataatatggtttaaaaaatatttggtgtgtccctacaaccctacaaccccccaaaagcctatttgttatctggcgatcgtttcagatgttttctttttaaattgtcctgcttaccttatagacgatacaaattgacctttaatatttgtttttagagtataatgactgacttcatgcttacagatgcttgtgtgcttatatgtgtatgtgtgtatgcacataggaatacacattaagtagctccagatgggctttatgcacataattattcaattttgaaaaaataaacaaactgaagttctttctgtctatctgtccatctgattggaatcacacttattgagaagacagagcattgcattctggccatgaagaaaaacctgaatacctggctatacctgctaaagtcagccaatgccaacaaattttgtagatttttattcatttttagataatagaggttttgaaaaggctttataagaaagttgtacattgtgaaatcctaaaaagctgtctggatatggtatcaaaagttatagtttttatcttgatgacttaagatgaagggaggatgcttatctattaaaaagcggaaaaatgagatcaaactcttttcttaggttgtatctcaactttagggctttatgaaactttatatgtgtatgaaatttgttttactaatacattttaaattatactgctgctattactctctcttgtctaataagacgtggcctcactccctcttccatgcaagtgaggtctccttccacacaactaagccttcactgaacaaaaaataactatagcatatgcatgagttatcagggagtatggacccctagcattgatgtatatttattactgagcacatgctcaatgctgtgcagacacaaaacacatatcttccttgtatttcatcgttgaatcttcacaataaccctataggatagatactcttcttattttatttaacagttaaggaaacggagacttaataaggtaatttgcctacgtaaacacaactgataaatggcagagcaaggattcacaccaagactgacctaacgccagactccaactctaaaccattatgttagcctacttctccccatgataggaaaattttatttacatttgtatctgagaagcccaagtcttgctttatatttttgtcttcttatagttaaatatttcttggtatcacgaaaacattttttctaaatgagcatattttaagataacacacaatattggtattagttttgtcacaaattgactaaactttcaacccagatcagacactatagaaagctaaagtgtcttgtattaatagtagaaagaggtctctgctgcacactcactacagttgagagaagaaaccctgctgatcaggagctgccctcttatggagaaaggctatggcaacatacttttacggaagtattattccaatagctgtgccttaagatctcacaagtttctactgttacttacaaagattttttaagatactggataaatataaaacagttataaaaattagtcccaattttatttccatgtttaatcaggtcttaaattatatataacattttatatcaatgagtgttcttgaaccacattatgtttaatatttggagaatatttccttgtatacatgtgccgtaatttatttttaaatttctttacccacataccacatagggtgtctccaatttttccaaattactaacagtgctgtataacacttgtactttctctgcatgctgcatttcttttctaagtttttcctctgttgaggttaacatattgtgcttaggatttacaaataaataacaatctgttctatctttaggagtatttctaatggagttgcctttccctttcacattataaatgcttttaatatgcagaccacgataaaaacttaaaaatgggtccccagattttccccaaatgatgtttgaataagatgtaaaatgaccacccacaatacttggccaaataagtattccgtgaaattagtcagtggaaaaagcaatatccttttactactcaaaatgctcaaaagaaatataattttaacaatcagaaatcacccaagagctagcttcagacacttgaattggatatgaaaatgaattccaacttctactttgcttttttagctcttacactacacccacttggtactaattataatttttgccatgtttcaatttatcttagactctgtgctgtataatgctatagtcatagaacttgcatgcacacacacacacacacacacacacgcctgcaagatcacttacatcactgacactgtgaatgcaaataagaaattcctgaaaaggcaagtttctccctgccaaaactatcattcttatgaaataggaaagagaaaaggtatgataaagaaagagaaatgtttatagttgtcatttttatctttctactttaaaatctaggaagaaaatcttttaaaagaaaatcaaacaattattctttatgttttgtatggactgtatgatactagtggaaagttcctgatgacctgtgagtgtgaggaaggaggtcaaaactagaacaacattaaaattggatgttatggcacaatgaaattttatggctaaatcattcattgactttttatcttcttaaggatatgttctgttgagaacatttggtttaactttaaaattctgagtgtgttcctttgagaacattaatttcacagtaaaattgtcaaatataatctgatgttgcttttagtaaatgctaatgtactattaactagacttttttcccccttttctgcctgactgagtacaaccttactttatttactgatgtaattattaattctactcatagcttaaataaaaaggtaactctgaagaagcatggaatcaaaaatttaatgaataaaatttcaaagtgtttattgtaatttatatatacattaatgaagaaaaatttaatgaaacacataaaagaaaagtaaaattacccatgattaacccaacaacccctgtgtgtatattttggtacatatagtccagatatgtatacactgttttgctttgccagctttttctttttaatgatgtaattaacattttaatatattattaaaaatttattaaaggatttattaaaaactggtgtgtatttttctgagaaatcagtaaatgtttaaaaataaataggttttttaattaagtgtggaaaacttttcaaatatgctaaagtaattaaatagacattgctgaaacaactggatatccagctacaaaagaaaacaacaaaaaaaattagacctttacctcacaccgtatataaaaattaactcaaaatggattataaacctaagtatcagagctaaaactagaaaactattaaaataaaacatcagagaaaatatttttgtcttttaattgggtgaacatttcttggaatggccacaaaagcataaaacataaaaggaaaaaattgataaattgtatttcatcaaaattaaaatttcagttccttgaaagacactgttcagaaaatgactgaaaaccagacttaaagaaaaagtttataaagcacatttttaataaaagacatataccaaaaataactaaataataagacagcaaacgacccccctgataatgggcaaaatatttgaacaaacccttcaaagatgatcatggcaaattagcatatgaaaagatgtgcaacatctttagtcaccagagaaatacaaatcaaaaccacagcagcatacccttcatacccactagagtggctaaaattaaaaacacaaacattaacaagtgtggacaaaatcttggtgtagttgagattatcacaggttgatgttgggaacataaaatggaaagctactttggaaagcagtttggcaattccttaagttaaatatatgtttaatatatttcccagcaatcaaactcttagatatttagccaagaggaagaaaaactcacatgtgcacacagatatatatgccaatgttcataacagttttattcataatagccacaatctgtaaacaactcaaatgtcttggctggtgaatgaataaacaaattatggtatatctatactactactagtaagcaataaaaaggaacaaaccattgatacatacaacaacactgacgaatatcaaaaacgtcatgctaagtaaaagaagtcagactcaaaaggctacattctataggattctattcatataaaatgctaagaaaagcaaaaatgataaggtcagaaaacagtgactcggggagagagtgggaattgactgcaaagggatataagggtacttgtaaagatgataatgttttatatctttattgtcaaaatgcatcaaactgtacactaaaatatgatgagtcgtattatattgcattatattttattttattcacctgacataaaaaataaaagacagaggaacactagatccctcttagagattcaccaaacatatttattatcttaaaaactctaagacctgaagaaaacaatttttatttcactttagtagactgggaaatccatagtatttaatctcatggataaaatatattctaagttatttaaaatgctttcagcatttgtaattattaaaaaagctacaatgctattttattaaaattaattagaataaattaaacaagtttaatgcttttgttatattgacaaatgtcttccttaaaggctgtgccaattttcatgacagtgactattgccacagatgcataggacatcgtatgttttaaaatcttttccagctttataggtaataagtggttcttttttattattttcatttgtatttttttactactaatagtaaatgtaaatattttccagatgtttattggccatttataatgttttcattttgaattttttatatatattctttattctttcccctccctcaatttgggtctttgtattatttattggtgttaagtttttttttttaaattgaaaccctttaatttaagatgttatgctaaatttcagtattgttatttttgaaatacatttatttttaatgttttgataacagaaattttcccttacagtgtgtgtgtctttggaataatgtcaaagacataattttcttttaaaaaattatcactgctaatgtaaaagcaaagtataatattttgcttcacagataagtggtttaataattggactgatagtgactgattcagcacttatgtgtctcttttgaactctcaggaagttgttgaactcctgggaccagcctatgatgatattaaccttagtatcaggttttctatttacgtaaccctctggttggttcagaaagtgctgcctggtgctgttctcatatccatcattgtgtgtgtgtggaaaggggttgggaggggagtgagatagggtagagattttattgttgggggaaggtgttgacatggaagaactttgaccatgtttagatgctggagtcaataattcctgaaaagtttgaaaatagtattgctgagaatattgcaggggtccacatccaaacacattaagagggattagccttgattagaagaaaactattgcctactaggccacacagaaggatgggaacggggaaaggtatatttgcaaacaagatgtgggaggacttgaggtgaatcttacccaattacccatgtcatttctatggaacagggcaaggttgtttgctataaattgggggttcagggcaggtgccagttattcatttgaaaatttgtactgagaattggaattttaaaattcatttttgaaaacaaggaattccagaagaatatttcttacttttgtaagaaatatttgccttaaatatttgtttcaagccaatagatcatataaaatagatgtctgcgactattttaacaacttctgctcccatatttatacttctctgttctttaactataagctatagtgttatataaaaaactacaataatacaaataaattaccccaaagaatgctttttgttttgtattaaggaaataaaatttgaagtcatatgactcaggaaagtaaataatatttattaaataaattactcaaatacctttttcactgtaggaagattatgatatacatttgaccaaaaaaagtctgttttactgttatatagcctaaaatgaaatgtttttaatttacagtgtcctgtgtaaagaaacaatagatattttttaaagcaacttcaggtttctagttttagctcctcattgcttttttgtgaccctccaacttgcagattgattttctatttgtgcttctgttgcagttttgagattctttgaataagctcatcagacataactacttagtagagctttatttctgagaagcaccattgtgacactcaacaattccaaattaattcccaatgcaaatcatggaattttcagcttctccatttctttgaaggcctgataaatgctgcagaggagggattctgggctggagtaattctagaaatgatgatcacattagacattgctgagctaccttattttaattttcaccagccttaagcagtttgttaatctgcctgaactaaacaccttgtaatctcaaagctaaagatttaagcataatatatgaaagaaagaagtttaatggaacagagaaacagcttctaaagcatgtagctactagatctataaactgtgcgggctagtttgcagctattttggcctcattggcaatctggaatggaataaattagaggacatacaaataatctaaattccctgctttgataaaatttacactaggccactaaaacaaacaagaagttagtatcaattacatgattgaattaggttacttttaatatcgtcttcccaatcagaaagtctttgttaattctattctctttgtgtggtttgtgactgaataagtcagttggatactgcttgggactattcaccaaaatctttgggtttattgggcagtttgtctttatttgctttctacttctattattccagttagtaagcaagtagtaatggattcaaacccatcactactactagcaaaacaacttatacattcaaaaattatttgcggagtgcttggcacttttctatgtagttggaacacaaactgaacaaagcaaacaaaaatcccactctcatgaagctacattttattggagagagacagaagataaacaaaatgcaatgtttttaagtacgaatggtggacaatggagcacaaagtaagtatttaaaaaatcttcatgtggcaaatataacaagagctattttgactcatagtccaaaaatctagccctgaaccagagctcttgcatccaaagcagaaggatttcccactaaaacatttaaaaattatcagcttcatgggtgtctgagtgcttgctttcttccaacgaagttcctttgctggggcttagccaagatggcctgtgtcctttttggctaacactgtggccttctcctgagtcctgagccaaaagcacagtattctttaaagctgacaataatatgttttcattcatcagtgactttcagaaaaaatgtggactaaaagttgccttctcaagagttgtgtgataacatctataggatgtagaaaacaaaataaaatagaaaaaaaagtttgagaaaagacaaacctgaatctgcagcagtgggtgatactaccataatgaaggatctggacctggtggatgaggtgttccatcaagagcctgctaggaaataggttaaatgtaaaaatgttaatgaaaaacggtatcctcctatcaaagttattttcttacctttaaaaatttaatcatgaaaataggttgagaccagagagtaaattcatttcttatgtctgagattaaactcgaattcccactggagttaaaatatttgaggaaggggtggactgcagtctgtataagccctaccatgtgttggctttttgcccctgacttgctgtccctatcctgccctcatggtgggcatgatccagggctttggcaggtgagacagggaagaaaagggatgcaggcaaagattgcacaaagctgggaggctggacataggggagaaggtggagtgctgctgatgcagaggactcagagtgaggctaaaaagcaggaccaccaggggctgagctcagagcagaccaagcttacactgattcaggagggcacagggccagagaccaagatcagaattcaagttcaggggatccagaatcaaaataagaggttgaagaaacaaaagtgtctgaatcctggcagcctgggccccataaaggacataagaaccgggaaaatactgccttgccctgttgtggggaaacaagtttttttttttccttatgtgttcactgactgggttggaatgaacttccagagttcagagcccgtatttgggaactcaacccctcttatggtttagcatgagggcagagatgactgagaacttcttattacagaagcatccatcacaaattgcaacatctgattacactttatttcagatattgtcaaattcaatagcagtaagatagtgaacattctaataacagcaagtgtagtatcaggaattgacaaagtgggaggattaagtgtcattgcttaacttaagcaacagagaaagaacagtttcccaaattgcttaggtttgcataatactgaggtacgaggtaaggtcagcaaacaacataaaataagttcttacttcactcccaacccttaaaaagactttgcgtataatttttgctttgtagacatacggctttcatttggggaaaaatattaaggataatgttgaagaaaatattaaaggataattaaggaaggagaagtacagtaatatttcttagtggttccattattgatccttgctatctatttttagcattttctaatattttcagtttttttcagaaaaagcacttattttatgtcataagctccacattgagtgagtaagtatatattactcttgtgaaaattctctttttaagtgtaaaattgaagaagccatgatgaaggcatggtcagaaaaattaaagagaataggatgactctgcttcccagaacttacagaattacttagggaaaaggaaaaatgatttttaagaggctaaaatgttaattagtgataaagagtttgcacctgacccccaccccttcacacatacacacacaccccaccaccatcggttctgctgagggatggatctgggctgagcggaggatgatcctgagcacagacctgtgtagtgttcttgactgtggcagagattgtaatatctatttttttaagaaaatgttttgattgacaactctcaactcacaaggactagacatcaaattatttgttttttttccagtgaaaactgcctcctgaggattctcctgctgttattctcctactatgaattcatctctcttaaagccttctccatccaattctgtccttctcagtcactttcatttagtaaaaataagctggtatcaagagtgagttatccatcctctttaatatttcagactcacatttaatcccaagtttcttccttccacaccttgctctcttccgtctcctcagtatatgtcactgtggcccagacctgtggtggagggtgtaggctttggggtgtgagtgtgtcttctctcctcagatacttgactccctcctccctgccttgtcctcctagtactggggcttggagctgggaggggagaagactagtcctcctgtggcatccagggtgtgtctggcctcctttggggagtcatcactgcttctctgactcacactgatgagccctttgtggggtgtatatccaaatgtctgtcttttcgtaaggtttatgtggtagacttttagaagcctctatgggaacctgcacagtgctccagtgtgggacatccaggaatgactctattttatcatctttctatctttccttgccaaatggtgggaatgcagtctgctagcactcttcatattgcccctttctccagttccaatgacatcagatatacctttgagacaagaagcaattaccagttcccaagtcagtggacagaattatcagtgtgaatccagtgtgaattatcaaatttcacacttgaaaaaaggaagtgtgaaattgaagggagagtgaagagagagttgccgctatgtcaattcagtacctcttccaaaagatcgtttcttttttcctcctacccttttcgttatctcagtctgacaaaggccggagactgctttgtcttcttttgcctttgagggtatgaagaataggacccactttgaacttggccctggaaattttagggttttcttcctcaacttttcttttatcaaggcaccatctttgcaataatctcattctgttttgtgaagggtagggagagaaggaaggactttacattatccttctagtaatagtgaacgtttactatgtgtttagaggtattacctaactcatttgaaactgaggcccagaagagtttgtcttgtctgtccaaggtcacacgctagtaagtggtagagccagaatttaaatctgggtaatctagcgagagaggctgagttctaactacttcctcttgacgcttgttagatgtaatgcctagtcgtggcttgtgaaagcctaatcctaaaacagtagggtgtggctcttagaggacacacctgagaatattcctcttaccagtgagaattccaagtcataatgctgtgaagcctcattaaagcttggtatcaactacaagacagtaaatcactgaccccagagatggtaagatcctagtaaatttactttctgtctaaataaaaagcttattaaaacaaatgataattattttagtgtgctctccttctgttgtctaattaactacaaaagtggttaatcttgcaaagtattatataatttagtgcccatttagctgtttttttttcaatttagtacacccaagcataatcagtagtagatttattagatgaccaaagaagttttaaaaaatgatgctcacagattagtggtggattcaaacaaggtggaaacaaatgaataattttatgcactcttcatgatatattatgctttgcgaaaatttcacaatcaatggcaaatcgcagaattctaaagctatttattgtaaagatagtggtgtacatagtttcaagtggttaaaactgtattgagtcctctggaatacagttgcactttctcaaatgaaatgttgattctgtcttccaacaagatgagtgtgtagtcctcacaatattagagggatttgaagctcctccagcttgcttggttaccagttaaagacctgctacctctgtagcacatgtatatagtaggatattttccatcgtaagtcagggaactccatctaggttgcttaagggatactgtagtatcttgtggaattccaggaggaatgatgtagaaggaacagagtaatagtgagaaatagggacaagagtatttagaggaactctggaaacttttacttccacttttttatctctgcaggtgtacttccttggttgaccactcattgacctgctttcactctttttcatctattaaaattagaaaatattcatcatctacatttctttggagtgtaagcatggtggactgtaaatatcatggactttgaaattggaccaacctagattttgtatttcagttttgtcacttgcatacattgggcaaatcatttaatctcaatttccttatgtgtaaaaataatatgagatttactgaggtttaatgagagctaaatgagatgctataggtaaagcatctattttttgcgtatgtgttattctcttccttgttgatttagttgttgcttgactagtaatatagcacaaacataattataccatataagacactttatttgatctgttttttgtcagtttacacttttagtatgaaaagggaaagcacaaaggttgtattcacaagctggtggggaatttgcttctgagtgagaggatccctgcagttacactagttctactatgttggaccacagggttaatcttatttaacccatttactagctggagagacaggaagagctgaacgatagcctcatacttcctgaagtgaaccttccaagtttaattacgtcccagaacccaggctgtttctataggcatttctctcaggatctatcccgaagtctaaccaaccttggcataggtctgactcctctctctaaagtgtccccagtccctatgttcctcaccatgaccagactctttgaactgtgtttctttcctccccatggctcatacatacattctggtaactgtagctcatgtagaaatgtttacaccatagtctccttcaatctgattttttagatggcatatttacgttgcctatttaatttctttctgtgtttctcaaatttctgggaaagaaaacagagaatcagtagacccttggctttggtggagaaataccttactctttacgagtgacccaatcagccctgttcctgtagtggtttgttactttgtagacacagatttggattgttttgaccatgagataagatagacaggagtaaagattacacagaatacttgccatctacctagagtgtttttggcatctgcttgaaaattcatggactatacacataaagatatatgcagttattctccccaagtgaggtgcatttcattcctttgtgaagaatggtcctggaaatgaaacctattttaatggctggtattggaatagaaaagaacacaaagaagtctaaggaaataatgcttttgaatcaggaaataaattcaggtttacaaaacttaagagtagaatatcagatttggcagtaattaatatatatgacatgaataagtttacaatactctgtaaatacaatcaagcagtaataattcatgaaactgtttcacagagtattgaaaccagtccccaaatttcattgtattatttttatttttatttttttattttactttaagttccaggatacaaatgaagaatgtgtagtttgttacataagtatacgtgtgccatggtggtttgctggacctatcaacctttcatcgaggttttaagccctgcatgcattagctatttgtcctaattgctctccctccccttgcccaccaccccccaaactggccctggtatgtgttgttcccctccctttgtccattcgttctcattgttcatctcctacttatgagtgagaaaacgtggtgtttggttttctgttcctgtgttagtttgctgaggttgatggcttcctgtttcatccatgtccctgcaaatgacatgatctcattcattttcatggctgcataatattccatagtatatatgtgccacattttctttatgcagtctatcattggtgggcatttgggttggttccatgtctttgtattgtaaacagtgctgcaataaacatatgtgtgcatgtgtctttatagtagaatgatttatattcctttgggtatatactcagtaatgggattgctggcttaaatggtatttctggttcttgatccttgaggaatcacaacactgtcttccacaatggttgaactaatttacattcccaccgacagtgtacaagcgttcctatttctccacagcctcgccaacatctattgtttcttgactttttaataattgccattctgactggcatgagatggcatctcattgtagttttgatttgcatttctctagagatcagtgataatgagctttttttcatgtttgttggctgcataaatgtcttcttttgagaagtgtctgttcatatcctttgcccactctttgatgggttatttgacttttttcttgtaaatttgtttaagttccttatagattctggatattagacctttttcagatgagtagattgcaaaaatgttctcccgttctgtaggttgcctattcattctgatggtagttcttttgctgtgcagaagctctttagtttaactagatcccatttgccaactttggcttttgttgcaattgcttttggcatttcatcatgaagtctttgcccatgcctatgtcctgaatggtattgcctaggttttcttctaagatttttatggttttgagttttacatttaagtctttaatccatcttgagttaatttttgtataaggtgtaatgtccctctattattttcatcatgaaataatagagggacatttgagaattggggagttcacagaggccttgcgatgtaaactttgtgactgtcaagaaattgctttttatttctttttaaaatagaataatagtggcatttcatgagcacctgctacattcagagcacactcctgggtgttccttatatattattatatttatttctcacaagtacatgagggagatcttaatcttcctttaaagatgaagaaactgattcaaagatgtgaattttcttgtcaaaagtcacacagtttgtatttccacgagtaacccaaagacattttcaaaaatactgtaaacagatatagtttgacttcttctcttcctatttagatgcttttatatttttctcttcccttattgctctggctaggatttccagcactgtgctgaataggagtggtgagagttggcatccttgtcttgttctggtgttcaatgggattgcctccagtttttgtccattcagtatgatgttggccatgggtttttcatagatggctcttattatttttacttcactaattattagagaaatcaaaatcaaaatcataatgagatatcatctcacttcagtcgaatggctattattaaacgtgaaaaaataacagatgctggtaaagttgtggacaaaagggaatgcttatgaactactggtggaaatgtaaattagtttatccattgtgaaaagcagtttggttatttcccaaagaacttaaaacagaattaacatttgacccaggaatcccattattgagtatacgcccaaaggaataaaagttgttctaccataaagacacatgcatgcatatgttcatcgcagcagtattcacgatagcaaagatatgaaataaacctaaatgcccatcaatagtagactggataaagaaaatgtggtacatatgcaccatggaatactatgcagccataaaaaaaaagagatcatgccctttgcagcaacatggatggagctggaggccattatcctaagcaaactgacacacgaacagaaaactaaataccatattttctcccttacaagtgggagttaaacactgagtgcatatgtacacgaagaagagaatgacagacaccagggcctacttgaggatggagggtgggaggcagtgaggatcaaaaaaagctacttatcaggtactatgcttattacctgggtgacaaaatcatctgtataccaaacacccatgacatgcagtttacatgtctaacaaacctgtacatgtaaccctgaacctaaaataaaagttaaaacataaatttaaaaatgtaaattatagaagtttaaaacatactataaaagaatgccttatgcattattatgcataactgaagttgttgctctgatttttctcctccaaactggaaagacggtagactttttactttcatattttcatattttgacttcagtatatgaatgactctcttgcctaaaagcttaattctaccatgccagccctatgagtgctgcatttggcctctaatgacaaatatgaccattatcttttaaatgggtagttgtcttagaatatttgtctcaatccttaatttcagtattcatttagcacttttacttttacaaaggaagttgaagttgtttataagttaaacataatagaaaataagaaaattaaggttaaataataaatagattacctaaactatatacagtagatattaaaggatatctaagaaaagctaatttgcacacctagattctaaaataattctgtttcatgacagctaaaacaaggaaaatatatattataatctacattacttttccaacacaaagtaatctgcagatatttttctgaagctatgcttaagaagagcctatcagagggtggagggtgggagcagggaaaggaaaaataactaatgggtacttggcttaataactgggtgattaaataatctgtacaacaaacccccatgacacaagtttgcctatgtaacaaacctgcatttgtaccccaaacttaaagtaaaagttaaaaaaaattcaaactcacatattcagttgtggctctccaaactggtggatttcgtttgttgctgagataacattgtctgaattcactgctttctggacctccaaccatataaccaatacatacgacaaatacaggagaatggatgctaccacgccaacaaaactgtggcatatattatctaactaaaagagaatcattagcagtgtttggatgcagcaaattcaggctcggattctttgacatgactgtatggggataaccttctctactagttaaaggttctgttgttatgtaattattgtccaaatcagtacaccttctttttctttttttttttttttttttctttttttgagatggagtctcgctctgttgcccaggctggagtgcagtggcgccatctcggctcactgcaagctccgcctcccaggtttacgccattctcctgcttcagcctccggagtagctgggactacaggcgcccgccaccactactagctaattttttgtattttcagtagagacagggtttcaccgtgttaaccaggatggtcccgatctcctgacttcgtgatctgcccgtctcggcctcccaaagtgctgggattacaggcgtgagacaccacgcccagccccaaaccagtacacttttgacaaaaatatcccaacagaaactgtcccaggcaaactgggatgaaggtaaccctagtaaaagtaatcatttgtttagacaccagccagaataacaattgttaaggctgttggagaacatatttacatatccacccatgtagaggcttccctacttaatacaggtgcagttgcatagttgcttagaaatcagtattgctttacaaaatatttccaaccatctcatgaatttataaagtacttacttgattcacctgaaggtggatataaagttgttagggaaaccagctggtcctcttaaagcaaaataatcaaaccctgatcttgtaaaatgtatatagagaaaagacttcacagcgtgactttctgaccttgacctttattcccagaacttaccttacttttgggatttctcactcatcaccaatgaaactctcagactagcctcagagaggttctgtaaagacaaatgttctgtgtgattcttcttttcagagatgacacccatctttatcatttaaacaaaagtttacaaaaggctccaagattatagatagaaatacccagaaactgataaacatcttgattacgtggtttgattacaaaatggtctacccatcttcattttggaagcccctctggggttgcactgcctgccaggttctcagtgtatctccacctgactgagtctgtctttctcccatcccttgtaggaaccctttcatatgtgtttgtgctcctagaggttcatgtagaggagagggtagcccagaaattgatgttttctctcttcctgctttgggttctctcctaggttctggttcctccccaaagacctttttcttgaattattgacagcaggtctgtggacccattcagaggagtcctccttcctcttatttcttgccgaggacatcccaaattctatgagcacaccttataaaaaagcttaacatgaacatgagaaacacaaagtttcgggaaaaatgttttgcttcacataattcacagaagcagtgcacttggtctgaaaatatttattaaagtagtaccagatgacctctttatctgtataataaatattgaaaatatttgcattattaaaactagctgtggaagaaaacagcctcctgactgggtgtttaaagtactacaacagagctattaatttactcatttaaacatattaatagtgatagtaaaaggaacctccattcagaactatgtatctactacctgtactgtcttcttatttctaactttaaattcatgattatcactgggaacaactatatggtatatacagagaatttaacaatgacatggttctatcagatttttcatacaaaagatatgtttcatgaattcatataactatgacaggtttctgctaggcattttgttttatttttaatttttttgagacaggctctcgctctgttgcccacgctgcagtatagtgctacaatcacagctcactgcagccttgacctcttgggctcaagcaatcctccctcctctgcctcctgagtagcttgaaaccacaggtttctgctaccacaccctgctaattttttaaactttttgttgagacggggttttgccatgttgcctaggctggtcttgaactcctgggctcaagccatccatccccctcggcctcccaaagtgctggaattacaggtgtgagccaccatatctggccctctaccaggtattttaaataccttctaaatcatattggtttagacttgttaactactatgtattaaaattcaatttattgattgattaagctgtaagaaggaataattaaacataatgccactatacaatttgatgccttattaatttatgctaaaatcattctaatgtacttattagtggtggtcctgttaaaaactgacagcccgtgaactgaattcgtctttcagtcatcagtcaatgaatcaatcaattaaatgtgaattattttaaatttatgaattagaaaatttcacatcaaaatctggatttgcagtttttctggaataactgaaatatttggcagaattggatatgccaaatttcatatgagctagaactgagtaggtcctcaatgaagcggctttttatttttatttttattttttgagacggagttttgctcttcttgcccaggctggagtgcaatggcacgatctcagctcaccacaacctccgcctcctgggttcaagcgattctcctgcctcagcctcccgagtagctaggattacagggatgcaccaccacggccagctaattttgattattattattattattatttatttatttattttttaagtagagacagggtttctccatgttggtcaggctggtctcaaactcccgacctcaggtgatccacccgtctcagactcccaaagtgctgggattacagacatgaaccactgcgcccagcctgaagctgctttttacagaatcttcctgaccttgataagcacttgaatttgcagccccgatctaaacactatttcagtgcatcctacactctgcctccagattaaacttccatctgcattacagtaagtgtgccattctcccacttctaataagcttcctcagctcctcattgactctgtgatctgacctccaaggccttcctgttctggcctctacctgttttgttctgccttattttctgctctccaccactgggtactattgttctgattaagtagggctacttgttaccagatcacagcttgtacatttatacctcttctctttcttatgcattttcttctccctcaaattccttcccatctgtagttgggtacaaataccaaagccatttttttaggtcctctaagcctggttcagcatctcagttatatcttccctgaacagcgaagatggtagtagttcttccctcttttagactcataacactgatttttctgactttcaaattactgaatgtataatcttttatactgaaattatgtgtgaccaaggcttttttcaactactggacagggtctaaatcttgttcactttgaattccacatgtacttaacacgtttccttatatttatttgccactcaataattatttgttgaatgagaaaattttcttctttttttccagtatactttatgtaagtaacatcttctgagatgcagatattgatattgatatttgcgtttcaattaggtaaatgatagatgtgtgtatttaaaatattgatttttgtgaggtatgtgattatttggaactctagagccttgtatataatcaaatatttgaccttcttatttaatcttttttttccataattaccatgatatagcttggttcttaataactcagacctactaaaataattcagaaggaattatgaaatacctgcactatatctttgttgacattataatactatcatatacaaactataaaaaaactgttaattcaaaattataatgtggtattaaagattaggttaacaggattaaatgtgaagcttaactggaaatattgaggcatgacaccaaaaaatttaatatccttttagttacacagttaggctggtcattgctcaatgttgctaactcaaaagcatgtgcttacatttagattatgtttaatagtaagtatgggttgacagtctgtttgtttccacggatggactggtccgctttgcactcactcagcggctgtgcattacgcgctttctgacttctgatcctcttctggcttttcttctgtttcttgtcaaagtgtgggtatagataaggcagtggtggtagatggagaggcctggagttcaccctttgttcccggaccctcctctagttttctgctaagcctgtttcagcatctctgagaaaatagctgactgtaaaatcaaaagagccgccaaaggtggtcaatgtattacatgcataaagttcgagtgaaagtttttttttaatatttgaaatatgttaccagtaattctagaaaagatttataacacaataacatttttatttttcccctagggggaatctttaattgtttttaaagacagaaacaattgcattctcataaatatattcatggcagtgttcataaatataattattcagcacagctatgtcagcaagaactacggggataacttgtgcttgacctttactcacggtagaaaagaaaccattttatgttggcactttaaatctctcaggggactattgggacagaggaatatagcctgcaatgaatagcatttaaacttatgtagtatctatctaacagggaactttgaaaatgttttcaaattcattattagatttaggggttttttctatttatttcttaatattttatattttatttaaaaggagtcatgaggcaactgagtatgacaattctgtccttgtgacacaaccataaactggccatttccaaatagtagttcaacttatttggtctgtatttttttttcaattatctatgtttatgtgcacaaactacttggatcctatggctttttttataccactttctcccttcttgcctccttctttccatccctgtctcacttcctttccaaacctttgttaagtactgactatatggagaatagtttgctagttatcagatgggttaaaaacagcagaaaccccgttttttctaaagaatctcaaaacctaattggaaaaatacattttagttaagcagactctgagataatagttcgagttcaagtagtttatttgggaggtaaaggagctacctgtaggagaatggtaaagtgagaagacaggtataatgatttcctagggctgccttaacaaagtaccaaaaactggggggcttatagcaacagaaatgtattgccgcacagtgctggaagccagacatcagaatttggggattagcagggccatgctccctgtggaggcactagggacagaatggttccatatcacttctgtagctcctggtagtgtcaggtgtcccttggtttgtagaggcatcactacaaccgccatcttcacaaggcacatcatctttcctctgtacttctctgtctctgtggccaaatttccccttttcataagccctaatggattagggctctctctaataatctcgttttaacttaattactttataaggactctgttttccaaatagtcacattcagaggtacttgggattaggactctaggactccaacatatctttttttgggaggtcataattcaacccataacaacagatatgacaaggaagatgaagaatgaacttaattccaggaaaacaacactgaggaacacgttgaaaatacaagcttcagagttatcacactaaaagggacaaaggagcaggagtatgtatttacaaacccctatcagtcatgggagaggaagtattaattcccccttaccttatttctgctctgcactttaggcaaagcaggctccagtggtcagagaaagccctcaggcacagaaatgcaagtgatgggagctgggggcatgtgactccccagtgaagtagaggaagggaacgtgggagggacaccaacagcatctgcgacaatacctgaaacaataagtgtaaaagcaaacaacccaaactgtactagggaaatacaaagcaagttaaaatctggagtagcagatgttaaccagagcaggactttgggcataccttcaaaccctgaaggaactggtgaatgttgtccactagtgggagaccgaccaaggaagtcacaacactcaaggactggataaagtaggaagcaatccgtgtggaatagatcagaggagggaccctccaactatagtggtgtctcattctaggcaggtgattcacatttacttctaggtggaatttcacatttttaaatgtggttcttaatgatgtggccactgcatgtttcttaaatctcatctctgttttagtttgtattcgttttatctgtaaaaactaaaattgccatcagtttgctagggctgctgtaacaaagtaccagagactggatggcttctggaagcaagaagtctgggattgaagtgtggctgtgtggttccttctgaggcctcattggcttgtagatcactatcttttccctgtgttctcacatcatcttccctctttacctctttacttgtctgtcctaatctccttttataaggagtccagtcatattaaattagtctaatgaaattacttggctggatgtggtggctcacacctgtaattccagtactttgggaggtcgaggtgggtggatcacctgaggtcaagagttcgagaccagcctggccaacatggcgaaactccgtctctactaaaaacacaaaaattagccaggcatagcagcaggcgcctgtaatcccagcaacttgggaggctgaggcaggagagttgcttgaacccaggaggcggaggttgcagtgagctgagatcgtgccattgcactccagcctgggcaacaagagcaaaactccatagaaagaaagaaagaaagagagagagagagagagagggaaggaaggaaggaagggaggaacgaaggaaggaacgaaggaaggaaggaattacattttgaggtactgggagttaggacttcagcatatgaattgttgaggggatatgacttatcctgtaacactctgtcctctgggagggagggaggtagggaaggaaggaagaaatgcataaagggaagaagatcagcccacttgacaggaagctgtgaatgcaatgctgtgacaatgtggttccagcacagctgggtgcgtcatctcgatcaagcgatttaacctcactggacttcatctggcaaataaaagagctagactttgtttttcatttctatgatgatgaagtttaaaaaaaaatgtttttcagcagctgagagtggacttaagatgtgctcagggcaggctgggctctgaaggaccaccctaggagtctcttgtataaatacaggtgcggggttctgtttgaaagaaagttaaaatgatgaattttgtttggggttatggtttggacattcaacgcctgcattttgttcctgttttttctagtgtatgccttttgcaggcatgcgtttgctgtaacaggcgtggtgtatactacagtcacctctttaaaatattgttattcattttcagtatataatagagagcaatagtatgaaggttatttatttgaagtcctgtttaaaatatctgtttatgttgttaatctaaattatggtgatatgattagttattaattatctgtgattagagaacatgtcctggtgaaaggtgcagggaagtcttccatggattaacatggagcaaaaagagagcgatttggagctaaacaggtcttaggccaaacccaagcctgagagtgattttgtggtgcctaatggataccaaattcttgtcaaggctcctgtctcatctgcacttgtattaccagtaacttgacagaagaaggaattatttttatgagtagttgaatcacaacatcccatcgatatctgctgaagacatgtatgaaagaataataacactgcctaattttactaatagaaattgcaaaaggtttgtcaaaaaccttttgtccttttaaatgttaactttttaaaattattaatgttgttaattttactttttataatttttatctttttgttagttgtttgttcctctccgaggaaaaaagagaccaaggacacttggaattctaagtacatgtaaaaataatagaaataatagaataacaacaataataatgttaaacttttattgatctcttactccatgccatgtactttatcaaaggttttgcctttatttatctcaattgatactcatatgaggaagattcaattatcatgtccattttacaggtgaaagtttctgtaaggcacagaaaggttctatgacttgcctttgaccatataatggtaaatgatggagctgagattcacattcaggctagctgagtcaagaagtcatgcttttaaccagatatgctatatttataaaagttgagaaataatcgcttgcagaatagaaatcataaataatgttgagagagaaacaatagaatgagaagccgaaaaaaaaaaaaaaaggaattttggatgtggatattccaactgaatttatattgttttgggaatactccaagattaagtacaggaacacatgccttttccattccattgaactttttctcaggggtagttgtatatatgcaggtgaagaccatggaggaactcagattaaactaagtatgtggacaacctcctttcttgagatatttaagtgcgtttgagatacacacaagttgctaaatgattcattatcttcttacatatctacagatttcaatattcccttcaaatatgtagttagccgagaaaaaaatatttagagttttcagttttcttcgttgctttccaggtacatccttggcagattggacctattatgtacctgtgacttgataaaatatttccttgcatttcactgactgtaaaactggaatcttctttatgaggtcattcagtattataataaatgctattattgaatctcagtcaatatccaagtttgttttgtcatcatacattttcagatttttgctactgactgcagatggatttatctcctcggccaacccaaatattagtccacctatttataaagaaactggatccttttcttcttttgttttctttataactcttccctgtgctcaaaagcaaattatttcatttcttcaagcctgttttctcttctgtaaaactgagataataatagtttttatatcttagaacaatatgagcattaagcaagacttacatgtgtatctctaccccaaaccactttcccgaggtcccaatacttgtaaataactgcttattcaacatcttcattcaaatatctaataggcctctcaaacctaacttaatctagatgctactcttgaattttctccctcaaataaactcctcccctggctttctaattttcataatttacctaattgctggagtcaaaaacttaggagtcacccttaaaacttctctttcattcataccttctagctgatacgttactaaattctgtgagctctaccttcaaaataagacctgaatctggccattttcaatacctcccttgctatcaccctagaccatcctccacttcatactacagatatgaattgcttaggtgaaccccatcttcttcaccagagcaattcatatctgttctttctaccccctactcttgactatggattcctcctgcccctagaaaaagccagagtgatcatgtacatctttcaatgagatcatgtctctcccctgattaaaatactacagtcaggtctcatcccactaagcataaaatgtatgcaatttgtcattgataatatgaccctacagcatctgccaccggccatgtattcagtttctcctgaatacgttgctcatgctgaggctgctccactcaccttcctgctgttacttagttacttcaagcttgttcctccctcagtgcctttgtacttgctattccctctacctagaatattctcccttagatatttgcatgacctgttgcctcaccttattttcatctctattcaaattcacttgctcatagaggggctggtcaggactttttaggataatttatctaaaactgccctcccacatgcctagttactctccaacctcttactcagtgatcatagcatctattatttgttgtgtgatgtctttatttgtttatgtgctctctctccatctagaacatataccccttgagttcatggtctttgtcttactcaacatgatatccccagtgcctacaatagtacctggcacatggcagatttgcaatatagatttgtcaaaataagaataaatgaataaaatcacttaacatatattgcctggagcatactgagtactatactcttttccaatgatacacattagaaaatcagagcctgttatattcttcattaatgtgagtcaagtacttttaaaaatctatttatatattcctcataaattatgtgagggcaatgtttccattttacaaatggaataactgagagcttagaaagatggataacttgcccagaatcacattatcattagaagttcatgcttgacccaaactgttcaggaatcatacaatagaaggtgatttaaatgaaaggatgtcactcttttgatcacaagatttggctgatgtcactggtgggccagtgactcttctttttcatgcctggaagaagaaaaaaacatcccacagggcaggggaccaatttttttggtccatggtaacgagtatactagaaaatgttgtaatatccagtaatattctaccatgttccatctgcctcacaaacctctgccatgaaaccagcctcaattcttttttctgttaacctttgtagcttttttttattgattttcagtttacatggtatgggtaattattatgcaaaacaatttgaaaccacttttttgtccacaaaaaaatcatcgtgcttaagcactgatagataaaatattttctttactcttacacactaattgcaggtctgctcagttgtcctcaaaggcagaaaagaggtgaggaagagaaagcaggtaacaataaagctgggagaagtggaggagtagggggagtaaatgagagagaaacagttcaaagctatgagaagattgaaaggagatggccagaattgcaacagtatcatcaatgatgaacaagaagtggcaatgcccaataggaatttatgaggtgctggcggggcgtggtggctcatgcctgtaagcccagcactttgggagactgaggcgggcggatcacgaggtcaggagatcgagaccacggtgaaaccccatctctcctaaaaatacaaaaaattagctgggcgtggtggcgggcgcctgtagtcccagctactcgggaggctgaggcaggagaatgacgtgaactcgggaggcggagcttgcagtgagccgagatcgcgccactgtactccagcctgggcgacagagcaagactccgtctcaaaaaaaaaaaaaatttatgaggtgcaatgagctgatgggactgctgaaaggaattgaactgaagcaagcagaggaagaggaaacctccagaaataacaaactgagggagtaatctatagtagatggtgaggtgtttgggagtaatacaattaaagtacactggatgtacagtggaggctaacaatggttgtaacagctaaggaagtgaatgtaatattgtcatacggtggaagcatgactttaatgctctactgagttgggggagaaatgggaagctggacctaattttccctgcttctgattttactgctgtaggagatgccagtggcacctaggtgctttgctgctgttaacgctgctatagtattagaatagcagcagcttctgttgtggcagtgcaaaggcgaaaggtagctgaaggccctgaacagtcagggagctaacaaactgtagctcactgtccagcttctctaatagaagtctctggtggtttgttgagcctgtaagggcaaattcaacaatgtttgtgataaatatcagattgaaattatttgaggaagctttagttctgcaagttagtgttgtggcaaaggtaaatgaaaaatatatgtctcaggattttaaaaactgatgcatttgtttctgtttcttttgaatatgaagtcaatgctttgtttcctgagcacctgcattaatgcaggtgagcacttgctttactcaccctatgatctatatgttgctgctcaaaaccttctttattcttgatgctcctgagagatgaagctctctcttttgttcttacagtatctttgagcgtaggccaattgtatgattttcgttttttactagtgaattgaggcttcagattgaaaagttcatcttagatcatcactacagcagtcaagaccactcctatccatgcaagcattcttggttttgttttctggtccatgcttaacttaatttgatttgtttgtatgtgttgggatgagatagaggtgcagatacagtgctcagaataactatatgaattgttgctcccaggaaaacatgtatgacacttaaattatgttatcaatagtttcagcatacattttaatttgacatacttgttttgcttatcataccttcccaatttttcctttaataccttgcatattattctcttatattaatgtatttaattaacatacttgaataacaaatattctatatgctaggcaagattctagggactaataatacaatgatcagcaagattgtgtgtaaaaattagcacatagacaattcttggatcatttaataaaagaggtcatttgaaatgtgtcgtttaaaaatatgtaaaatggaaaatcatgaattatttttattcatatttcatatttccttttattcatataatcatatgaaatattattacattgatgaactcatattgatttctgattatgaataatacaatggtattagccctaaggagcttatggtcaactggaggaaaggcattataataaatgatttcaacaaaatatcattatatgatgaagtctattagggcaagtactgttgcctgtgttgctcaccattatattctcagtacttagtcataaaaacaataaagacattcttcaaaagaaattcaaaattttgaatttcttattcttaacaacaactttaaaatcaagttttaaaacctgtgctgtacgtaagagacgtccagggagtgttttcaaaatacacattcccaagcaactctcctgaaccactgaacaagatttttgggggtagagccgcaactttacattttaaaatttctttggtcaattttattgctaagccctcgttatgaaggaataacctggagggaggtttttgtgcatgtcaaggagctttgacaaaggccctcacattcacatcacttttagattaggagtcagcaaaccatagtttggcctgtagaccaaatccttcctcccaactgtttttgtatagcctgtgaggtatgaatgacttctacatttttaaatggttgaaggaaatcgaaagaataatactttgtaacatgaaaattacatgaaatttaaatttcaatgggtacaaataagttttattagaacacagatgtcctcaggaaaaagtttgcctatggtgatgagaacagaatatacattacacttcacaagatataaatctaggagaaataggctcagcacagtggctcatgcctgtaatcacagcactttgggaggtgaggcagaagaatcacgtgaggccagaagttcgagatcagcctgggcaacatggtgagactccccaatctctacaaaaaaatttaacaaattaaccaggtgtggtcattcatgcctgtagtcccagctgcttgggaggctgaggtgggaggataacttgagcccgggaattcaggcagcagtgagccctgattacaggcaccactacactccagcctgggtgacagagtgagaccttatctttaaaaaacaaagaaagaaagaaaacttggagaaacagtaagttagataagatagtcacaatctaaaagtattttgtccttatggagttatgggttagatctagcaagataaaattcaacaggtgagacagtaaggtcctatatgtttgcataaataaaacaaccacacaattagagcaatttagcttttggaagtgtaaaaatgatgttggagttttagttgacattaagttcaaatatgtgtcagttgtatgattatgaccaagaaaaatctaatgtgatatggacctataaatagaagtatagaatataaaataaggaatagaaagactacacctaaataattgattccagtttgagatgtcctactttcataatggaatagatatctgaagcattttcatgggggaactattagggtggtgaagggctaaaaaatcgttccaaatagtaaatgacttagcctgaggaaaagaagactcagggaaggacataacagatagcagtcttcaaatatttggattaatgtcatgtggaaaaagggttaggtttattctgaataagccaaaagggtaatgccagttatggagatagtgcagacatgttaagctcaatataaaaaatatactaattattgtaaagatggaattatatgcctcacaaggtgattcccttatctcccttgaaggtgtggacagagtctggaagaactctgggtcaggatgatgttgaagggatttaaggatcagaaggaaatttagattaaattacacctaaaatctctctctacatgaagtgtctcagagaataattttgttgtattatgcacatattttaatattcattgagcattcactatttgcagagtattttttaaataattgtgaaggatacaaagggaatccaagatatggcttccaggagacaaaggaattttgcaaacaagacagagccacataaaacatcaggaggaatggtacataaactgaaattctatagtcattcaaagaaagtgggatcagtgaagacctccagaaggaagtgagctctgaaaggagctttgaagattggtttgaatttggataagtggtggtaaggcacagaggttctaggtaatgaaacaagcaggaacaagtatcagttaggaaagtagatatgtatggcggggaagaaaaatgcttgctagaacaacattcatttgttattcattcaacacttaaggagcaccttgggaaaccacaatgcaaagcaaggtgtgaagggggttacaaagatgagcaaaaaaagattcctgccctcaagcagctcccagcccagtaaaatgaaaactagtgtcaacaccacccttctatagtaacttaactcctgggtgattcagccataagataagttactggaaatttcttggactgtattcctccagcttaaaaaactcatcaacatttcattcaacaaatatttattgaacttctgaattgttctgtctccttgggatattatcagtgagcaaaatagacagagccctcatgcagagcagaatgtaagccaaacatatttttttgttattccctggttctccaagaaaaataaaacaatatttattgttttacaaattttgagagagcaaaatccatagagaaatacctcttggggttttcagaagggtatttcgagccctgactgtggagcaaatggcgtgagatactcagcagtatctctttaaacctgtgctcctttcttgagcagcatttgtatttttgtcatctatgccatttttagggggttttgtttttgtgttttagcacctgcaaaatttaaactggaaatttcatcctttgtgtcttagctcttgtcactctaaacatctcttgttgtatgaatccgtattggctcttcatacaaataaaatgcaaatcatatccttgccagagctaaacacttatctcaacgaaatcagaacaaatacttgaaggttaaaactgagactcattgctagcagaataaagagaaaaacactgaatgcaacatgaattttccactgagatgaattcaaaatgtgagccaaaaattcagtaaagataaaaatacttctcatgccaaatgatgggtttcgctcttgatagatatcagacttctatctccaccatttttctttcacatgaaacttaacactgagcgtctgattgcttctcactattgaaaaatgccatattaaatttcacaaagggaagcatgttaactttggtgtccaggtcaaatgactattcaaaaggagtggcttttctggtcaatcaaatacaactaagtattctactcactgatgagtgagtggcctggattttgttcagttctgcctttatctatgtaattacttctctggtccatggttccctcattggttaactctgtggtgtgaggctatgaatatcactatagctaggtcattgctttgcccccttaagtacacatcagtttattatattccattttttaaagtattctccttaatgtgtccaagaacttaaaatgactgtatgtatgcctaggttaaaattttatttaatattttgatagcattttaaacataattggttgcctttattattctatgtattttatgatatatgcttaaaaatattaatctgagaagggatccataaactgccgaaagagtccatgacacaaaaatggtctggaacctttaagtctcatacatttctggtaagggagtaggacacattctctgacccactctccatttgcccgttactaccttaagagaggtagttttctaactagatatgctaaagggattcatgaaataagatacccacaaagcaacattcataatggattgtgttacatagctggtattcatagttattttttgtgttcttggtatatttttcttttgtttgaaatctaggcagaagcagaaatactaaaatgtaggtctgacttattgaaaatcatattagaggctgagtacagtggctcatgcctgtaatcccagcacttaggaagtctgaggtgggtggatcactcgagtacaggagttcgagaccagcctgggcaatatggcaaaaccccatctctacaaaatatacaaaaaattagccggacgtggtggcccacacctgtagtcccacctactcaggaggctgaggtggtagaattacctgagcctgggaagtcgaagctgcagtgagccgtgattgtgccactgcattccagcctgggcatgagagtgagatcctgcctccaaaggggaaaaaatatatcatattagagtgaaacattgtgtccgttagcagggaagtatcttgaagatgattgagctaaggtaattaaagtatgtgtattgtttctgcagtttagatagctgctgctgtaaacagtaagtactttccaagggtgtaaaatgatttctgggtgtaattaacataagcaaatatccatcagtgaattcgtagacatgaagtctatggattaattaatggaagctgtgcaattgtagttatccttttaagtattttcttttttatttctttttaattaaaaaaattaagacatcaaatctcacagtattaccaaggctgatctcaaattcttgagttcaaggcatagtcctgatcatccctgaagtagctgggaagacagataggagccactgtgcctggcttcagtcttttattttgagacagggtcttgctctgtcacccaggatagagtgcagtggtgcaatcacagctcactgcagcctcgaccttctgggctcaagcactcttcccacctcagactcccaagtagctaggaccgcaggtatataccagcacacctagctaattaaaaaaacaaaacaaaacaaaacaaacaaaaaaaacgtgtagagagagtgtcttactagtttttccaggctggttttgaactcctgggctcaaacgatcctcctgcctcaacctcctaaattgctgagatcacaagcatgagccactgtactcagcctctttaagtattttcagacaggaaaagggggagatatccttctaatgataaagtccattattcagaaatcattttaagaaacatgtaataatcatttggaagagatgttactttatgtcatattctggttgtggtaaacttcatttttcacttctacatggactatcatgtaaagagctttaatcctggcatccatgcttaatgaagttaaaaaaaattatttaactaagattagaaagatgaaaacagaatgctcaccagcccatctataattctcatcagttcattagaaatcccttctgtgggtctctaaataacacaaaagttcaaaaattctggggggacacagatattcagtccataacactgagggttaaaggaggtagagtaatttgcttagtgttacagagctatctgtcttatagttctgaataagttttttaaaattaaatagtaagaattgtttttatagaattcttccatgaaggctgttcttttagactagacctttaacatattcatccagctaggggaaaaaagaaataaaaaaattctctatgagtaaatatgcgagtatgtgacctgtttgttcatgtgtaattatatgtaaactacatttattgtaaatattaactggcaagctttaagacttttaaaattactattcctaggaatttacccttattaatcattatgacttgagaggattttaaatgacattaattgtggctgctatttatccagacactatgctaagtcctttacttaccttatttcattgagatctcacaacaatactaaggaaaaaacaatattattatccccattttaccgatgaggaaactcagtatattagcttaggcttccattacaaaataccattggctgggtggcttaaagtccatgataaaggtgcccatcaattttgttccctgccaagggccatcttcctggcttgcagatggcccccttctcactgtgctctcacatggtggagagagggagagggttctggtttctcttccaagtattatatggacactcatcccaccttgagagccccacccatatggcctcatctccacctaattacctttcaaatgctccacctccaaatatgactcctccactgaggggtagggttttaatatttgaattctgggttcaatttaacatttgaatattcagtcgataacactgagggttaaaggaggtagagtaatttatttagtgttacagagctagtaagtggttaaaaataaagtgcgctccagagacttccagggatgatgctatcctgggaaataattttctgcactgaaataatattttacattggtgtgagggcttaaaaaaatcctcagcttgacttttccttactacctccagcataagcactctttcaaagaaccatgtggcttgcctctctcctggactgccttgcttatggtctggtttccctgggaaaaacaaagggattctttcaattctctgtcccatcacataaatttgtcaataaaagtccttcagtgacctcccattccgcttagaagaaaataaaaaattccctccatggttctcaaggccttcttgacttcatgtaactgaccttatctccaatccccactccactctgcctcgtctgccctgacccaagctctttcctgtccagcctttgcacgggctgctccatctgcctggaatcctcttccccacatgagtggaaggcgtgtttctcctcgtccttcaggatcccactcctcactcaggcttccctgacaatcctgtctatgtagccatgtcctacccctagccaggggcgtgtctgtatgtttctctcttttatttgtcttcctagctattaaagctacctgctatttctccatgttcttttgttaatctgatttatcacctgcctctcttagttacctacaagttttctgtgaacaaggacttagttttgttcatgtttatatcaccagtgcctcaaaagcacctggtatgcagtagatgatcaattattatgtgttgaatttatgaatgtatcactcttaagagacagaaagaatcccagttcagaagtgctaaggggctatgtccaaagttgtccgggatgtaagagacaaaaccacaactcacacttaggtcttcttactttattggtctttccattcctctctcctacccttttctgtagaaacagaataaggagcaaaacacactcctctgaaagttgaaagtggtgaaagagaactgagatctactaagcattaaagctgtgtcagatattacaccaacattctctaaagtcctaagaggtacagttactaccctcaatttacagatgagggaaataaagcttagatggactaattcacttattcatgatcactcagcaaatcactggcagagcctttgttccagccctggcttgtatctggtaataatgcccttacttaggggatgctgaccatggacattcgacgaaacccttttctgggctttcattaacctaggagtaaaagaaaggggatagcttcactttagatgatagtgaaattttctaaaatttataacacaatccccccttgcctcatgcctctacgcttttgtttactatgatggtatttaaagctaaaacaaaacccagaaatctttgggttttgaaagcaatctgttaaaaactataataatccatgtatccttagacttgagagcatttctaaatgaagcttgcaatctgatcatttggtgatgtttggattatgtggttatagtaggatttaaaatgccttttcacacagatactatagaaaggtgagcagcaggttgcacacagtgacaaattagcggtgctcttagccaggctgtttaaattatttttaggcaggagacatactgtacacaccaggttttagatgcaagtaattactatgaaatgttacctcactctttgcctgtagttaatctgagctctccctatttctctctctttccttccagttctattccctaatacttcatgtattatcttccttgcaagttcccttttttctgtgaaatattttcttgttatattggcaaggatacttatccttacaaaactggtagtggctgcagcagccatgcccagagcttactatgcagagactagtgcctatatcggaagttgagacaggttgctataccaaacctatctttagttcactacctgtttgcttcattaggtagaagctttctcctagacttaggagaagcaaaaacaaacacaaaaaaacaagcaaacaaaaacaatgctcctttatttaaaggagcattttctcagcatctgaaccaattatacatgcctactttccatatctaaatttatagcatagcacaatgagaactcatattaaatggaagaccttgaggctctgcagtatcctggatcatctaacaaagtttttttatatatttatatgtgtatatatatctatacacacatacacacagatacacccaaacactatacatactaagcatttaacatatttgaggaagttaactttatcacatcacagttcacgtttgtataacttcctaagaaaaggtggaatctattacaaaacaaacagaaaaagatgatttaaaaagccctaagagttggagctgtttttattccttcatagagcctgcattctaataaccatttaatataacctctaccttgatttgtacatggactaaaaaggtatgaccactggggcttagcactgaagcaagaagaaacaaaaagaggttgaaggaacactacttacataagatttccagatgtgggattactgtgtattcagattccttacacaatattaatagcacatataaaataattaaaatttctgggaacttttaagctgtttgatgtatcaagcagggtctaccttcatgttatagtgattgccaggtttcagatgctgggtaggtgtcaggtggatacttcattcatgatgccaatagagtgtcaaataaatatggattttttaactatgagataatatattatcatacttctgcaccctcttccaattatgagacacagttttctttgatgtcactcaggctcagaaagttgaacacccttcacttgatgtgatttggcaataattgtctttgatgctgagaaaacatgcacagtatgaagcagaaaaatacagctgggtgaggtggctcatgcctgtaatcccagcattttaggaggccaaggcaggaggatcagttgaacccaggagttggagaccagcctggataacatagtgagaccctgtatctacaaaaaaatttaaaaattagccaggcatggtggggcgtgcttgtagtcccagctacttgggaggctgacatgggaggattgcctgagccaggcgattgaggctacagtgagctgtgattgtgtcactgcactccagcctgggtgacagacagagactctgtctcaaaattcaatcaatcaataaaataaaatagaaaaatgcaacctgacaatcgtttttttaaaaaacaaaacgggctgagcacggtggctcattcctgtaatgccaacactttgggaggctgaggcaggtggatcacttgaggtcaggagttcaagaccagcctggccaacgtggtgaaaccgtgtctctactaaaaaaaaaaaaaaaaaaaaaaaaaaaaaaaatacagaaattagccaggcatggtggcagatgcctgtaatcccagctacttgggaggctgaggcaggagaatcgctggaacccgggaggcagaggttgcagtgagccgagatcatgccactgcactccagcctgggcaacacagcgcgactccatctcaaaaataaaataaaatacaaaacaaagtacataacagtcatgaacataaaatgtgcctacctgcacagactctgggagagttaaagcaaggtagaaggaagatgtaactgaacactccccacctccactatcagagctatggtccagacttccattgtctgtaagctggattattgccaggcctcctgactggagtctcagctttcctccttgctgtcttctattacaaacataggagccagagggagcgtatgaaaatgtaagtccagttatctgattcctctgctcagactcttccaatggcttcccattcacccagagtaaaagccaaatcccgatgatgatgaagaaagctcacataacctgtgtaccctcttcctcctctgcccttgctcagtccattcctaccacaggggcccagccactttgcctcagcctcaccaggtgggctcccacctcaggcctttcacacttgctgcatcctctgccaagcccctctctctgtaatgtgctccctcacctccttcaggtctttgctcaaatttcaccttttggtgaagccttctctaactaccttacttacactttaaaaaaacagggaaatcagtagtaacaaaacattacttagcattcaaagtcctcagatgataatataatatgaatttcactctgagtagctacaatgttttcaatatgctaagtttaaccctaagaagggcaaagggcaataaaacttaaagagtcagaggacaagtagatttctccttagaatcacacacagggtacgtttcctgggctactccactgaacagctttcagttcaattgaactctaaatatttaccaattgcctgttctaagggacttgatgcaggggttactgaattgggtaagaaaggatgagacccagattttaaggttaagatgatttatcagaggggattactcaaatactcaaaggaaatgaccaaaaatagataaaatagggtgttgctcataagtgaagtatagcaaagtgttttcattttgaccaattgctacaaaatcaatagaactgttgacttggaattagatcatggttaatttgattggatcatgacagtgacaaaaactgcaagattttctgtccagggttctgacacagtctattgaattaaatgcggttcaaattcaaagtaccttcatattattcaaagtttcgcatagatggtgcaatattatgaaaggtaaaatgactgctcctagctttgtatgcactgtgattagtgaaagcattatgacactttttttttagtatctaaatataccataccataaaatggtaagttttaaaaatagacttgattattaccaagcagtggctggtgagggtagaagaggttgtctggagttgattaaacagtggtaggggttctgggttacatgggacagatatagaatacatctgcatttgtataaattaaaaatccttctgatagtctctggaattttatattctacattagcagtaatatttgaattattggttttatgatctctctttcgtggatataaaagaacttaagttatttacaacacctgttatgttatttagatgatagttaggttttatatgcatattaacaatgtattttaattaaatgatgaaaacagatgtcatcattagcaaatgtaatgggaagaaaattacatcttgtcacttgccttgaaatgcactccagaatgcattagaaaatactgtacctaatgatggctgactaattcagtatactgtgcaagtaaaattcaggaagcttgtattcttctgcttttaaaactgaaaaagaggaagcctttttggaataaattttttattactcagctattcaacttaagctttacaaatagaatatttgatggcactgcttttaagaatctggattcaatctatgtattttatttcatagttctagatcctatttatgtatttcaatccattgaataatgttacacttcacaggaccataatagatgttttatctgatttttgttcactgtttcctctatacattataaaatagctaatattttactgagtacttactattgtctcacacctccctaagtgctttgcatatacatattagccattttaatcctcacaacaaccccacagtaggtaggcattattatcctccttttacagaggaagaggtggagtctttgcatgttaaataacttgccagatcagaagctaataagaggaagagcccaagaaagttttgaacccaggaaatttggcgctagaaccactgggctctgctcttttctcaagtattggcacacatggagattaaatctaaaactaagaaatatgcttgtgcactcacttcttggggtcaagaagcaagtaatatactttccttctacactcagagtaggagcggcatatcttcattataccctcactagggataagtgggtgttcagaacctctgaacagacaagacaggaatgtcacaagtggccacatagagaccctggtaaccagaatgggtgagcacaaactttaccaacagaagagtttgtccagggagatgaagccattagatgttgtggaaattaggggacattgcacttctcatttattcccttgtggctctgtgatttctgagaaacaaagcaggttgaagagctttataggaccattgatgttttaaaggaattattctgatcaaatattaaaaatgtaaggtaatgatactttgtcaaagtaatgttgaaagctcccctcccttaggtaacacatgcctgaacatagtttttcacctaaaagaagaaaaggcaacaaaatttggttaactcactaataagaaggatacatttgatgtatgtaaatttatcagatattaaacatgaaaaggaaaacaagtctttcacgttaaaatttttctgtatatcattcattcaccaagtatttcagagcattggaaatatttgtgattcagccaatttacatttatcagtgcagtgataatactaatgataatactctttttataaatatcagatttttagaatctcctttctttttttttgtttgttgtgaatcagcaatgaccataaaaatgccgaaaaaattttcagacaaaattacacgtgttccaccagtggttgtatcttctggagtttccacaaaacaaattttgcttgtgggctcatttttcactctgacttccatctcacaagatgacctatttgcccctcgctagtggtctattgatagatcatccaagccactcatactgatccccatctgccaggaaatcctgccagtcatcactgcctcccaaagttatcagctaagtgtactcagaaacttaaaagcgaagtactctgtttccctcatgtattatctatgtctacgtataataataatagctaatatttattgagcttttaccataggctacacacggtgctaagcactttacattgattatctcaattaaccctcccaataatcttacaaagttgctattattatcaccagttcataaatgaggagactgaggaacagagtttaaataacttcctcatggtcatgaagctgagaaatagaactagatttgatcctgaccaggccagactcacacttatgcctgaactattatatttaattccttccaaaaagtgtccagttgtataatgtagttgggttggtttttttccctctttatagtaacataacaaagcaatttggtgaagatagtcaacaacagagcaaaggcaatgtttacagtgtgttgtgcattccagaagatgcaagcatgaattggttacttaacactttggcttgctcatatgtgtagacaccactgtcttctaaattgccaacacatggagtttgctctttatgcattagttaggttggcatgatcacgtgacacattctggaaaagtttgcatggagtatgattagacctatttaatatcagttgattacatatctgttatatagatgatcccaatattacctattaagattattttcttaaaacttacttcattccttttaaaaattacattcctaattcatatcctactttatgatttctcataattttacttgattttcttctcttgaattgtactgtgaatgagataacttgtttgtcaaaatattaaaattaccctttcttgaacgaggttttcagtttcagacctctgatatatctccaatattagaaagcagtaatattgttccataatctagaaacagtatttctaggacccaacacatgagccttctacacatgtagcacctcacagcattcaggaacacagtgaaggtatttattgggagatggagtgcagcagaaaacaaatctatgctagtgggcctccatgtcctcagatgtcttcatttaatgcttactcgggagtggcctcctatggtaaattgaaaatggaattaaaaataaatgcttgactgaagcaatagactataaaacactaatagctaatcatcggttatgctcttattttttgtaagtgtcatctctcagtgctttcagaacactgtgggatgctgattggatgaacttcatttttaacaatgctaaatgggggaccataaaaactaccaacaatagaaaaatatacaaaaacccttaatatataattttttaaaagggtatgtagaatgatagtcatctgcaaaagagcagaaattgcaacattttataaatttttcttttgttctttttcagccacctctgaaaacacattttcctaataagtcaaatctcctgctgattgtactaatttttttttaacacataagatgttgtaaagaaaagtaatttaaataactgtgacagaattgaatgcaaaaataaaatgctttagtgccatctgctggacatttgcaataagaaaaaagtatactcattttaaactaaagaccaaatacgtttttagatacaaactgataatttgtagaactgtagtaattttcaaaaattactcaataacatctggggtaaatttctgaattactgagatatttagaatattgcctctgaagcaacctatgtttaagcctgtgtacaaaacactgtgatgctttttaaaactcacatatacaaatgtgcacatttctgtgattcacaaaattgtaagttttaaacagtgatggatatcaggttaaatatgtgtatataacataatattaaattattcagcatattttcagaggggtagtgccccagattttgcatttatgcttaaagtttcattgggatgattatttttatgaaatgagatgacagatctgtgaaaaaattgccttcattttcaagtttattcttaatgtttgcagtctctgccacatggtggtctctggataatttgcaccagaactactaaaaaagctccttcctggaatttatcccaaacctactgaatcagaagctctgtaggtttgtccaaaaatttgcattttaacaagccccttagataattctaatgcatattaagtttgaggataccaaggaaacacctcttacaaagcaataactttccgttcctttagccataattaaaattagcattctgaaaatagaatggtgtagtggaaagtttgaaacagaggacctaattatcaccaaccattttaccagccttatgtaaggcacataaagcgtgtccctaaattttcccatttataaaatgaggaaattgtacccactaatctttggagtttctcctgtgtctatattttcccaaatgttttcattttacactggattttggaatccttccttcatcttgtctcactctaagaaaagtgcttaagcgaatgccatagtgatgaaccccaagtcctggcaaagaagaaaaccttggttttaagcttgtacaactagatttcttaaatttcagaagtgattcacaaaaagcgttgaaggagacgacaaaggcaaatggtagaataattcatatttcttccaaaggagagcctgtatgctcatatctagaatagcatattatattcctacagctggtgttaggtgaaaaattcacctaagtaaatttagattagtaaagtattgataatttttaatgacacttggtaagagttcaagctatgaaaggaagttcaaggctgaaggaaaaatacactgctgtaaaagcgatttcatctgagttacatacgtttgcaattgcaattgcttctttttgcaggatactatgcatatgcctgacacctgtaaacaacttgtatttataatatcaggtaataaaataatagaaactcaagaccttcttatgctactttctttgtactcccagagccttaaggagtgtgggttgtgcaacagacctcagtagatgtttgttgaattgatgtttggaagattctactgtgtttgacaaacagctggaaagtttaatttgattgtagtgtaagatgtatgagaaaacgtatgtgagagatgctaatagataagtaagtggggaccttgtaccacaggatgagaaattgaactacctcagagatgatatttaatcagtagattgacatgattggttcagtttattaggaagatcattcaggcggtatgaaagatgcactagaatgatggaaaccatcggcaggaagcctagttagaaagctaatgaaataatacaagctaagaataatgagggccttcattcacaggtgatagatttgtgctgtgcattaaatcactacagaaagaaggaggttgtttgttcgtttgattgtatatgtaccttgtatctcagtccaagttttacgttgatttgctgtccctgcagcttcttaaccagataaaatgagcgagacagacacaagtacatatatccacaaagcttgcagaaaaaagatattaaaaataaaaaattacaaactttatttctcaacataggatccatgaagttcaagatgcttttataacccatgataccagccatttagtttatccctaaagaactgagagtcctggggattttaccatgccaatgcagtattttttataactttaactgaagaaaaattagtgcccttcacagacattttaagattaggaaacaaaaggaagttagaagaattcaatttaggactgtaaggtagatgcctaatgattgcctatcaaaactctggcagaattgcccttgtttgatgagaggaatgagcaagaacattgtcatggtggagaaggactctcagatggcatttccctgggactttttctactaaaggttgactaactttatcaaaacactctcataataagcagatgtcatcattccttggccccccagaaagtgagcaagcaaaatggcttgagcatcccaagaaactgttgccatgacatttgcttttgactggtctgcttttactttgactggaccacttccacctcttgaaggccattcttttgattgtgctttgttttcaggatcatactcataaagccatatttcatctactattaacaaatcttcaaataaatactttagcatatttatcccactataaaatttccattgaaaactctgctcttctctgcagctgatctgggtgcaatggttttggcacccatcaaatggaaactttggtcaactttaattttccagtcagaattgtgtaagctgaaccaattgagatgtctatcgtgctggctactatttctgctgttaattatcagtacccttcaattaggatatgaacaaaatgatttttttcctcacaaattgatgtatgtggtctgctactacaggcttcatcttcaacatcatctcattccttctaaaaatgagtcatccacttgtaaactgctgatttatttggaatattgttccataaatttttcataaagtgtcagtgatttcaccattcttctgcccaaacttcacttgcattaatttttattttatttatttactttatttatttatttatttatttatttatttatttatttatttattttgagaccgagtctcactcttgtcacccaggctgaagtgcaatggcctgatctcggctcactgcaacctttgcctcccaggttcaagcgattctcctgcctcagctttctgagtagctaggattacaggcgcctgccaccacacccagctaattttttgtaatttttagtagagatggggtttcaccatgttggcccggctccaggctggtctcgaactcctgaccttaggtgatctacctgcctcagcctcccaaagtgctgggattgcagacgtgagccactgtgcccggtcacttgaaatttcatgtttgttcttgcttcagttttagaggaattcatgttgctctcatagaagctcttttcaaacttatgttttatccttcttagtggctcaaactattagtaggtacttttcagacatgttataacagttattacaagttcattttggtgcaagaaagttttgaaaatgcatagttttttagtaatactaattttctatgaactttttgaagacccctcatataagtaatttgcttggggaactgaatctattttttaaatttcctggtggtggcaaaatgctttccatagtaatgtatgcttagtgtatgatgaagaaaaagaaagggagggagaggagagaagagaagagagggaaggagaggtgaggaggggaaggaaaggaggggaagagagggaggggagagagataaaatggaaaatgaatgggaaagggagatcttagacttagactcagatattgttcacccctggtacagtggaaggaattaagcaatttgacatagattagaggattgtagctgaagtggaagactgaccctcacaatatacatttcaaaatcattttaggaagtcttacgaaaaagctagaaatctgaaaactgcatttcatagactctcctgcagctagaattcctgatgtaatttaggttccatcagtcaaatgggcttgcatgagatttgaattgaaactgatttagatgcagagccacgacaacacactgggcatcattttcccgggatctcctgctgtggctcttgtggtggcttctagatcagaataccttagctgaggtggtaggacactaacactagccatttggacagtaggtttctgatttctgcggcttcctgattgaggaatttggtatttttgttttgttttgttttttgtattagacagggtctcaccctgtcaaccaggctggagtgcagtggcatgatcatggctcactgtagccttgacctccgaggcttaaacaatcctaccatgtcagcctcctgagtagctgggtctacagacatgcaccaccatgcctggctaatatatttttatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaaatgatgagttcatgtcttttgtagggacatggatgaaattggaaatcatcattctcagtaaactatcgcaagaacaaaaaaccaaacaccgcatattctcactcataggtgggaattgaacaatgagatcacatggacacaggaaggagaatatcacactctggggactgtggtggggtggggggaggggggagggatagcattggcagatatacctaatgctagatgacgagttagtgggtgcagcgcaccagcatggcacacgtatacatatgtaactaacctgcacattgtgcacatgtaccctaaaacttaaagtataataaaaaaaaattttttttatagagattgggtctagctttgttgcccaggcatttctcaaattcctaggctcaagtgattcacccaccttggcctctcaaagtgctgaaattacaggcatgtgccactgtgcctggcctgatggtggaactttgagtagttagcttgtgattttgttttgaggggcattccaagagatcaatccaagaccccacaaccatccctcttccaactattttgtagcagaaaactccattatttaacctttttgtctaaaagactgtgctgtttgttattttctactcaactctgacacaagaagccacgatgtacaaacatcattaaaaaaaaaaatagtgacccttgaaattttgcaaacttttatagctcctctattatagagtggaatcaaaaaggcagtttcactaaaagggggacaattgtgttgtggggacaacaaagagttttttaactgtaaaactatatgacttactgtccttctttgacactggtacatgctgtcatgaactgctaatttatatttatgtataacttactttctaaattgattatacattcattgaagtcaagaactgtgaatttatgttcaacagtgtagtgtgatgtcaaaatgtgtataaacaagcctccaacctactagactagcaaaacattgaatttcagtcattattagggctccctcttggacaacccccgtgttttttggaggctcttaatcagtccatcgttctcagaacaactctcctggctttaatatccatgccactaacttcataaggacttggtggtgcccatgtgctaaggttgacgaagggaacgcgtgatggcactgatctgttttctgtgccaaaggcgtcaagggaaacagaggccatgcttattgttttcagcacctatgcccttccaccattgtacacacatcctaaagcaatcctcctgttggaagtcctgcatgcaaactatcctggcctctgccctgcttttacctcagagaaagccctcacctgctctcagaacctaccacttggagttttaaaactttaaaacaatagcttccatcctttcctcctctggaaaaatccagttctatttgcctagacttcataaaggaaatccaggaagaaaggtagaattttctcctagattctcattactttgggaatgggagaagaaaaaataccaaatagaaaaatgtgaatttctgcactaattagaaggatttctctacattccactattatgatttacttgttcaacaaatacatattaatttgtacaaatgtcatcaataattgcttgtttaaattatttattttgcattcatagcatgatatttagattttcagacatttatagaataatatttagttttttaggcattcatctttgtttcttttgaaatatatgctattaatcacccaaacaacttttttacaaattgaattttagagtttcttgaattgaatgtacaattattaaaataatgcaacaattattatatagtgaaacaatgaaaaaaaacagaacctcatatcctgggagaaagtttcaatatcaatgcttttcttttgatagcattgtgtattttacaatactctccattttccatgtggataatttaaatctgtgatttgtgatcatatattttgttaacctcactagtcaataagaatatattgttaattctaaaatcgaagtgtacaaataaatttcacaaaaaggttttacatttgcagtcccacatttactgtaagaccatttaataaaatatgtatttccatttattattcataatagaacactgtcacaaatcttaaagcattaaaacatcagatacaaaaaataaatgtgctgtttatggtttcactaccagtatcttgcttccaaaggcacattttattatgaggacagcatcttgacaacatgagatatcagagtaatgtaaggggaatatgaattgagaaaagggcattaaggttgtattttaagagaacaatttaatagaacagtgcaggttatggaataggtagattttaaggacgtaggagtgaggaatgccctctctccctttcctccttccttccctccctccctccctccctcccttccttccttccttccttccttccttccataatattggctggtaaaataaggagcattgcaggaaataagttggagaagttgacagggacctgagttggactttttcttccagagcagaataagagaatcttatctgtaagtaaaggaagaaacccagaaagaaaaaatatttgaagattaagagagttatagactgagaaaaagcaagctctttcttctctcattatactccctactgggacgtctataccagtagtttaaacaagacctgctgctgaaacaaaaaaggaatttctaaagcacatgagaggagggcatagatgggtacaggtcaccaagggccagcattgagaaggatgtgattccctgtagagtttggagtgatggctgtgtgaatggcctcatgagctttgggatgaagcacttggtgaaaagctgccccaggccacttaggtatgtccctctgggagaagaacatggtgccctggtggctgtcttccttaggacctactccaagatcccccatggagaaagtgagaagctagagatctcaccgtcatacctcagtggagaagtctcatccaaccaactcacttgccatgaccaactagaaaaggaataattgctgcctgcccacctgtcacagccaggagaccttcaattctatgtagccctgatttgctattcaatgctatttgatgagacagaactgaatctgaatctttttctttctaatattaaatcattcatacatacaaaacagtattataaaacatacatgtaaggtgtaaagaaaaaataaactacatcatgtaacccctccgccactagcttaagaaataaaacgattttaggaatttcgggtcctagagagtttgggaaaagtttagatatgtattaagcatatgtatgtgagtatatatatatatatataaaaacatgtgtgtatatatgtatatacatatatgtatacacacacatacacacacaaagagaactcaataagattaactagtaagtttaatctactggatagatatacatatgttatatgcaattaagtttatcattgtcatgtgcaaaataaaatgaatactttttactagtagtttacactctgtagtaatgcttttaaatttaagctctataccagtttttgtttttttgcttttctgtttgtttttcttaataattccctgagatctcttttttctatccttttatttcaaacattctgtgcctttatattttgggtatatctcttcaaaacttcatttagctggatttttaaaatctaatgtgatgatctttgtcttttgatgatacttcttgtaatgtataacatttgtgattcctcatgtgttagatttttttttaccatgtcatactgtaatatttaaatgttctgctttgtctatgtttatgtatttatttattttaactcttatcttcttttagattgacttttttctcattccgtattttttccgctactggtttggatatcatacactctatttcaattatttttggtgaatacctaactaaaattttattttcaatcacttctacaggagttaaaactgaagttcttggtcacagaacctcagtacatgtttcttggcatctgcttcagagatatgttacttttctgaattactgcttctctttcatttttgtcctttgagaatttgcatactttccagctcaaacgtacattaaaagttacctttttaaatattacacccagaattttcagtgttttgtgaagtaggatgtattaggatatgttgtcctcaatatgaacttgtttgtaagttgtatggacttttttctcaaaacagactaatttatacctatatgtataaattttccattcagcaaatatgggtgtgtattggctgctacaaaggaagtgtatgcctgaactatttgctaaactgcatttccaatattgtttactgtttggtagaagagaggtgttatgtacggtaataaaacatagtaaaaatattaaatggtctatgagtgacccaaatgaaatgctatgagattgcaatagagtaaggttttatctcagtggtcagtgccctgcctgtatatattgcacaaagatttcctgaaacaggttcccttttgattgcaccatataaaattcccgtatgtttgaatttaaaaacacacagaggctttggttttcaagccattatatcttagcataaagcacgtactaatgaggaattgacaaactgctgtatgggcaaaatctggactactatctgtttttgtaaataaagtttcattggagcatatttacattcattcatttacatactatctgtggctactttcctactacagcagaaatgagcagttgcaaaagaaactacatgaccctcaaagtctaaaatatttacaatctggctttattccaaaaagtttgccaacactcatactacatcatgttctatattttagaataagtgtatagggaaactttttccttagcctagttttctccttctcatttatatttacttaaatagatttgatttggtggttctcacaataaatatttatttatgtactctctgcttagagtttccttggttagatatatttccttgctcttattacttaattattattattattattttacttatttatttattttgacagagcctcgctctgtcacccaggctggagtgcagtggtgcgatctcagctcactgcaagctctacctcccgggttcatgccattctcctgcctcagcctcccaagtagcagggactacagccaccgccaccacgcccgactattttttttttttttttttttgtatttttagtagaggcggggtttcacagtgttagccaggattgtcttgatctcctgacctcatgatccgcctgcctcggcctcccaaagtgctgggattacaggcgtgagccaccgcgcccagcccttccttaaaataattttctttagtggaagaagtaagattgccggtgccattttgcatgataacttttgaaataacaagtgcccacagttgttttctactagcttgaccctagattaattatacttaaagtataaaaagttcagtgtatcaaataactcttcgataaattgaccagatattcttgcattcattaaatgaaatatcacatatattcctttatgaagtgatattagctggcctttaaattgggaaatatttcagatcctaaactacactgttatgtgctggtgcttggatgtttgctttaattattggaattaaatagaaaaggtgccaactggcaaagcagcaaagggatttgagaatttttaaagtaatcacagaagttctgcttaagagctattaaggttaaaaagaaaatataatgaagtctcaatacctcaaacactgcagtacctggacctaacttatttgattctatttccagggagtatcagttcctcacagttatcttagattgagaacatcaaactaactgcctgaattaacaaaagcatctgtgtactctgtgtcctagggaatactcaaatccaaaaaactagctcagatacccagatgaatttgagcaggagtccctcttttggcgaaatagccaatgactattggctaggctcaggacaactctcagttctcattttcaaaaccaagacatccttccactggggcattcactggatgttcttgtgttctattcagaacagcaaacagttctatttatagagatttaagattgggatttgaactgatgtcgatgggaggagactttaatcacattaaatgtgaacattctaatgggaggtttccctagacaactttagttgtccccacagtcagtagttaatcaggagtggttgctagcaagcttcatacatattacctggttaaaataatgaaaaattgaactatgtaaaaatctgcatatctacaaggtaagatttagaacttttgatgtgaactgcaagaactaggagctcaaatataatgtaaaagctaacattctgtgtactgtattaaattagatacttgatcccaaatagataagtagcctccaggaatgggggatagaagacagattgcccagcaacatagtctaaaacagtatttgtcaaagtatgcatcatgctcaaatactgggtcatggaatcaatttattgtgacaaacttatttttgaattatattcagtattaaagttagaataggatagaaaatagtagagtacatcatatgtatttaggctaaatattttgtgtaatttttgtttcagttatatgcacacatgactgtagttgtaaagtgttgagctctcagttgaaatattttgaaacatctaaaagaaacaggcatggaatagatactcaaatttcattgctggcgacaaacagggcttatgtagcttctacatacacatagttcagtgctaataagcaaaacagggattatggaatcatgctaatacatatcctacctttgaaggtaaggttagtggggaaaatagttttgtatgttttgctttagttcaaagagctatgcttcctttttgttaggaaatattccttgttttgtttgttcttggttttgtcttccactatttacttagtttgctaccattttctcttttgcctaggagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgtgagtattccatgaacataaggggcgttgtgaatgtggataaaaactattacgccttccaaacatgagaacacgtgcatcttagaaagcagacatgtgcataaacatacacgttaaaatgaacctccctcattttgttcatgtccttaataaggtagtggaatgctgatgaaagtaattcctaaaaagaacttactttatctttgtttcttaatacatgattccaattcaaaaccaacagattacctgtgagaattcatttggtttttgaaaaatgcagttaatgtagatttaatattatcataaattataaaactcttgaaagttatgaccaattcttttaaaaaagttaactacttttgatttctgtaacattagtattcagattgaatgcacgtaaaatgcaaaataactgaatgtcatatattaagcaatgattagcctctatgagagtaaattcagatttactgatatgttaaagaaatacagtggcaagcttatctcatggaaattatttagatatttaaagtctattgagatttgcacttctcattttcttctctataagatatattcttacctgatgatgtttccttatttggcttaaataagagctacctactcctgttatgccagtactttaaataaatgcaatttttgaagcgttaagatgctaatatgataggaaccaatattattatttatgaaatactagagtaattctaataaatatttagtttagaatacattttaatgttatactttatcatattctctaaaatagtgcagtataattatttatagggaaatcttgatagatttccttgatagagatctgcagcttaatgtagaacagttacaagcatgtagctaaagaattcccagtgttcctgtaaagaatttgtcatattatctaatcattaatagattataatacgaagtcatgtttaaaaataacacgaaatctttaagccctcttgatatttctctattttgcacattacagttaaatttaaaacaaacctcccaatcaacattatattctttagtagtctagttgagttacaagtcagatattctaaactttattccagtggacttaagacactgagtatgatcaatatatctttttttttttttttcttttttttcttgagacagagtcttgctctgtcacccaggctggattgcagtggcatttggctcaccgccatctccacctcctggattcaagtgcttctcccacctcagcctcccgagtagctgagattacaggtggctgccaccatgcctagctaatttttgtattttcagtagagacggggtttcaccatgttgaccaggctgatctcgaactcctgacctcaggtgatccgcccgtctcggcttcccaaagggctgggattacaggtgtgagccactgcacctggccgatcaatatatcttatactttaaggtgagactgttactacctctgtggctttaggaagataacttctctgaacagtttctttacctatgaagactggatagtaatatttaccttgtatgggtgttatgaaaattaaataaaaataactaaaatctaggtctttatgatatgtatatttaatctttctttagggtcccattcttatgactccataagttttcttttcctctcctaatagtggtttgttataggcaatcatcatatgccaccttataggctttctaaaataaacttggatattaaggttgtatctggcacatagaaagtacataagatctatttgttaacttccccttctatagtgctctttaatacactattttggaatacattcttacaggtaaaacttggaggcaacatcaaaatacttaacaacccatgtggtaaggacattgttcagtctgaaaagatgttggcagtgaacaatgaggcgcagatcagctgagtgctagtgcttgctaagcacccacaactgttaaatgcttttaacttcccattataggtttgagacatgccaatagcaatacagttaatgattgatatattaaagtcatcaggtcttaaaaaggagagggtgtttaaagaaaattgaggtaggaggtacttacgctttggagaggacactcacgcctagtgtagttcatctttactaaacccatccaatcttggaaaaaatatttaaaggaacaaaataaaagaaagcacacatcttaagatatttcattcggagcacaagacaaaaacattgtataaagttgtttttttctataacaaacgttgaaatgtgtatcacaaataaatattgcctgtggaataatttattgccaaaatagttaacatatttctcttcccatttttatttattataaacatttctcattctttacattttcccaaattgtgactatcaatattttaacaataatttgacaaaattattgatacaattttatgcattttaataaaatatttttcaataataggtagactacatgtggtagtgaattaaccttctttatgaagaatattttaaatctagatttactaatccaagttctaaaatattaggaaattattgtgcctaactcttgtatctaacatatagcaggacccataatgtttgcattttcaatgaaggattgaacaattactattttttaggaaaagtaaacatttacttttcaaaatagttgtgctttaatactttgaagaaacacataattgttttcttaaaaccaatttattaatacatggctcaattttgtttttcttttctttgtcttctttctctactctgcttccttggatgctttcccaaaggaggacaaagtggttagaatccatactttcttttctatcatttgttattgtattgttgtgaactttattaagtgaatgttgcacctagtattgttaataactatatttcacaagaaattatatactaggaagagctcatttccagctctcatgaaaaaaataaacatttaggagcattacagagtttgatattaatagataaagtctggatagtttgagttcatgatgacagtgaaattttaatataatttatatcattgcaagctcatttatctgcttgactctgagttttgatgattattccaactgctttcagaaacaataaattctaatgggctctacctttttcagcatgcaaaggcaggtgatttgaaactttattgcagaaggaatggaaaacacttagtaaagggaatggatcaaattcaagtaaagaggccaaagtataattatttttctatagaacacaagtagcagagttgtcatactgaaccacattttgcctttttcttctctcctatgaatatgaataacttgttaggagagtaaaaggtcacttttaactcttatcagctgtagaaaccacagaggctctttgtgcctgggaagataggctccaagtagaatgttcagtcagcctttcctttgtataaacactatacaccttcatttggtgtaaattttatacatactatacaccttcatttggtatgaattacaccttcatttggtgtaaacttcctcgcagctcattaatctaccaatatgagaatgagacaatgagtatttcaggtttaatatatcaactgagctgcctttgttcaaaaattttaaagcttatatgatacactgcagtgcataattagcaagtgtgacattaaactgaacattaatctgtgtttctaaatttacgctaggatatgcttattgattttttctatgaaaaagaaatagagttgaaaaattatataggataatctatttttggtatttatttttgtctgtaccattgactgtatgtgggataattttaggggatattattataatgccaatttcatcaatattattactttggatgagttcacagttgaaacgtgggtaaagttcctttaaagagtaaaagtgtaagtaaataatgctggtgtttaggcagatttggtgataaaatttaaactgctctcctgtagggctggccaaactcactatccctttgacagcgttacccataatggtaggttatttgtgcttgttatgattatagtgtaatgagaatacaggtgggttttgtggactcagactaaaaatagagtggaaagacctgtaaaatataatcactttcaattattttcttcactttggttagaatgtatatatctatcactttatttttaagtactctgtcataatttctttaaacaccattttagcttattgaaggagttcaatgaatggcctttctagccaagggaaactgaagccacattttgtcttagccatgttaaagagaataactgactattaaatgaaatactttattgccagttctttccctattcctctaatctcttttatttttagtagagaaattataatttacatgtgtgtggtgttggtatgggtggaaagggaagagagataagggtgaataaaacttttctaaaagtaatcttcatcttgatcaatataataataatacattctacttgatctgttaaattggtgaagaactgtgattaaaataaaggagtatgtgatatgaagtcctaagaatagctaatttataaatgtttcctttgttaagcccggcaaaattattgtcatattttccatatcagcaatattttattttaaaacttcatcctcagcctaaatcatatctaataataacttggaagattttgtatttacttataaagaaaattgctgtcataaagaatgactttgtaatgggcatatgtaatggttgataaaagaaaattatgttgtcaagtgcacactctcattggcaaaattatgattatattttttacttcattaaaagccctccttgaagcctaaatatatagcaatactctaaaatttcccatagccagtttaaattacttttatctttgttttactatttggtggcagaggattgaatttagatagctctcttgataatatttaacactttgctgctgctaagccaactgaattgaatcctgcaaacttaattcctttgggatttcccataaattttcatcactatttttttagtaaggatgattggttgatgaatatagcaactaaaatgaacttgctacgtttcttgtttatctgtattttcacaaagaaagtgtcaggttttataagttaagattattctacaataaatgttagcattactctgaaaaacagaaccttactattttcttattctttcaacatatgaaagctgcacatacctaccttttaagtatcacatataaaaaataatttttatatcaaagtaataacaagacactaaattgacaaagttacaatttttcaactagtttttcgtaactgtccattgaagtttgttttaagacatcataataaatgatatgttagtaaataaatatgcttttatagaaaggcttataaaaggtgggaattggcttggatgggacaggatgttggcttgaatggtatagtgccaactgaatttgaacctggctgtattataaggtgttgtctgtgggatggttgattcttaacagcttaaaaaaacattactctcaaagactcaactcttaaataccaaagtgatgatttgtttctttctctggctagcattaaaggcaaccaagaaaaataaccatttttaaaatgatttgcatgattgcattaaatatttattcttgttatgaaaagtcttctcagagttatccatatttagctcatggcatgatgaagcatatgatcctaatttacaaccttcagtcttttgaaaaagtgattataagagtttgcctggacccacttttatgttttcttctttttatctggatgttttgatagatttctctgacaaaagttcttttgaaattcttcccagaaaaataacataggtctatatagaaagtttataaatatagataaatacatcaataagaaaagtttagaatgtatcaagagaactttcatttggcaatttggctgattagatttcacaagctgtctggttttgctgagcttatcctagagaggaataaaacatcaaattgcagaaacttttatggaagataattcagaaagctgtgaatttttaatgacaaatctatttttgaaatttgctagcctgtttttgagatttgctagcctgttttaacctcttgcattcagcattactattctttaaacttcgtatgattattgcatattgcatattattgcatattatcaaagttctggttagtcttggttttgtaccttcctgcatcatcttttagtacagttataaaatctgtttcaagaaattataatttttcaaatcagtattaaataaggattcatagtaggactatgggagctgctcaagggttagaaaattagccttttctagtataaggaaagggctatggtagaaagagcttccaaaaagttaaggactatggacaaaattcttgatatttttgtgaacatacgttgtcaaatcttacgtttatgtatctaggagtggaattactgggtcacatgaaaactctatgtttgtccttttgagggactgccaaactttccccaagcagctgcatagcaataaatgggggtttcaatttctccacatttttatcaatgtttgttattgtctttttgattaggagccatcatattgcaagggaatgaagtagtatctcattgtggttatcataaaactttttttagccaaaattatcaaacttgtttgatatctccaatgattcagtctgtgtgaacttttattcatacataaaaatgcttctagcttagtaatttcttgagaatgaatttttttaagacatattcaaagttttagaagttcatttttttcttctctggggattctttatttctctaaattagaattatataggtacttattaatccgtataagtcaatctaaacaggaactctgaaatttaagattacttggaatttaatatctgtctgtctggactaactatccctaggatgcaaagtaagagatttttatgaccagttgaaaagactgctttttaagctcacaaagagaactagcagtttcagttttatctctcagccataggtccaagattaacagagaaacttaagtgcctactttaaaaggctattctttcatggtgcataatatattttctctagtgaactttcagtagcatttgaacagatgcacataaatactgacaaccaaattttctgtcatctgccacccaactttcaatatatgccacatacctgccatccaacagatttcatggacagggagctcctgaccactcaacagcagttacttataatggagcttctgcaccatggagctggaaatggggataagaaatgttggtagccgtttcctctgggactgatactgtagtctttcagaactggggagagagagagcccattcacttggccgtacctaccaagaatagaatttgcatcttgctgagcatggagcagagaagaaaggaagttggttgtggctcaagtctcttgctgttcttataaaaatttagtagagtttctctaacagatgtttctacatttgctgtatacacttcagacaattttcagatactttaaatgactgtttttttttaaaaaataatttttattagttgtagttgttttgctggggagaaggatctgcagaggtcctcacattaccagtctggagttactcaaatagactcttcatagttttgtgttaattcatccattcacttatttatttattgagttatttatttttgagacagagtctctatcacacagactggagtgcagtggtgcaatcacagctcatggcaacctaaacctcccaggctcaaaccatctttccacctcagtctcctgagcagctaggaccacaggtgtgtctggctaattaaaaaaaatttttttttaaatttttgtagttatagggccttcctatgttgccaatgctggtctcgaactcctgggctcaagcgatcctcctgctttggcctcccaaagtactggaattataagtgtgagccaccacagcagtctttttattcattttttattcatttatttattcatttgttggcttactgtcatcagtagtctcatatataattatttttatttcaaaattactatctcattcttttcaataaatgcattttacatggtaattcatgccaagatgctctctttctgttcatcttaatataaacgttatttgtattcaagaaaattcaattgcatttcatcactaagcttacttttgtttaaccaagcagccactaaaattaattattataattaagagtaaattctattccttgggttacatgaactcattcatttattcatttattcagggatttttaatttaattttattatgactacattaggttaaatagttaatatgcaatgcagataataaacactttcttttgcaagtttattatttaataaattcaacttaaaatgtgtatctatatgcatatgtatacgtatagtataactataatgctatgttgctgcataataattttatgaatgttatattaaagaataaatagaattccctcagatttccccttagtgtacaggatgacaactgtctagtaattcagccagcaccccaccaaaccttttagtgccaaaagcatcttgtgctgattttcttataagcctcaggtctactagactatgactattcctcatattctatttattaaagcaggtttgaagatattttttaaattttggaaaatatgttctaaatttattagttttgcagttactttaaaaactttaaaaatatgttctaaagcttgtaaccataacatgaaattagatatgtagatcttaaaaagtccttgtttttatatatggccttactaaggcatttaacaaatacatttattcattggccgatttattttgtttttgtatgtatatatgcaatagttttttcatatgtaaacttcaacagcaaatattttgttttcagaaagtaatccttttgaatcactttacaatggtggcaaaataattttgtgcatttaatttatgaacatctttgttataaaagacttaatttttataaaaatcaatcaagttgtttttattgaccaataaagtgctgttacagcaaattacatgggaaagagtagaaaactaaatctttcagggagaaaataatatgccttgtgactcttcaactacttctatggaatttgaaaatgtctgtgtcttttaaactacatagaaacacagaagaccaacaatgtcagtcactgagccaatgtgcaattataatgtttttcagtacaagctaaaccaggaatgacaatcacaaggagaagatgcacttgacggacagtatcacagaagtttctaggtagggcagtaagtcaagcctcagatcggtagttgggatttttcttgttttgtttgttgctgtttttattgtttgtttgtttgttttattttgcttttagacatggttaaaacttgtattactttttacaattactttgttaaattacgtgtcagactagtgtatgatggttcccctaaaaaatatatcttctgaaatctatgtattttagttctctttaaaatttactattgctagagatgcttaaattgttattagatatcaaaggaccatttgggaggactcttgtatatgagatttatgcgtcatatgcagattaacttcacttaccagctatcaataactactaacttctcttagtatatctttctcttatatactttcatacctattttcagtttttctctttgttgaagtactttttgtcaaactttttccagttgatgaagagctgtctatcaaagggtcagagcagctcaaatgccatcctccatgcagagtgctccctgagtgtaccagccagaattagctctttctgcatcatttacacttcatcattatcacagattccattttaatgtgtgagtttctggcaggtaaggaaagaatatatacacccttgaatactctgataagcacctggcttgaagaacaaataaaagaacataaaatcctggtggataatagaaatgaaaccccaccaggagcggtagctcacgcctgtaatcccagcactttgggaggctgcggggagtggatcacctgaggccaggagttcaagaccagcctggccaacatggcaaaaccctgtttctactaaaaatacaaaaattaaccaggcgtggtggcaggtgcctgtactaccagctacttgggaggctgaagtgggaggattgcttgaatccgagaagtggaggttgcagtgagccaagatcgcatcactgtactccagcctgggcaacagagtaagactccatctcaaaagaaaaaagaaagaaagaaagaaatgaaatactaagttaggtgacagtactgttttgcttcttaaaatagttcagtggtgatgatgtggtcaaaggacaattaaaaacaatggaactgggtaggggccagttaaggggttatgagaagacatttacacaaaatataccaaataaatttcatatttgttgggaaaatgctaattaaatgagagaagaaataggttcgtttcaattctgacatattatatgtgtattaaatattaatagtggtagctgcagtaaatcattcttagaaactaatgtttattaggcatgtctttctcaaacactagattgatcacaaggcctaattcctgtgatgtttatatcagagattacacaacagccttagcatttgctggtatcagcccgattccattctgtttttttgtttgtttgttttgttttgttttgttttattgtgttttgtttttgagacagggtctcattctgttgcccaggctctagtgcagtgccatgatcagggctcactgcagccttgacttccctgggctcaggccatcatcctacctcacccttctgtaactgggactgaagtgaagtctcctgtagctgggactgaggtggctgaggccatcttcgcttcctgcagctgggactacaggtgcctgccaccatgcttggataattttgtgtgtgtgtgtatgtggagactggggttttaccatgttgcccaggctggtttggaacttgtgggctcaagtgatcctcctgcctctgcctcccaaagtgctaggattacagttgtgagccactgggccttacccagttctattgtttttaattgttactctttgactacatcatcaccactaaactattttaagaaacaaaacaatactatcacctaacttactatttcatttctattatctaccaggatcatatattcccttattttttatttaaacttctgtcttttcatggagattgaggaaacaaaagactatcctcctgccctcactgtgggttaactacaagtacatgtatctcatttttcccaatctatatttgattctatttttcctctaactttgaaactttaaaactaaagtttcagtttattttattttattttattttattattattatactttaagttttagggtacatgtgcacaatatgcaggttagttacatatgtatacatgtgccatgctggtgtgctgcacccattaactcgtcatttagcattaggtatatctcctaaagctatccctcccccctccccccaccccaccacagtccctagagtgtgatgttccccttcctgtgtccatgtgttctcattgttcagttcctacctatgagtgagaaaatgcagtgtctggttttttgttcttgcgatagtttactgagaatgaagatttcccatttcatccatgtccctacaaaggacatgaactcatcattttttatggctgcatagtattccatgatgtatatgggccacattttcttaatccagtctatcattgttggacatttgggttggttccaagtctttgctattgtgaatagtgccacaataaacatacgtgtgcatgtgtcttcatagcagaatgattcatagtcttttgggtatatacccagtaatgggatggctgggtcaaatggtatttctagttctagatccctgaggaattgccacactgacttccacaatggttgaagtagtttacagtcccaccaacggtgtaaaagtgttcctatttctccacctcctctccagcacctgttgtttcctgactttttaatgattgccattctaactggtgtgagatggtatctcattgtggttttgatttgcatttctctgatggccagtgatggtgggcattttttcatgtgttttttggttgcataaatgtcttcttttgagaagtgtctgttcatgtccttcgcccactttttgatggggttgtttgtttttttcttgtaaatttgtttgagttcattgtagattctggatattagccctttgtcagatgagtaggttgagaaaattttctcccattttgtaggttgcctgttcactctgatggtagttcctgttgctgtgcagaagctctttagtttaattagatcccatttgtcaattttggcttttgttgccattgcctttggtgttttagacatgaagtccttgcccatgcctgtgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcatgtttgtcaaagatcagatagttttagatatgtggcgttatttctgagggctctgttctgttccatttatctatatctctgttttggtaccagtagcatgctgttttggttactgtagccttgtagtatagtttgaagtcaggtagcatgatgcctccagctttgttcttttggcttaggaatgacttggcaatgcaggcccttttttggttccatatgaactttaaagtagttttttccaattctgtgaagaaagtcattggtagcttgatggcaatggcattgaatctataaattaccttgggcagtatggccattttcatgatattgattcttccttcccatgagcatggaatgttcttccatttgtttgtatcctcttttatttctttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaatagccctggccagaacttccaacactatgttgaataggagtggtgagagagggcatccctgtcttgtgccagttttcaaagggaattcttccagtttttgcccattcagtatgatattggctgtggatttgtcatagatagctcttattattttgagatacatcccatcaatacctaggtttcagtttttagtgaagagtaaaagttgtgatcctaagatgaattagtggatatggtgtataaaaggtaatagggagtgtctaaaataaattaagaaattgtatattagcacttcttgtgtttccacctcaaaactattctttaaaaagcaaagtaattttgatgagtctgttttggatgtctttaatgtttccttgtattcaagataaaagaaaaaattgtataaagacatggataattggcattgtcttattaaagttgcttagttctttgtgtggtcttttgatctgtaggcatgtctttctttatccttgatcattgtttctcagctacctactttgacctctcctttctattatccaatgtatgttgaattttctgtacctaccttctcatactttttctcatcatcttcaccaccttccgttagtaatatttttcaaaatctcaaagctactcttatatgattattcatccaggtaaatttgaataatctgaaaacaaaattttgttgatagcaggttgtcctgttttcatggaagaaatgtcttctcataaccccttaagaatatgaattgcagttttctttttaatgtgatttccccaaattcttgtaatactgtataatatggctgtctcttagagaaacatttgctctgattcctcagtaaagttccactttttcaagttttcatccattggtttgtttttggacttttatattgatcttcttctaaattttagttttagataaagaggagagttttacttttctatgagtcccatctgtccatttcttgaaaagtctatgaaagatgcaacgagtaggatgccaggcagcagggagttcagggcagggtttctgggagaggtctctctctgggccactcccactctagcattcctagtctgcattcctttggtagcgtcctcagtagtgttcaggggattcagatttctttccccacagttgtcccatggatcatacttgtctccagcctctggaggtgcctctgaacttccaagtatctataacagagttctaattgtcctagtaaacagtgaggagaccaccaaagaggcttcagcctggtagtcaaatatattagcagatgtttaataagcatctcaaatttaatgtgtaaaacccaatccctgctttagctctccaaaccagcttattccagccttcttcactgtagcaaatgactaacacattattaaagttaacaaaactaaaaatcttggaatcctcctggcctttcctccccctgcatccaattcatcaggaatttggctctgtcttcaaaatatatccacaatgcaacctcttcttaccacctccactttcgccaaactggtccaagacaccatctagtctggtttattgcattgaacccctaattggcctttccttctcaacccctcatcccccaccccactcccaaagacaaatctgagcaagaataattgtttgaatgtgtaaaccagaccatgccatgtacatctctgctcagaaccctccaatggcttcccatctcatccaaagtgaaagcaaagacccctacaattgtacccaacaccctgcatcatctgtactccacacatacacacatcctctcctgtcactgtcctatctgcctgctaccttctgctcactgtattcttcctggccccagtgcatactaaacaaagccctgcctcaggctgctagcataactctcttttcctggaacattatttccactcctcactcccaaactctcttcaggtctctgctcaaacattaccttatcaaagaggcccactgtaattactccatgtaaaattgtagccacagcccaaccatagaacatcctttctttttaccatgtttgatttttctccacagtacttcaccctgtgaaatatatatctacctctttcttttctcattgctagctctgtagaaaagggggactttaactttgcagtattctcagtgccaacaaacttgcctggcacaggtagccactctaaatatgtgatgaatattgagaagtaagtgtttgacttctgagtttgtggagtcagcttcatgttaccagggcaaagtatcacttctaaattggcacaatccctgtaccttgagaatcccaacaggcaaagccctgctgtacctggtatgctatatttgccatggaaaggtaatgaaataaatgaaatttgcagccacagggcagtgtgcagagtcatggtatagttattaaaggctttttctgccctcacccacttcacccccaatctatccttgctctaggatcatgtgtcatttagtttagggttctctggggaaaatctgtttatttcaaagccttccattcatccgtcttggatcatggattgaccattgttttactaggcttgattctcgtctgtatgacttccaaaattttctcaaggtttctacttgattaatgatttccatccttgtggcatggaatatgtctatattttattcttatttttatgcttttatagcatttgaaatattaggaaattgtgtttttgaactgaaactttgttgagtaattttgataaagttgaacttttggaaaaataatgaaaggccttgaatagaatagtagccctctgccaattgaataacttttagcttttatgttgacattttacacgattaatttttaaactttcttttgaattctagaataagcagcaaaaaagaattaaaaatcacttttttagtaaatatattcaaatattactttagtacttttattttctttcttataaaccccaagtgttttttcttctttaattcttaatatttgcaactgtaactgggctgatcaccaattagtgaaattcagtgagtttgtatcctagtgactgcaatgggaaaatacacagcaaaaatgcaaatgatattgaaatatcaaataaaaatataggattctcaattagtggttagtcctatgcaataaatgctatatgcaagacactttttaatcatttcactccttgccctaaaatacataaaaagacaccaataatgtaacctgtagtatattcattttttaataatgagactgttttatgaactataattatgtcaaatatcaaatgaacattaagtaattattctttaatgcatctcaaagttattttaaagagaaaaaagtttcaaatgtagaaactcattgttgaactgtagctactttgtcattggtgaagtaagatattgtgatgattagagaaaatgaggaaattagaatttgacttgacacaatgtagtaaatgtaagtaagtcaaaaatatacttttataatttgtttttaaatttgtgtattattttaaatgtgtacagagtagtttctaatatgcattatttcatggaattgtattcgcactggagtcgtattagttattacaggcaaaattctttataggtatataagaaaagtgaggccagagaagtttagtgattttctatacatcataaagttgacagcatgtggttgaaaatccagggcacatacctcagagctcctgacttttaaaataagatcatttgattaatttatgtcaagataaattattgttataaaaattttatgctgcttataacagattttaaaggaaatatcaaattttttttgttaattccttcactttgctgtttgcttgggtgacatgagccatgcttaattttcatggtgcttttgctcagcctttatagtgctgaaagtatagtaagcactcagtgaactttgaatgaatgagtgaatgaatgaatggtacttctctgtaccttttttttccttaattatgttgttttgaaactccagtgtttaaaactataaaacataattttgtattttaggatatgtttcctaaaataaaatcattagaactgtacttagctattgttgtggagctgtcttatcaaacctatgatctctggctttgcattctctactctattcagattttatggtatgagagggatgtttggtcttcttcctcacacaaagttctagaagatacttgagttgagcagaataaaaagaggctcccaccagcttttttgtttatccatgtccaaatataaattacctactgaacgctgcatatatgataagtggaaacagataaattttattgttttggaccattcactcaaatctttcaagtaacccagtttctgtttcatgaatgtttcttaatcttacacttcttggtcagtgatttattattaattggaatgtattgcttaaattcatacctttgattggcatatgagtttgattacagacattcaattttcttagacatacctaaaatagcacatttttaacaaagaatagtattattagaaactgatttcatccattattttaattcacttttttattagaaagagcatctattgagaattctgtgacctaaatacataatgtatatagtatttttgctatccttcgtatgtcaatcaaatgtacagtgtcaagttgatgaatttacaaagcgattaaatttgttacctatatttgagattgcctttatctaggtttgtcaatgctctgtaagaatttcttcccgcttagacttttggttaatgcattagaaagtatttgagtaaatataattttctaaaataatattattccataataagttaccctatgtttttgtgatttttaaaggcttttgctggtgttatttttgctttttaatttcaggaagctaaaactttgtaacaaattgtactatgtgaattggatatagcaaataactaatttcctacatctcactcaactgtggggttaatattatttaatgtatggtatatatgcaaaaatcacagctcgaggttcattaatatcctttatttcttttttcatatcttttatttcttatattaagatgctttcatttgaacccagcttttttttgcttgcattcacagaaaccttcaaaaatatctttaaaatatttcattctaaattgtgttacagatataattgtacatgtttaaacatattttagaactagagactatggctagcagaaataattcttactgacaatataaatatgtaattactatatatttttgtttaggaatagtatacatcttttctattcctacttaatgtatttcttgtgacattgctgagatgactactgaggcagtctggactagagtgagaagcactgcagtgaatgctagagaatctgagtttagtcacaatctaaactgtcttctaaggattggcaactcacttgaagtatctctgcctcaacttttatacagaaaaataggcagtacccaacaccagttctcttactgtttggcttagaccatggtgagctttattaggttggtaacaagagtcatcaagatgtgtaagtacagatgttgggggaagggatgttgtcacatcagaaactaattctgagtgggggtcaaggtgtacaaaaacgagatgaaagagaactagctcaaagaccattgtcagaatccaagaaaactggaagtagtctgaagacagttgtactgtttcatataaatgtaacacaggatgcagttccacaaatttatactcacatgatttactctttcaaatccccacttacttacatttaggcaactatttaatcatcttaatttccctactttatagaggtctgcaaactttttctgtaaaggatgagagagtaaatatcttaggctttgtgagctttacagtctcagttacaactactcacatttgtctttatgcctctatatagccatagataatacaaatagatgtggccatgatccaataaatttacatatggaaactgaaattttatgtgtcatgaaatatcaatttttaaatttcttctctcaccattaaaatataatagctattaatttacaaaacattaccattgaaaatatcaccaattgtggaggcagacatttttggactaatatttattgagcacataatattgttacagtgctgtcagttgtaagtgtgtgtgtatatcataaattcgtgtgtttttatttaatcatcatgacaaccttattaatatctccatgtgacagatgagaaaattgagtcacaacccaattgctccaggtcatgtttgatttgctctatgcttgtcttggagaattccgttcctcatatctggtcactttaaactctaagcaagtgtatacaaatcttctgaggtgcttgtttaaaggtagatttgttggtgtcactcccagaaattttaattcagtaggtttggaatggggctaaaaaatctgcatttctttctcttagttcctgggccatagaaaatggatggcaggcaggatttggcctgtaggtcataagtttctgacccctctttagtacaatagctctctcttctgatcattactgccaatcagtcctaagtggaacaaaagaagcagtaagaatgttctgtaagtatctgttaagtctgtttgttctctggtatagtttaagtctattgtttctttgttgactttctctcttgatgatctgtctagtcctgtcggtggaatattaaagcctctcactattatggttctcatcagcacatgtaacattctccaagatagaccaaaacaagtctaaataaatttaagaaaattgaaatcatatcaagtatcttctcagaccacagtggaataaaactggaaagcaactctaaaaggaaccctcaaaactatagaaatacatggaaattaaataatatactcttgaaaattatatttaggttaacaatgaaatgaagatggaattaaaaaattctttgaaatgaatggtagtagtaacacaacttatcaaaacctctgggatacggcaaaagcaatgttaagaggaaagttcatagcgttaaatgcctgcatcaaaaagtctgaaataccacaaatagacaacctaatgtcacatctcaaggaactagagaaacaagaataaactcaacccaaacctaacagaagaaaagaaataacaaagatcagagcaaaactaaatgaaattgaagtaaaataatacaaaagagatatgaaactaaaaatcaattatttaaaaagatatacaaaatcaatagaccattggtaagattaaccaacaaaagaagaaataagatccaaatatgcccaattacaaacaaaactggagatattatgactgataccacagaaatacaaaagatcattcaaagctactataaaaaccattatgcacacaaactggaaaatctagaagagatggatacattcctggaaatatacaatacttctagattaaatcaggaagatatagaaacccagaacagatcaataacaagcagtggtatctgccattataggaggttttttccactgattccccctgttattttttttttatttttcagtaattaaaaaaaattgccagtaagtaaaagtccagggccagatggaatcacagctgaattctatcaggcactcaaagaattggtaccaatattaccgaaactattccaaaagatatagaaagatggaatcctccctaaacgttctatgaagccagtattaccctaatacaaaaaccaggaaaggacataacaaagaaagaaaactatggactgatattcctgatgaacatagatgcaaaaatcttcaacaaaatactagctaactaaatccaacagcatatcaaaaagataatacatcatgatcaagtgggtttcataccaggtatgcagggatgttttaacataagcaggtcaataaatgtgatacatcacatatacagaagtaaaacaaaaatcatatgattatctcaatagatgtagaaaaagcatttcacaaaatccagcattcctttacgataaaaatcctcaacaacatagtcataaaaggtacctacttcaaagtaataaaagccctatatgatggatccagaatgaacattatactgagtggggaaaagttgaaagcatttccactgagaactgaaacaagacaaggatacccactttcaccacttccattcagcatcatactggaagtcctggccagaccaatcagacaagagaaagaaataaaggacatccaaattggaaaagagaaagtcaaacagttgctgttcgccaatgatatgattgtatacctaaaaaaccttaaagactcatccaaaaagctcctagagcttataaacgaattcagtgaagtctcaggatacaaaataaatgtacacaaatcagtgacactgctacacaccaacaatgactgagctgagaatcaaataaagacctcaatccctttcacaacagctgcaaaaaatttataaaatacttaaccaagcaggtaaaagacctgtacaaggaaagtgcaaaatgctgccaaaaaaataatagatgacacacaaaaaatgaaaacacatcccatgctcatggatgagtagaatcaatattgtgaaaatgacaataatacccaaagcaatctacagatttagggcaattcccatcatcattcttcacagaattagaaaacacaattctaaaatttatatggaaccaaaaaagagcctgaatagccaaagcaacacttagaaaagagaacaaatctggaagcatcacattacccaacttcaaattatactacaaggctatagttactaaaacagcatggtactggtataaaaatagaccagtggaacacaatagagaatcaagacataaagccaaatacttatagccaactgatttttttttaatactttaagttctagggtacatgtgcacaatgtgcaggtttgttacatatgtatacatgtaccatgttggtgtgctgcacccattaactcgtcatttacatcaggtatttctttaatgctatccttcccccactcccccaaccccacaacaggcccctgtgtgtgatgtttcccctcctgtgtccaagtattctcattgttcaattcccacctatgaatgagaacatgtggtgtttggctttctgtccttgtgatagtttcctcggaatgatggtttccagcttcatccatgtccctacaaaggacatgaactcatcattttttatggctgcatagtattccatgatgtatatgggccacattttcttaatccagtctatcattgatggacatttgggtcggttccaagtctttactattgtgaatagtgtcccaataaacatatgtgtgcatgtgtctttatagtagcatgatttataatcctttgggtatatacccagtaatgggatggctgggtcaaatggtatttctagttctagatccctgaagaatcaccacactgtcttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtttgttggctgcataaacgtcttcttttgagaagtatctgttcatatcctttgcccacttgttgatggggttgtttgatttttattgtaaatttgttaaagttctttgcagattctggatatagccctttggcagatgggtagattgcaaaaattttctcccattttgtaggttgcctgttcactctgatggtagtttcttttgctgtgcagaagctctttagtttaattagatcccatttgtctattttggcttttgttgccattgcttttggtgttttagtcatgaagtccttgcccatgcctatgtcctgaatggtattgcctaggttttcttctagggtttttatggttttaggtctaacatttaagtctttaatccatcttgaattaattttttataaggtttaaggaagggatgcagttaacagctttctacatatagctagccagttttcccagcaccatttattaaatagggaatcgtttccccatttcttgtttttgttaagtttgtcaaagactagatggttgtagatatgtggtgttatttctgaggcctctgttctgttccattggtctatatctctgtttttgtaccagtagcatgctgttttggttactgtagccttgtagtatagtttgaagtcaggtggtgtgatgccaccagctttgttctttttacttaggattgtcttggcaacatggtctctttttcagttccataagaacttcaaagtagttttttccaattctgtgaagaaaatcattggtagcttgatggggatggcattgaatctataattagtttgggcagtatggccattctcatgatattgattcttcctacccatgagcatggaatgttgttccatttgtttgtgtcctcttttatttcgttgagcagtggtttgcagttttccttgaagacctccttcacatccattgtaagttggattcctaggtgttttattctctttgaaacaattgtgaatgggagttcactcatgatttggctctctgtttgtctgttgttggtgtataggaatgcttgtgatttttgtacattgattttgcatcctgagacttttctgaagttgcttatcagcttaaggagattaggggctgtgacaatggggttttctgagtacacaatcatgtcatctgcaaacaggggcaatttgacttcctcttttcctaattgaataccctttatttctttctgttgtctgattgccctggtcagaacttccaacactatgttgaataggattggtgagagagagcatccctgtcttgtgctagttttcaaagggaatgcttccagtttttgcccattcagtatgatattggctgtgggtttgtcataaatagttcttattattttgagatatgtcctatcaatacctagtttattgggagcttttaggataaagggctgttgaattttgtcgaaggacttttctgcacctattgagataatcatgtggtttttgtctttggttctgtttatgtgatggattacgtttatttatttgcatatgtagaaccagccttgcatcccagggatgaagccaacttgatcgtggtggataagctttttgatgtgctgctggatttggtttgccagtattttattgaggaattttcttatagatgttcatcagggatatttgtctaaaattctcttttttttgttgtgtctctgccaggctttggtatcaggatgttgctggcctcataaaatgagttagggaggattccctcttttccttttttctttttttttttttttgagatggagtctcactctttctcccaggctgcactgcagtggcgctatcttggctcactgcaagctccacctcccaggttcatgccattctcctgcctcagccttttaagtagctgggactacaggtgcctgccactgcacctggctaattttttttgtatttttagtagagacggggtttcaccatgttagccaggatggtcgtgatctcctgacctcatgatccacccgcctcggcctcccaaagtgctgggattacaggcatgagccaccacacccagccagattccctctttttctatttattggaatagtttcagaaggaatggtaccagctcctctttgtgcctctggtggaatttggctgtgaatttgtctggtcctggactttttttggtttttagggtattaattattgcctcaatttcagagcctgttattggtgtattcagggattcaacttcttcctggtttagccttcggaaggtgtatgtgtccaggaatttactcatttcttctagattttctagtttatttgtgcagaggtgtttatagtattctctgatggtagtttgtatttctgtgggatcagtggtgatatcccctttatcattttttattgcatatatttgattcttctctcttttcttctttattagtcttgctagtggtctattttgttgatcttttcgaaaaaccagctcctggattcattgattttttgaaggtttttttgtgtctctatctcctttaattctgctcagatcttagttttttcttgtcttctgctagcttttgaatttggttgctcttgcttctctagctcttttaatgtgatgttagggtgtcaattgtagatctttcccgctttctcttgtgggcatttagtgctatagatttccctctacacactgctttaaatgtatcccagagattatgatatgttgtgtctttgttctcgttggtttcaaagaacatctttatttctgccttcatttcgttatttacccagtaatcattcaggagcaggttgttcaatttccatgtagttgagctgttttgagtgagtttcttaatcctgagttctagtttgattgcactgtggcctgagagacagtttgttgtgatttctgttcttttacatttgctgaggactgctttacttcccaccatgtggtcagttttggaataagtgtgatgtggtgctgaaaagaatgtatattctcttgatttggggtggagagttctgtagatgtctattaggtccacttggtgcagagctgagttcaattcctggatatccttgttaactttctgtctcgttgatctgtctaatattgacagtggggtgttaaagtctcccattattattgtgagggagtctaagtctctttgtaggtctctaaggacttgccttatgaatctgggtgctcctgtattgggtgcatatatatttaggatagttagctcttcttgttgaattgatccctttaccattatgtaatggccttctttgtctcttttgatctttgtcagtttaaagtctgttttatcagagactaggattgcaacccctgcttttttttgttttccatttgcttggtagatcttcctccatccttttattttgaggctatgtgtgtctctgcatgtgagatgggtttcctgaatacagcacactgatgggtcttgactctttatccaatttgccagtctgtgtcttttaattggagcatttggcccacttacatttaaggttaatattgttatgtgtgaatttgatcctgtcattatgatgttagctggttattttgcttgttagttgatgcagtttcttcctagcatcaatggtgtttacaatttggcatgtttttgcagtggctggtcccagttgttcctttccgtgtttagtgcttccttcaggagctcttttagggcaggcctggtggtgacaaaatctctcagcatttgcttgtctgtaaaggattttatttctccttcatttatgaagcttagtttggctggatatgaaaatctgggttgaaaattcttttctttaagaatgttgaatattggcccccactctcttctggcttgtagagtttctgctgagagatccactgttagtctaatgggcttccctttgtgggtaacccgacctttctctcaggctgccctcaaggatttttccttcatttcaaccttggtgaatctgacaattatgtgtgtgtcttggggttgctcttctcaaagagtatctttgtggtgttctctatgtttcctgaagttgaatgttggccagccttgctaggttggggaagttctcctggataatatcctgcagagtgttttccaacttggttccattctccccatcactttcaggtacaccaatcaaatgaagatttcatctattcccataatcccatatttcttggaggctttgtttgtttctttttactcttttttctccaaacttcttttctcacttcatttcattcatttgatctccaatctctgataccctttcttccacttgatccaatcggctactgaagcttgtgcatatatcacatagttctcatgccatggttttcagctccatcaggtcatttaaggtcttctctatgctgttttttctagttagccattcatctaatcttttttcaaggtttttagcttccttgcgatgggttcaaacatcctcctttagctcgaagaagtttgttattgtcgaccttctgaagcctacttctgtcaactcgtcaaagtcattctctgtccagctttgttccattgctggtgaggagctgcagtcctttggaggagaagaggcactctggattttagaatttttagcttttctgctctggtttctccacatctttctggttttatctaactttgatctttgatgatggtgacatatagatggggttttggtgtagatgacctttttgttgctatttatgctattcctttctttttgttagttttccttctaacagttgggaccctcagctacaggtctcctggagtttgctggcagtccattccagaccctgtttgcctgggtatcaccagcagaggctgcagaacagcaaatattgctgcctgatccttcctctggaagcttcgtctcagaggggcacccggctgtatgaggtgtcagtcgacccctgctggcaggtgtctcccagttaggctgcacaggggtcagggacccacttgaggaggcagtctgtctattctcagatctcaaactccatgctaggagatccactgctcttttcagagctgtcagacagggacgtttaagtctgcagaagtttctactaccttttgttcagctataccctgcccccagaggtggagtctacagatgcaggcaggcctcactgagctgcagtggggtccacccagttcgagcttcctggatgctttgtttaactactcaagcctcagcaatggtggatgcccctcccccagcccaggctgccacctcgcagttggatctcagactgctgtgctagcagtgagcaagactctgtggacgtgggacccaccaagccaggtgtgggatataatctcctggtgtgctgtttgctaagaccgttggaaaagtgcagtattagggagggagagtcccgattttccaggtaccatctgtcacggcttcccttggctaggaaagggaaatcccctgaccccttgcgcttcctgggtgaggcgaccccctgccctgctttggctcaccctccgtgggctgcacccactgtccaaccattcccagtgagatgaaccaggtatctcagttggaaatgtgaaatcacccatcttctgtgtcgatctcactgggagctgcagaccagagttgttcctattcggccatcttggaactcctcagccaactgatctttaataaagcatacaagaacaaaaattggagaaaggcaccctgttcaataaatggtactgggaaaactgacaagccacatgtagaagaatgaaacttgatcctcacttcttaccttaaacaaaaatcagctcaagatgaatcaaagacttaaatctaagacctgaaaccataagtattctggaagataacattggaaaaactcttctagacattagtttggcaaaaagttcatgactaagaccccaaaagcaaatgcaacaaaaacagtaatgaataaatgggacataattaaactgaaaagcttctgcacaacaaaagaaataatcagcagagtaagccgacaacccacaaaataggggaagagcttcacaaactatgcattcaacaaaggactaatatcctaaatctacaaggaactcaaacaaatcaacaagaaaaacaaaaaaaaaataattccatcaaaacatgggcaaagaatgtgaatagacagttctcaaaagaagatatacaagtggcaaacaaatatatgaaaaaatgctcagcatcactgattatcaggaaaatgtaaattaaaacaacaatgatataccacctgcaagaatggctgtaattaaaaagttaaaaaaaaaaaaaaaaaaaaaagatggtgacctggatgtggtgaataaggaacactgctacactgctggtaggaaggtaaactagtacaactatggaaaacagtttggagattccttaaacaactaaaagttgaagtgccatatgattcagcaatcccactactgggtatctaccaaaggaaagaagtcattatgtgaaaaagatacacgcacatgcataattttgagaatgaagatccagtttgcataattttgagaatgaagatccaaagttccttctcaaagcttctctatattcatgttttataaatttgcttatatcagagaagaaacacctaccccaatgaatatttccccatcaccagagtatttttccatatattttggtgcgtagtgatggtattattgatgttaatattttatatttgtctcttttcagcaaaaggaaaatatcagtagtttttaatttgtgagcttcaatttacttcaccaactatatctgcattcttctttctcagaggctaataccagtacatgctgtgatgttttttttttcctccttgtgtgttttgtgtcacttgtgtatattccgctgaaatgtattctgtttttcaacttttagggataaaaactgtgcagtgtacataaagttatttaaattatcttaattgattttcattaacttaattatgtcttgagaatttattttgtgaggccagcaaggaattcagtctcagtaatcattgaaatttagtcctccaattctcccaggacctcagagacatgccttatatagacactatcaaagcattataaaggcccctccagtcatcaattctacactggctagtacagacactctccagaggttctgtgccttacttgaagcatggctatgtttgatgaagctgaggccctgttcctctggtccagcttttgagggaaatataattaaaaataaaatcttcttccaacccagaaatcttctccatgaaggtagtagagaaagaaaacacttttttgttgaataagcattaagccaatatgtgatgcctatcacaggcaatctgctgagattgcagagacagaaataaatcttacgcttacatacaaccaagtaggtacaacccactccatacatgatctcaagattaaaaataactaatcctctagtaagaagacttggcagcagcagttagcgcacatagtttgccctaaattggtaatttgggtaaattgataactaatgtatgtcagggaattggctttgtccaaagggaaaataagcttctcctatccttatgacaagaggttatttggcaatgtggagcaaggtgcctgctgaagttagactactcttcctcacaaacctagagaggggcgctatcttcctggatgattgcatttcaaacagatggctccaggtccttaaaaaagacaatactgggtgttaaagctggcaaaagtcttatttaaccttaaaaaagatgtacatacatttcaaaggacagagaaattttgaattaaatgctccaagaaaaccagagaaggagggagtcctttcacttacttttaagaaggaaaactgtctcttcctctcctctccacttccttcccctcccctccccgcttcttgtccttttttaaaaaaaaattgtatttgccccctttaaaaaaaatgtatttgcccttacagagcttccctatacccagaacacagccatcctcttaaaagtgttaccacatttcccaggacatgactagctaaccacgagtgagtctctgctggtccccaggctgccagcctccagtttcttcaagaatggggaatcttccaggattcctctcttaaaattcacaatgtgttttctattgtacagaaaaaataagaagtccctgagacaaataaatcaagaatatttaatattttgtctgatttgaatgtgactttaaaaatccaggaacaacaaacacagattagtatcttaaattactttccaccacaccactatcattacttttactccttaaatatgtttgaaataaaccaaactgaccagacacagcaatttttttgtggaaatatttcttccttctgtagctttactaccgtatacatcattgaggtgttaatttcctttgtgagaataatattcatctttaatattcccacattgcatacagtaattccagatcattttatgacattaaatcaactcagaatctgtaacatagcataattattgttcccatttcattactgcctttaacaaattttacagatgtttcctccacattttaaattgtttccttcaaaattgtttttaatattctttgttagctcttctggactccaggaagcctgtgtctttttatctgtcttgccctaaaattatctttgaaaagttaaactggtggcaagtttacatatggttaaagaaccatttatattgatctatccttatgaaatattatctgtgaagcatcataatattccataattacctcagcagcatgtgaatctgtgtgtcaaatggcatatacatttcactatatagagaattaataattttcactgggtataagaggtagccatgtttaggatgatgagattagtgacacactaggagttggatcattttggtctgagttgcagtcctgtcacctgaaaaaagaaaaatcacagcttccctagatttttttgcttacttgtaaaaataagaacaacagtattacccaatacatacttctcagagctattgagcagatagaagtagtaagaaatttctaacgtcagattatattttataagtataagagttttctagtttatgttttcttgcatatgatttggattctaagtagaacagaaagatctagataagccttaatcagtactgctcatttaatgcagatgggaccctatgtgatttacttctcttaaaatgtattaaaccagagaaaactgctaaaaaaaaaacggacagttcagctttgttggcttgtaatctttgtggtaaaatggtaactgcattcaaccattactttagggctgcctgaccaaatggtctcgagaaacatacatgaattttaataaacaaaacatggcctggtaggtcacagtgcaaaactagatcatttgtaacttatgatttctgttcaattattgtgatgtatgacttttctatgactccttctttacaagttttcttttctacctacattatttcaggataatatcattttcagtcttgtaaaataagtagaattaaaaccagtttaataagttgattttagttagaaatctcaaccgattttgtttcacttactctggaaaaatatatttatttatttatttactttatcttgctggctattttgaagttgaaattattgttttctctgaatgcaccaattatttgtgtgagcccaaactctctgactagatgattattccagaaaccttattatttaatatgttgaatgacatttacttttatgtggtgtaagccattcccagctactttttttctgaatgtattattttgtatactcgccttacttttcagagaaaatcattttttaccttattcatatattcatttcttttctgtgaggtttgaatatttttaggtcaaaatttaacagtgctactgctgtgccattaagcgtaaattgtgtatattctgcttctgtttttaaagtataatatcaagataggaaccgattatgaaagtaggtcataatgagggataatctccttagagacatgtgttttggggatattgtgctgcttgatccactaaattctattatggtagcagcaagatgatagtgttattggaaatttttagtttagtccttttattgttttagttattatcttttcttccaccaacaccacattgctttgaaatatattttggaatacatatatgatagacatttgtgttgcaggaaaatattatgtcccacaactatttggggagttcataaaaggtaaaaatattgacattttgatatgccttgaggaaaatacactaaggcactgaaaaataatatttataagcccatagtaagagatacaaaggccaggcatttctttgcaaaaataaagaaattggcaaaatatttatcaaaaagccttgagagactccccaaaacaggaaatattctatcttgttatttcaaagaaattcaacagttcagaaagtgcaaagttaaaaatgagagggaaagaaggaaatagaaattgatcaatttggtttcccaggcattgattaatttcctatggtgttcttaatatatctttttgacttggttccttcctttctaatagagaaagtaccatctcctacatctgttgatatttcaaactgtgattggaaaggagagattcattaatcttcattcttcaacattaagagagttagaactctcctatactgagcatagtggaaagtggacctgtttctctctaaagataaagtaggagtatgatgacctaacaactgtgactaaattagcattattgacaattagtgtcaataatatcataaagttaatatcagggaaacctgccccgatagtcacgtaggttcttttctgttttccctaagtgtcggcaggtttgagaaataaagggacagagtacaaaagagagaaattttaaagctgggcgtccgggggagacatcacatgtcggtatgttccgtgatgtcccacaagccacaaaaccagcatgtttttattagggactttcaaaaggggagggagtgtaccgatagggtgtgggtcacaaagatcacgtacttcacaaggtaatagaatatcacaaggcaaatggaggcagggcgagatcacaggaccacaggactggggcaaaattaaaattgctaatgaagttttgggcaccattgtcattgataacatcttatcaggagacagggctttgagagcaactggtctgaccaaaatttattaggcaggaatttcctcttcctaataagcctgggagcactatgggagactggggtttatttcatccctacagtctcgaccataaaagatgaccacacccaagggggccgtgtatagacccacccccaggcgcatattctctttcccagggatgttccttgctgagaaaaacaattcagtgatatttctcccatttgcttttgaaagaagagaaatatggctctgttctgcccagctcactggcggtcagagtttaaggttatctctcttgttccctaaacattgttgttatcctgttcttttttcaaggtgccaagatttcatattgtttaaatacacgtgctctacaatttgtgcagttaacgcaattatcacaaggtcctgaggcgacatacatcctcctctgtttaggagatgacaggattaagagattaaagtaaagacaggcataggaaatcacaagggtattgattggggaagtgataagtgtccatgaaatcttcacaatttaagtttagagattgcagtaaagacaggcataagaaattataaaagtattaatttggggaactaataaatgtcatgatatcttcacaatccatgttcttctgccatggcttcagtcagtccctctgtttggggtccctgacttcccacaacaagttaattcataaaacatgtattacttgaaaatatcaccagttgttgaggcagacatttttggactaatatttattgggtacataatattattgtagtgttcttagttgcatatgtgtatgtcatatatccatatatttttatttagttgttaaggtaaccttattactatctccatgtgacacatgagaaaattgagtcatagcacaattgctccaggtcatgcttgacttgctacatgcttcagttggagaatggtattactcaaatatggtcactttaaactctaggccagtgcagacaaatctcttaagagactcatttaaatgtaaatttcttgggcccgccccaaacatcttatactatcatattatgttctaaacatagaatgtggtttagtaatgaagtaatatctcatttatccaaaactcagctctctatcaacttcacctttcttgtctgaaaaacagatatttttggactaatatttattgagcacataatattaatacagtgttatttgttgtatatgtgtgtaaaatatccatatgttttttattaattgtcaagacaaccctattactatctagtcatgacaaatgagaaaattgagtcacagcacaattgctccaggccatgcttgacctgcttcatgcatcactttgagaatgctgtctgaaaaacagacaggcaacaggaaataagcaaaaaggtaatgtggaatttcacaaataatttgatcatgtcaaatccatgccattaattcataagagaacttagtgtactcatagtttattcatagctctctctcttttttttcttttctctcttttttttttttttcctgatacagagtctcactctgttccccaggctagaatgcagtggctcagtcattcatagctcttaaaatctaggttttgttgctagccttcaagtttgtagaatgcgttagaaaaaaagaaaggctgctccaatttagcagatatgctgggtgacaagaatcttacaacttcagaggatattcaaaactagaaaaacagacacaagaattcaaaaacttgcagtctggatctgacatgcacagtgcagctggcttgcacatatcagttggacttgactatttacagttctcctttgctgcagcatgagcaaataaatccacttcttccagtgatggctatagagagagaaaagagtatgtaatttagagtcaaatatactccatttggagtagtttcaaatctcagctcatctactcactgactgtggatgacaccaagttttctgcaactaggttttttgtttgtttgttcttggtctatgaggcagtcatagcaacaacctccctagatagagtaaataatgcaggtgggaaaattccctatcaggatacctagcacataatggaaatccaaaatctttcctttgtcatcttccaaaagcatgaaagatagttacagagggtgggatatggtgttaggcagctgaggactcagatcctggctgcatacttataagttggataactttaggaaaatgatttcaactctcaatgcctcagttttttcatttgcaaagtggagttagtaatgcctatttttctaggttaatataagagtgatcaataatatacatacagcacctttaatatattaggccttcaataaatgatgatagtaatgattatatttctaattttcaatgtcttcctttaaagacaatactgcagatgtgttatacattttggaaagatttgtatcctaaatcataaaccattagtatttcaatataatttattcatcaggttcctggttgtttatagggtaatgtttaagccttaccttcatacagaaaaaatacatactttattattgtgaatttttattgtgatatatatttatacttataaaaatatgtatatatgtggattttcatttttccttcattctcagcattacacacagctttatatctttattcttacaacattagcttgtgtagatttattttgagatgagaatttcagattttaatacactttaatattgatattattactgttcaggaaaataacagaaaaacatagttaggattctgaacttagaagtgtaaaagaattaaaacctggcttctctactcatgagtttcgtaacttaagatgatctatgtaactacactgagtctcagtttcttattcatagaggcaataatattctctacttagtatttggggatgattactagcatttataatgtgcttaacatgatacacattataaattcctaagatgaggtaggctagtctatttttcatttgactgtcacatttgatagtgatagtaataaaatttgatcacttagttttcaataattaagttctaaaaaagaaataaaaatacattctccctcatctcaaggacaacacacttaatggatagacaaacatgaacaaataccagtaagggtcacagatgttttagatgttttgagtaagttaaatgggagaaagaaagggagtgattattcaacctggagagataaaggctttccagaatgtgacattcagtttgagtacatttagttcaagcacaaaattttcgttaaatgataataataaatatataatgcagaagactggatcaaaatgctgcatagaacacatatataaacacctcaccacccacccaaaattcctttaaataacaaggagaattcagaacaaagttaaatgtaagaaaaggtgttattagcagaccataactttttagatactcctcaaagacagaaagcccaaaagagttcattaataaaagcaaaccacatgtcagctcaaaacacaagcaatagaaaattattacaaagataaaagctggagagtttattatgtttaatgatactcaatataaatattaaaagaagaggaaactgtcagtgcaattatcatgcataatgtcacctcactgtcaaaaatatcatgcatactgtcaagaacatttgaattcacctcacctcccaacactactccttacatgtccacttaaagaaaaaatgcagcagctaactctctaacacttgaaaacttgtagacagtactctaaggaaatttagctacttatttgaggaagatgcttagaatgggcatcggtgtctgagaatgaatgtttagtgtgggtgtcagggtatgagggaataggagagcctgaggtgacttgatatccaaaactgacgtggaaaggagaagaaaagaagttaaagcagctacatcacagggaaattcactaggatattctacaatcagagaacagccaactttgtttcaataagtgaaaaattgagaaatgtttttgcgggtttgggtagcagtgggtggtcactgccattctgcacatgtgtaagatgcctaagtgataaaacaaagccagtcagtcaaggtacctacccatttacaccaaacccacggtgaccccatctgtttagaagatggggacctttagaaaataaccctattacctgcacaatggcagaagaaattcattccagaatgaacaaagatgattccatgacatttgaaataacaaagatttgcatacaccaaataaaaacagtctgctgaggaaaggggcaatgagaggataagaatgagttaggaattaaaatagatttgcaaaaattatctttaaaagtcaatagaactggtaaataacagacagaactgaggacagaatcagtaatctataagataaatatatgatattttcactggtttaagaaaaacaaatagaatgttagaagagttagtcatagatgcttaaccaaggaagtctaacttcaagtaataggagttccagaagatgaaaaaagaaaataatcgagaacataaatacaaaatagaggaaaatattcccaaattgttaagcatgattgttgaaaaaatacttacacaaatatgcatcttggtggaattttattactcttagtataaacagaagaatcctaaaatatttcaagaaaaaaaaatgaaaaggtttacttacaaagaaaggagaaacattgcattctgatttatctttaacaaaatgttagaagttaattaagcaatatattcactgttctgaaacaaacataaatttttgaaatcgagaattctgtatctaactggttgtgagggcaaagttaacaaatttttggacgtgaaaacattcagaaagtttaccttttacattctctttctaaaataatcactccaaaatttagtgcaaaaaatgatcaaataatatttactttaggaagataaggatgacttaacaccaaaaaaatctaacaacataactcagtgtatcaaacaagtaaagtataaaattatatgattaaatcaataaatgcttgaaaaatgtttggtaaaattgacagccatttctaatgaaacactagctttaaatataatacagcctcctaaatataaataggaacatttaccaaaaattaacaacacttattatttttacaggtgaaacactaaaactatattaataaaaatcaaggaatgggacactaaccgattatcatttaacatagtcttggatgttttagttaatataataaggcaataaaataaaataactagaataaaagtggagagaaagaagtaaagatgtatctttttgttgactataaagttgtataccataatgaaaattattgagaaatttagtgaggtggctaaatataaatttgaaaaatcccatatgtatatcccataatttattcatcattcttgttgtttcaagggtttttaagaacaataccacagttttccttgtgcatatattcttagtagcattttataagaataaattccagaaaaaagttattttcaaactgctttccaaaaatgttttagcaattcagcagtgtttgaaggtatacatttctcacatagcaccaataataaatgttagtacttttcttggaatcttgtgaacatgatacatataaattaacattgtattattaatttaattatttgtatttctttgatttgttaagcttatgcattatttcatgtgttttgagacgtttaatttttatttttctgagaattatttgctcataacctttgcttatttttctattgagttgtatttttcttgtccatttgtaagcattctttgtatattaagtacattagcattttatatattaaatgtgttttaaatatatatatatattccaatctgatattgtgtgtttactttatagctttcttgttttgttcttctgtcctaaaattaagatgcaaagttgtctgcaaaaattaagtctatacaatcttttttttttttttttttttgagatggagtcttgctctgtcgcccaggctggagtgcagtggcacgatctcggctcactgcaagctccgcctcccgggtttacaccattctcctgcctcaccctcccgagtaactgggactacaggtgcccaccgccacgcccggctaattttttgtatttttagtagagacggggtttcaccatgttagccaggatggtctcgatctcctgacctcgtgatccacccgccttggcctccccaagtgctgagattacaggcgtgagccaccgcgcccggcaaagtctatacaatcttaatgcaaagatcgtatgtgagtctgtgtgtgtgtgtgtgtatgtatatgtgtatagacggttcaaaaaggtaggtagactttcctccttttaacttgtagggatatctatgatacatttttatctaaaaaagcaagttgctagaaatgtgtatacatcattttctttaaagaagttaattgatatatacaaatgaaacttattattttcaaatgtacaatttaatgtttcttagtaactttcagtgtttcttggtaacgttacagagtaatgcaatcatcagtacaaaccagttttagaacattttaatctccccaataaaatcccttaagcccatttacaattaatcctcattcctctccccagcttcaggcaaaaactaatctactttttatctctataaatctgctttttctggatttttcaaataaatgaaaatcaaataattttatatatgtgtaaaaatgtttgtatacgtttgtatgaacaggagaaagctgagaaggcatacacatctggctgttgacattagttaaagtcagagaagtgggatgagaacaagggaggcaaaacaaaaacaactaaatagacactcttaaataaaaaataattcaacaaaaaaatataaaaagtaaatttgcataaggcacattacaaaaaatgaagaaatatattttaaaaaatcaactataatgaacaatgaaaaatcattttcactatcagattgacaaaaattcagaagactaataacacccagtgttgttgggggttttgagaagtggtcactatcttatgttgctggtggaagtgtaggttactactgcttgttgtgaagggcaatttgttagcctccatgaacatttaaaaggagtttaccatgaacaattctacttttatatttttaaattctagggaaattacagatgagcagtgctatattttataataactaaattaaaattcctataaacacaaacataaatgcatataactgtttatatgtatatatatgtagatacacacacgtaggtatacataaagatacatgcctgtttctgtgtgtctgtgtgtgtgtgtatgtgtgcatatagtgttggaaggatacatatgaaaagactctggccttttctaggacctaaaaagtcctattagagctgtagggctcctcgtcttcaccacacctctcccaacttgatctcatcctctcatataatccccttcacacactggttactttgctgttcatgagcacaccaagtaaggtcttgacattttcagtttcctatacctagaatgacttcctttataagtctggcccaaggtttgtgcctctgctcatttggcatctcatcaaagaggccctttctaaaaacttcttaaaaagcactgcccacccactgctcctactctgcactggccctttgtgctaatttacatttcatatagcactacctaacatagtatatattgtcagtgtatctgcttcttcccactagattataagctttgtgatcttggagacttgtttccctagggtctggttagtacctggcacataatagacactaaataatatatattaaatgttatgtggatggactaaattataatagatttggtatgaagggaaagtttcagatttcagttcttaatatatatagttctttatttttaatatttttttcaaaagaatacatttccctaatgtgtacattgttgttttattaagttatttaaaaatcacagaccaaatgcaaatcaatctctcatctttccaaattaattcaggaagcatgtttttagttacattcttccaaatcacctaaacaaattctagcttaaaattaattaaaggccttaattttacataagaggcttgaagattgatttaagatattacatgaacagtatgaaggaaacagcaagttaatttctttgtatttaactttgtgggataaatgtagcattggtccagacagggaacagcttaccttatttctactattatgaaagaaaaatgttcctcattcttgtggacgtctgagctctgactaagtggagctatcttggtttagaaaactgttctgatcagtaatctataaaagactgatttattttattgtgaccttttttatttaaaaaaaatcacttgaactgccaacctttctaaagaatattgtcttcactttaatgcttttaaatgtataattatcagcaaggaacactattattttagtttctgtataatcctatctgccaagtagtaacagaattaaaaatcagaaattatattggtaacatagttaaacagaggctacagtctgtaaggaggttatctagatatcaaataattccaaggtatttcagtacatttagaattttaaaaattctttaatattttccctggtagaatttacaaagcatcaggaagagaaaatgtccctgtcatacagtatgacagataatggttaaatatttccacttggcatgattactatatttaaaacttaacaccttccaccctttatgatagttatttgtattttgtctgagtgtgtgagaaaaagcactttgatttctccaacaagaaagcagagccctgttatgtgtgttagtgctgtaagacctctaacttcccagagtttttgagatcagaaaagaagacatttggattgcatttcccatcttcagattatcaaggattacagaccattttagttcaatttcgtatttctgtccttaagagacatcaacatttatatgatatatactcaaatataactgttttcctgttgtcatatagatgtaaagatactttttagcaaaagtacatagttttcctaagggtttggggttgagaaaagtaagttgggaacaagtcttcaaggagggaggaatttatttcttaagatggtgatgttctctatccttccacaggatggcaggaaaaacttggtaatttacccagttgatgagtagtaggttatacatatctgtattttaaggtgggtatgacttccaatatttccaacaatattttgatagacatttctgcatatcttctaggagtagatgttttcactaatagtttaacaaactatttgaaacaaatctataaagttagccatctaataacacagttgtggagtttagataaagattcattgagaaactgtatggtctatgaatatatgggagggataataaaagcatcagtgacatagtgccagacagttgagcatgaaggccatcagcatgctgttactagaaaataactctagtggaacttttaatgctattaaatttccaaattccctcctccccctcaaaaaaagtttaaatgtacttccaggttttgggtatttaagtcaaatgactagtaaatctgataatccattattgtgacacttggtaaattagaggctgcaatttgaggcaaagttctcattaataagttacattttccctaagaataatagtgttgaatggtgtccagcatgcttagtactcagaagaataaaacttgccttcaaatgaaagaaaataaggagagtcctaattaattttccttacattttgacattttataaatttatttaaattttaccacacaatttaaataacccgtgatagagtaagtactaaagttttaaagttttaaataagtgtttaagcatagtgaaaaaaatctttggtgttatatttttaaaatgtgtttttcagaatttcatgataagtcactagacttggattaaagtggttggttctcacctcagctgagctattagtaaaatgtatcactgtggacaagttatctaaatgtagtttcctttcctagaaagtaacaggtattgaattaggtggcctattagcttccttcaagttctaacatttttgtaataaaaatatttttactttgtgttctttgataaaatattttatattatgcttttaaaacatctattaaaagtgacatactgcatttgtcttagttgctagtgggtcttttaaattttgtatgatgtcctataagagatcactgtttttaaatttgtacactaagtatgtgactggaaattaatttaatctggcccctctaaatatcaagccatttaatattttatctcttctggcagaaaaaaaaatcattgggttaaccattattgtcctccctttataggagaaaagtaaattgacctgctatatttacaaagcaggtatgcctaactccaaagatggtgattccccccctacagtgccattttaaatgaaaacacattattttttccttggaacaaaatatgtggtattttgttattattttaaagtgatattctgacagaaagtagtagaacatcgttttatgtattttaacaggttagatggtaaattccttgtctatgatatgacctctttctacttcctgaaaaaaggagacaattattcatatattattttcaaaatctatcagagctaccccagatcatcaataaaagatagctcttttatgagtggtcacagactgatctcagtgtgaaatcactgtcaaataacattttccattatgtatatagaaatgaggttatcgccagcttaaaattaagcagcaatcatcttgcaatgacagttgtttctgctttattataatatcatttccatggtaactaaacagagcaccataaaggaaggattatgctagcaggtgtgaaataaacagcaggaggacacttacaaaaactttataaaaacttgaagatagatgacatttttaataaacattgcaaccaacgataatacatatggacttaggaagggaataacaatttaacctagtatatgaagtacatggttaaaactcttctaatactaatttattagaagtagagaaatttatgcaaacagctttctccataggacagttttattaagcaggctatttttgcaaattctttgatcaccatgtaatcgtgatcaaagaattgtgatgtgatgtattggtatgtagtggataaaattatgtccagaatatagtgttcatggtggttgatgtgcctgttttcctttatttttaattgaaagctgtttccatttgtttctaacatataggctagtgataaaattctcttaaatgtgatatttatctcaagactatgagcagaaagatatattatttctttttaaatatatacgtagttgtggtttctgatagaaagaaatacattttagatgactgggatatggatttagccttgtttctatttcaatttgagccatatcaaaataggatattgtttaagtgccatggttttggagaaaagacagtcagcttaaattacttaatgagagctgggcatcataaagagagtccaaagcaaaatactgggttcacaatgtctcaacctatggccttggtatttgggaaaaaatggtcaattccagaaggtagatcttggtggaagtcaggatgaagtcaagaggctgtcagcaatggaatgtggaaatgtgtgcagtatttcacagcttctgtgattatgggctatggtactgaaggcagagaaaggaaggttctacgttgaaaccttggtgatgaaccagccttctatcacgctgtgttggtatttagttgatgtttagcactgcctgtgaagatcaaactccagtttgagcagaggttggctccagacaatgccaaagaggatacaattaatttctaaacatacttaatagtttctacattatcgtatttttacgtcttttctgctagaagcattgcacttcaacaaatgacacattactgcataaagccccatttcttgaatgaaaactctgagccatctatagtttttagaaattaaaggatagcatatgtatcctggaattggtgagtaaaaggacagggaaaagtaaagaaaggtgaggatggcaataatagcaagtaaacatgtcctggaccacagtattttgggtggataaaattattgcatgaaattcatggcttccagttcttccactatagcagcgaacgcaggcccgtattactaaagcagcatatcattatttaaccaatttaagatacagtcacaacaaaaatgacaactattcattatgcatctattaagtgttattcaagcagttggccattaacaaagtagtgtactttaaggccatattcatttttactcaagattacttcttgccaatgcctcaatggttctgaatttcagaaaagcagctaatatgcactctgttagagaataaataaggagtaacatctacttaacttcttgagtagagcaggagtttgagatggaagttctaaagaatgtgtctcctgtcttcatgaaatatcagtgatgtagtatttttcttggtcactttgcccgctggggtcctccgtgaagagacatgtatcaagacgtagacatttatcaaaatgaaagtagaggataaagacagctcaaaagtcctaaggctgctgacatgaacagataattggtggctacagttgtgcctgctaagatttgggtgcatggggcttcgctttggttagctcccatggtcttcttttccaaaaaaaaaaagaagccttcaggttaaagacactccatttacccccagcacctggcaggatttgcaggataattgcccagaattagaatattgatctagttttttacattacccatcccttttatttcttttgagctacagctggagatcactgattggttcacaggaatgagggttagtctaaaatgcagacaaaaacttaaaaacaactaatgagactagaatgtaatgacaagtgtatgataaggattttttttctttcttttttctttttttttttcgagatggagtttcgctcttgtcacacaagctggagtgcagtggcgtgatcttggctcaccacaacctctgcctcctgtgttcaagtgattctcctgcctcagcctcctgagtagcataatttttctctctccagttcttttgttaaaaacaaatcataatagaactgagttgtttgtaaaataaactttagtcttatacttggcctgattatttgcataaagtgcagcaaaaataattatgtttcccataggctttttaaaattggctttgatggaattctgcttcataaggaatctcagataagaccttttaaagccaagcccagccatgggtttgcaccttcaaatacctatgaattgggtaaattcctctcttcttgatgtccccaagataacttgggctcctgggcctattagaaagtgacatttttggccaggtgtgtcggctcacgcctataatctcagcactttgggaggctgaggcaggtggtccacaaggccaacagatcaagtccacctggtcaacatggtgaaagcctgtctttactaaaaatacaaaaattagctgggcctggtggcacactcctgtagtcccagctactcaggaggctgaggcaggagaatcacttgaacctgggaggcagaggttgcagtgagcccagatcatgccactgcaccccagcctggtgacagagtgagactccatctcaaaaaaaaatcaaaaaagaaagttacattctttactgaccacaggttaggaaccccgtataaagactgtgtagacaagttaagaggccagtgttcccaaggggcttttattggctctgcaagtcaagcttgattccttaaagggaagcacacccttccagtcaaagctttggcaaaaacaaacaaacaacaacaaacaaaaaacagtttctccaattgcatcctgttgcaagagaaaatggattcttattgcacttatgcaaatagctatattgtcataagttaagaatactcccaaatcgtttccaaattgtggagaaaccaggcagagagaaacaaatacgctggaaattttgttcacagaagtataccttactcaattgttaaaagctgtaaatagttcaaaataaaaattttcttgactctgagaaacaaaggatcagcaatattttaagcaaaaagtaaaaaatgattacttcagtcctttattagtttagttcattcagttaattcttgttctgcatgacattcatgagtcctgaacatttttcctctattttaatgtcacaatctctacagctatcggaaactggcattgtctcaaatatttttaaaaaggcaaaatctttacgcaacaggagggaagacttagctttccaaaaaatctgtcacgtgtctttcccttctttcttcagtagtttatttgcaaggcaaacaaaaatctttcattatccttttatgttacacgaaaatcttgttcaagaggtagaaagcttgatttcatccttgcattactctaccattaaggtcaagcccattttttaaataaaaccttaaggataaatcttaaccagtttgaccatgaggtgaaattcttataaatcttttataaacctttacaaatttttgttaaagagaaggttagtgcctttagaaaaccctgttgtgcttttatttcagtgttcaatttaccaaattgaaaaaccaaataataaccttttgaatttagtcaatatgttcatacacagaatttcttttacaagattaatttttacaaaccttccacaccttgttcaaacctttagatttatttaatttaaaacaatcctttaaccctctaacctagacaaaaatttatattcccatgccttcttataatcttttactaaaaacacattttactttccttacatacctatcatgtaaatctattttaagtagtctcaattacatgttataatggtaattcttagcaattttaaattttgatgtaaaacctagtaagttattttaattatgtactaggtgtagatacggtctgactctttccagcataatcaggggcatggttaactccgtatgtccccagaccttaccaactgtaaagcaggcaagtcaaacgattttcaaaagccaaagaagcagtttatgaccttaaagcatttagcaaacctaatatctgacctgtataatttagaccacatgtctacattttgaagacatttttactttaccaataatctttaaagctgtttttatttctcaaagattaaagtcatatgaattaaaaggcattacagctttaatttttccttcaaaaatatttgatctatgcatttatttttctttagtcaattaattagagctcttctaaataaacatcacatacataacacatatataactacacagagagacagaaaattgagtagttgtaagatttttcattgggcagtttcttaattggattactggcctcagggtggagcccttgaagaaacagggctaggaaagcatgtggtttctagggcctaataagcaggcatatctgaaagacagaaacaaattttgagagggctctatcctgggggttccatgaggaaaacagaaattttttccaacacagggtcagtggcacctcctctgtttcccaaggagtcccaggctatcaaaagctattctagggcctctcatgtgtgtgtgcattaacagtgaagaaaaataattccattgactgagaagaaaagaatgtttttctggcaaaacaagatccacaaagagaaaagacataaaggccttttaaatatacctatagcttgaatatccacttttaattaagctgacttttaactatagtgctctgtttttaaaaaagtccttttgaatcttttattacctgaccttagccatggtatatggccaatacttctgggttttgaactcatagaggggcagaaaatacagagatttttaccattcctgcaactattttgcacagagagtggccagaagtccaactggcaagaaattttatgtttttgccagcatcccaggcttctgggttccattcccctacactgtggagccctattgaccctggagtcctgtgatggggaaacagacaaagaggttaccttcatgttgtaaaagttagcccctcctcaagagattgctcagctaaatttgtaatttcttaccagctcatttttaagccaaacagtttaaggcttcaggaaattaagctttttccagtttgggggattcatctgaggggtgtgtcctgtggtacagggacacaattaaccatctgggaagagaggataaaggagaaaaaggaaaaagaaagcatttattttccaaagagtcccaatgattcaagatgcactcaagagaagtacagactgaagatgtttggttaaccatctggaaaaaggaggaaaaggcatccctttgttcctttctctttctagaaaaacctgggatacaagagggggagaaaaaaaaagatgtccccattttctcttctatccttatatcctcgagtcctggtgaccttggcagtgccatccatgggtgccagtgtgaccttcaccacgtagcaggaaggcctagagggtaggattatttgcactcacctaatgcactggcctatactccctgctgtcagtaaccttgagttccctatacctcatctatgccatggatacgagcatgacctccttccatgaagtggggagcccagtcagcaggaattagttatgcttaactatgttgtgcccctagacttgtgctgtcactaacctttgggtttgcggagacttgggtttttttttttttttctagggcttcaatcgaaagctcaggattgagtttgggacaaaaaggtgcctcagtagggtacacagactcattaaattaagtccaaggtgaccctcatgtttgcagtcagtgactggtgggggtagttggggccacttctctgttgcttccctatcataagcagagtgctaaggtgaagttgtggaaccagggcctcctcaaataagggagagaaaaggagtcccaggaattgggaacctgccctagtaagatgcctccccaaaggaaaaaaaaaatctgccacgtagaaaagctccctttattcacaggactttgtgaactcctgacatggtggaggaaagaaaaaaaacagcttaagtgcctgtgggaaaaagcctcttgttctatgcaaatggattccttcaacaggggaaaaaaaaactttaattgctgcatcctccctgtttctaagaatagacagaaactgcatttcttatgactgggccaagtgcccattctacccagtaatatctgtgtagtttgcaacagcacctttaacattataaaagaagagctagcagccatcacaatccatgaaagaaagaaaaaaagtaccattgaaaagtctgggcatcttggctaacaccctaacaccccctccagttgcagactggagccggtctaggggccttaggacaacaatgaggtgttgccttggccagatgccttcagtttcctcaggaccttattctgatcccatgtgacagctagacgtctgtgaagggaaacaaagtgaagattccttacacctgagagtgatgggggtgggggtggtggcagagccctccccacatcctgtcctctgtagccatgccattcactcttaactggctaattggaggtacagtgcttatctgccttcagaaaaaagtctgaggacaaaaagtcttgggaaaaaagtgaagaattatatgcccacattcactcaccctctgacaatcctggatgagcccctagaaatgatgcaggatttttcttgttaagtttgctagctgggggcttccacagccagcaacatccttgattgagcctttcttggccctaggcctgctgcaggatgtgtctcattcactcggcccactgggccacacctggcttgcagaccagcctgtattctgtgctcaccaggggatccgtgctcagcctgtggtttggcatgacctagcctgcctgttttacagctcatactcatgttcagtggctcccaagttctttttctgcatccaagaagaatgaggttacactgacaatcgaaaggtgaggggggtggagaggaattttatttcatgacagaacagctctcagcagagaggggatgtgagggtggtcccccatctgaagtcaagtggtttctctcagtgtggctgggcctggggcttttatgggctcagaatggggagggcatgctgattggtttgtgagtatgcaaaaaaaaaaggctaaaaaaaggccagtcaaaggtgggcatgacagtgtaaaaaaaacaattatggaaaggtaggtatatgtaaaatatgtgaagggtgaggatcaattagaagaaagcaccaaatgggaagagaggttctcaatttggtctgtggatttgacttgtattttggctttcagactttaaactgtcttttggcttgaaggtggggtttcaccagggacccacccctatctgtttaggatttgtctgcctcctgccactattatcaggacataagatattgaagacattgaaatatgggttgtgaagactttttctcgtatttgtgaggaaaaatattcaagaatatttgactccattgtcctcattaatcatagatacaggttattgtgcagaaatctctcaagctagtatagccagaaatgtgtcaccttacatgtgatctaatgtcacgaactagtttcgtaggaattgaagtaaatgaatatgcaatagtaattgcctgttcattttgtttgttcattactattcccatgtctcattcccctaagtctgactttttgttttcctttccattctacttttcaggcttcccctcatgctcttttcctcaaattgaggacatctgctctaaggtgaagggccacaagttccagattatattgtgccatttgatgtctttttctgctttttaaccttgaggaatgtaataattgcagacagaattattgttatatttggtttagatggaccatggtgacagtcataaatgcatttgaaatcatttttgtttagggtttctgaaagcaattaacataaagttggaaagacatatattctattttttttttcttttttttgagacggagtctcgctctgtcacccaggctggagtgcagtggcgcaatctcggctcactgcacgctccgcctcccaggttcacaccattctcctgcctcagcctcccaagtagctgggactacaggctcccgccaccatgcctggctaattttttgtatttttagtagagacggggtttcaccgtgttagccaggatggtctcgatctcctgacctcgtgatccgcccgcctctgcctcccaaagtgctgcgattacaggcgtgagccactgtacccggcccatatattctattttaatggaaaacgtaaccagcggaatcaggatgaaagtctaaagatgtgatatctgagtcttaaaattataaagaagaaatcttgagagggtttctgatttttctatagcttcctcattataacctactcatattagtgaactaacaataatctgatagggaagaaaaacttgcagtccttattttctgagctgtatttggcatcttgtgttgtcaataagttcttccttatatcagatgcaaatccttgccaatacaatatgggctcttgtcactaattctttgtttttctgtaaccaagaaaaggagtatcatatatctctctctatctgtctgtctaactgtctctcttttcctgaaatatgtcatttcagggcagtacattttactttaagaaaggatagcatgatgtgttagtttttgtgttgctataatgaaatacttgaggctaggtcattagtaaggaaaagaagtttaactggctcacagttctgcaggatgtacagaagtgtggtgtcatatccacttctggtgagggcctcaggaagttgcaaacatggtgggaggcaaaggaggaaccagtgtagcacatggccagattgagaacaaagagagatgggggaggtgcaacactcttttaagagagctctcccatgaactcataaggaggactcgctgattaccatgagaatggcaccaagcattactgagagattctcccccacgatccaaaccctatcaggccccacctcaaatatgagggattacatttcaccatgagatttggagggaacaaacatccaaactatatcacatgggttggatgcgaaatgctcatttttaagtgccatatttcattttcttaaccaacatttttatagcacttactatgtgctaggcattattccaagcactttgcaaatgctaatttaactcttacaacatacctatgggagaggtactatcactatgcctattgtacagacaagaaaactgaagcagagaacagttgggtagcttgtctaagatcacaattggttaagtgacagaggtgactcttagccactatgctatgcagctctttgtgaaatcatctgtgtgcttttctgacatctttaaggcattttttatggttctgttctccaactgtatcaccaactttggatttatactacagattttcccagtgttcttgtgcagtgtatatctacaatgtatgtgcatgtgcttgtaaatatgtgcttgcatgtgtttgatattatcacagcactcatggagattctggcacaagtggaaccttacattaggaggaaagacatatatattccatagagatacatttggaatatatgtatatatatgtgaatatatatatatggaatatatgtatatatatgtatatatatggaatatatgtatatatatgtatatatatggaatatatgtatatatatgtatatatatggaatatatgtatatatatgtatatatggaatatatgtatatatatgtatatatatggaatatatgtatatatatgtatatatatggaatatatgtatatatatgtatatatatggaatatatgtatatatatgtatatatatggaatatatgtatatatatgtatatatggaatatatgtttatatatgtatatatatgtgtgtgtgtatatatgtgtgtgtgtgtatatatatgtatatattccctatgtatatatatggaatatatgtatatattccctatgtatatatatggaatatatgtatatattccctatgtatatatatggaatatatgtatatattccccttatgtcctccaatagacctcataacgaattgcatgtgagaccatggacaatttatgacacttctgaatcaatttacttatattcaaaataagagagttggactggttgattttttttcatcttcaaattctagaactgaatcaggaacttctaaagcaaccagtaaggagattttttttcagtatagagcaaacccttgacatttgaaagaactacatcctattttggtcaaatattttaaaccttaaacaatcctaagacttttaaaaatctctaagtttgtaagaaccacaataacatatcattttctagtataaaataaattaaatgtttacatggccatgttctaatctctattagctctaaaaatactgaagtaaataatctatagattttttacaataaattatgcaatgaaatcaaagtggacattactgcattatataataatcagataaaactacccccagtatacttgcagtcaaacaaagcttgtgcacttactgcgctaagggataatattccagaggaactttagaaaacattcagaggaggggctatggaagaagaactaatttgattgggtctgcccatttatactggtatcttcttaaatattttgagaaatctgatgagtataacaaacagctgcattcatttgtttgtacaggtggttgtaatcctatataaacttttttatagtttaaaattttaaaaacgtacaaaatattgaaatgtataaggcatgaaaaaatagaacttctttgcatgctagctaggtataaaaatgcaggaggagatgctattgagaacataactcttacctaatgaaggaacataattattatcttgaatatgcaagtaattatactacttcataatatctctgcttagcagagtgcttgattcctggaaagaaaaaaaaatacacacacgcacgcactcacacagacaagatataaggaatagctgtatatgaaatagctacaaatttgcatgctaggagaataattacatgtggaaaaagttatgtgttttacagacagcaaaatctttctattttatcttttgcttgaggtttttggctccttctatgaaggactatgttgctatgcttgcagacaactgacggatagatggatgtattgattgtataattataaaatacatggcattagttatgcctaggacatatgatgtttgataaaagaaaaggaaaaagattcacctgtcaaggaattgcagtttattagagatgaaaacaatgatcaaaatagcaaaaaatctaaagactaatgtaaaggcaaaaatacgtcaaaacataatatgagaagttaacaaatgagaacaacctggtgagttgaatgagtaacatcagcaagatgagagactagactctttctattatcatgcccttgcgcaagtatcaactttgacaactacccacagataagagtacatttgtgagaatctaggagttcactgaagttccagcacatcatcaaagcaagaaatttaagaatagaaacatcaaagaggataaaaagaacagtttcacttcttgtatcccactttcctcaaggtggtacagctcagtgctaagagagacttttggcccactatttatcccatggggaaaaatgagaacatagtgtttgaactcctggctccttctggtgtgcaagatgctgccctagaggcccacttctttcttgcttcacccagattactgagataatcatcatagccgaatggttgagagaggctgggagcaggaagagaggctgtgggctctacttaccactccatggattctatcaggaagcctgacaatgaactcctctcatgttgacaccccttaaccctctcatgggcaccccaaatgtgtccccaagaatcttgctgctgacactaaatataagcatcttgcatagagagctggctggccaggaaaccattttctcctaggcctccaggcctgtgatgagaggagctgccgtgaagtcctctaacatgccctggagacatttttctcattgtcttggggattaatcctttttctatcacattgtcaggctgcaaatttttcacacttttatgctctgcttcccttataaaatcgaacgtctttaacagcacccaagttacctcttgaatgctttgctgcttagaaatttcttcctccagataccctaaatcatctctctgagccctccaaactgttccaaactcttcctgttacccagttccaaagttgcttccacattttcaggtatcttttcagcaacaccccattctcgttaccaatatactgtattagtccattttcacgcttctgataaaaacatacccaagactgggcaatttacaaaagaaggaggtttaattggacttacagttccacatggctggggaagccccacaatcatggtggaaggcaaggagcagcaaatcatttcttatttggatggcagcaggcaaagagagcacttgtgcaggcaaattcccattttttaaaaccatcagatctagtgagactcattcactatcacgagaacagttcaggaaagacctgaccccataattcaatcacctcccaccaggttcctcccatgacatgtgggaattatgggagttacaactcaagatgagatgtgggtggggacacagagccaaaccatatcactggcccgtaggtatatcagtaggggctcaacatcactaatcatcagagaaatggaaaccacaaccaccatgagatatcacctcacacctattatcaaaatgttagaagataacaagtgttggtgaggatatggagaaaaaaataacacttataccctgttggtaggaatgtaaattgacatagccactatggaaaacagtatggagttccctcagaaaattataaatagaagtactatatgatccagcaatctcacttctggatatacatcaagagcaaatgaaatcaatattttgaagagatatctgcacttccatgttcactgtggtgttattcacaataaccaagaagtggcaacaacctaaatgtccactcacagatgaatgaagaaaatgtgataaaaacatacaatgtaatattattcggccttaaaaaagaaggaattcctattatttgtgacaacctggatgaacctggaggatatcatgttaagtgaaataagctagaaaaataccacttatttagaaagaaatataccacttatcacttgtatatggaatctgaaaaagttgaactcatagagaccagaagaatgattactaggcagggcctgggggatgaaggaaatggggagaagtaggtaaaagggtactacctttgagttatgatcaataggtctggatgcctaaaatacagcatgttgactgtactgaataatagtgtattgtatacttgaaatctggtaagagaatagatcttaagtgttctacctccccacacaggcggagaaaagataactactactacttaaggtaatggatatgttgataccttgattgtggtaatcactttacaatgtttatgtattaaaaacatcacttggtatatctcaaatatatataattttatttgtcaattacaattaaagctgagaaaaaatgcaaatggattaatgtgaaaatgcttacaagtgcgaaagcatttatccacatgtaattaaacattttattaattgacatttacggaaataattaaatttcatgaatgcaagactaccagataatccaagatgtaatcatgtataggtatcttatactaatttcttttagagcagataataatcatctgcctaaataatatagaaatatctgtgcaattggtctagtagcactgatgcttaaaaaagcaatctgtccgtacttaggaatgctggaataaaaaacagtataagtctctgaagtttttctctttcaagattgtttttgttcttctttgtcttcagaatgtccatgataattttagactctctttatacaattctggaaaaccttttcgggatttatgtgtcaggcatgtggggaacagactgcatcaaatatatagagcatttgtagaacaacaaatttatacttgttattctgtatttaacaagcacagctctttttatatgtgtcagtgagatcaaattttgtccaactcttctatatccttgctgtttttattctgtatgttctgtcagttacagatgtgtttctgtctcccactgtatttgtgatttgcctatttttttatttaagtttatataggttgagactatgttgttactgcatatgaaatcagagttgtgtgtcttttgggtgaattaatttttcatcataattaaatgctccttttcatctctagtaaggtttactgcatcaagtctactttgtgtgatggctgtactatcgttattataaccatactggttttcttctgtttagtgtttgtataatatttcttttactctatctttctgtatccttatgttctagtagtctttcttctaattagcaaatcattggcttaggttgtttacacagtccattgtgatgattgtttaaatgggaaaatttaattttcttacatactgtaggtggcactatatttgtattgaaatttgtcatctttatattttctatttcccattttattacttcttttggattagttatattagcattctatcttttcattttcttgccagcaatacactctattgctattattttgttattcataaaatcttatgttattaatgcttagtatatactaacatatttaccacaatataagaacctcattcaccattaacatagcttatccccacaaatattttatgttattattgtgtgatttattataatgacaaatatgttaaattatgcttgtttgtcatcaatattcatttatatttaccaactgttgctgtttattctttcctgtatttttatttccatttagcttcattttccttcagctaaaaacactctttagtatttcttttcctgtgatgcttctggtaacacattcactttttgtttgaatcaaaatgcctttatttttaaaaacatgttttcctgttacagaattccatttgacatttattttcctacatcaccaaagtataattgcattgtcttttcttctgttatgttgagaagttagttatcaatattatggttactcctttgaaaataatgtgtcttttatctctggttgttttaaaaagattgtattttttttaatcatactctaagttttaggctacatgtgcacaacgtgcaggtttgttacatatgtatacatgtgccatgttggtgtgctgcacccattaactcgtcatttaacattaggtatatctcctaatgctatccctccgccctccccccaccccacaacaggccctggtgtgtgatgttccccttcctgtgtccatgtgttctcattgctcaattcccacctatgagtgagaacatgcggtgtttggttttttgtccttgcaatagttttctgagaatgatggtttccagcttcatccatgtccctacaaaggacatgaactcatcatttttatggctgcatagtattccatggtgtatatgtgccacattttcttaatccagtctatcattgttggacattggattggttccaggtctttgctattgtgaatggtgtggcaataaacatatgtgtgcatgtgtctttatagcagcatgatttataatcctttgggtataaatgggatggctgggtcaaatggtatttctagttctaggtccctgaggaatcgccacactgacttccacaatggttgaactagtttacagtcccaccaacagtgtaagtgttcctatttctccacatcctctccagcacctgttgtttcctgactttctaatgatcgcaattctaactggtgtgagatggtatctgactgtggttttgatttgcatttctctgatggccagtgatgttgagcattttttcatgtgtcttttggctgcataaatgtcttcttttgagaagtgtctgttcatatctttcacccacttgttgatggggttgtttgtttttttcttgtaaatttgagttcactgtagattctggatattagccctttgtcagataagtagattgcaaaaattttctcccattctgtaggttgcctgttcactctgacggtagtttcttttgctgtgcagaagctctttagttagatcccatttgtcaattttggcttttgttgccattgcttttggtgttttagacatgaagtccttgcccatgcctatgtcctgaatggtattgcctacgttttcttgtagggtttttatggttctaggtctaacatttaaatctttaatccatcttgaattaatttttgtgtaaggtgtaaggaaaggatccagtttcagctttctacatatggctagccagttttcccagcaccatttattaaatagggaatcctttccccattgcttgtttttctcaggtttgtcaaagatcagatagttgtagataggcagcattatttctgagggctctgttctgttccattgatctatatctctgttttggtaccagtaccatgctgttttggttattgtagccttgaagtatagtttgaagtcaggtagtgtgatgtctccagctttgttcttttggctaaggattgacttggcaatgcgggctcttttttggttccatgtgaactttaaagtggttttttccaattctgtcaagaaagtcgttggtagcttgatggggatggcattgaatctataaattaccttgggcagcaaggccattttcacgatattgattcttcctacccatgagcatggaatgttcttccatttgtttgtatcctcttttatttcattgagcagtggtttgtagttcttcttgaagaggtccttcacatccctcttggattcctaggtattttattctctttgaaggaattgtgaatgagagttcactcatgatttggctctctgtttgtcttttgttggtgtataagaatgcttgtgatttttgcaaattgattttgtatcctgagactgctgaagttgcctatcagcttaaagagattttgggctgagacaatggggttttctagatatacaatcatgtcatctgccaacagggacaatttgacttcctcgtttcctaattgaataccctttattttcttctcctgcctgattgccctggccagaacttccaacactatgttgaataggagtggtgagagaggacatccctgtcttgtgccagttttcaaagggaatgcttccagtttttgcccattcagtatgatattggctgtgggtttgtcataaatagctcttattattttgagatgcatcccatcaatacctaatttattgagagtttttagcatgaagggctgttgaattttgtcaaatgccttttctgcatctattgagataatcttgtggttttgtcattggttctgtttatatgctggcttacgtttattgattttcatatgttgaaccagccttgcatcccaaggatgaagcccacttgatcatggtgggtaagttttttgatgtgctgctggatttggtttgccagtattttattgaggatttttgtatcgatgttcatcagggatattggtctgaaattctctttttttgttgtgtctctgccaggctttggtatcaggatgatgctggcctcataaaatgagttagggaggattccctctttttctattgattggaatagtttcagaaggaatggtaccagctcattcttgtatctttggtagaatttggctgtgaatccatctggttctggacttttttttttggttggtaggcaattaattattgcctcaatttcagaagctgttattggtctattaagagattccacttcttcctggtttagttttaggagggtgtatgtgtcaaggaatttatccatttcttctagattttctagtttatttgcatagaggtgtgtatagtattctctgatggtagtttgtatttctgtgggattggtggtgatatcccctttatcagtttttattgcatctgtttgattcttctctcttttcttctttagtagtcttgctagcagtctatcaattttgttgatcttttcaaaaaacgagctcctggattcattgatttttttgaagggctttttgtgtctctgtgtccttcagttctgctctgatcttagttatttcttgccttctgttagcttttgaatgtgtttgctcttgcttctctagttcttttaattgtgatgttagggtgtcaattttagatctttcctgctttctcttgtgggcatttagtgctataaatttccctctaaacactgctttgaatgtgtcccagagattctggtatgttgtgtctttgttctcattggtttcaaagaacatctttatttctgccttcatttcgttatgtccccagtagtcattcaggaggaggttgttcagtatccatgtaggtgagcggttttgagtgagtttcttaagcctgagttctagtttgattgcactgtggtctgagagacagtttgttgtgatttctgtcctttcacatttgctgaggagagctttacttccaactatgtggtcaactttggaataagtgtgatgtggtgctgaaaagaatgtatattctgttgatttggggtggagagttctatagatgtctattaggtccgcttggtgcagagctgagttcaattcctggatatccttgttaactttctgtcttgttgacctgtcaattgttgatagtggggtgttaaatctcccattattattgtatgggagtctaagtctctttgtaggtgtctaaggacttgccttatgaatctgggtgctcctgtattgggtgcacatatatttaggatagttagctcttcttgttgaattgatccctttaccattatgtaatggccttctttgtctcttttgatctttgttggtggaaagtctgttttatcagagaccaggattgcaacccctgcctttttttgttttccatttgcttggtatttcttccttcatccctttattttgaggctatgtgtgtctctgcatgtgagatgggtttcctgaatagagcacactgatgggttttgactctttatccaagttgccagtctgtgtcttttaattggagcatttagcccattgacatttaaggttaatattgttatgtatgaatttgatcctgtcattatgatgttagctggttattttgcttgttagttgatgcagtttcttcctagccttgatggtctttacaatttggtatgttttcgcagtggctggtactggttgttcctttccgtgtttagtgcttccttcaggagctcttgtaaggcaggcctggtggtgacaaaatctctcagcatttgcttgtctgtaaaggattttatttctccttcacttctgaagcttagtttggctggatatgaaattctgggttgaaaattcttttctttaagaatgttgaatattggcccccactgtcttctggcttgtagagtttcttccaagagatcagctgttagtctgatgggcttccctttgtgggtaacctgacctttctctctggctgcccttaacattttttccttcatttcaactttggtgaatctgacaattatgtgtcttggagttgctcttctcgaggagtatctttgtgtcattctctgtatttcctgaatttgaaagttggcctgccttgccagattggggaagttctcctggataatatcctgcagagtgttttccaacttggttccatgctccccgtgactttcaggtatacctatcagatgtagatttggtcttttcacatagtcccatatttcttggaggctttgttcatttctttttattatttttttctctaatcttctcttctcacttcatttcatttcatcttccatcactgataccctttcttccagttgatcgaatcggctactgaggcttctgcattcatcacatagttcttgtgccatggttttcagctccatcaggtcctttaaggacttctctgctttggttattctagttagccatttgtctaattttttttcaaggcttttaacttctttgccatgggttcaaacttcctcctttagttcagagtagtttgatcatctgaagccttcttctctcgactcatcaaagtcattctccatccagctttgtttcattgctggtgaggagctgtgttcctttggaggaggagaggcactctgatttttaatttccagtttttctgctctggtttttccccacctttgtggttttatctacctttggtctttgatgatggtgatgtataaatgggtttttggtgtggatgtcctttctgtttgttagttttccttttagcaggcaagaccctcagctgcaggtctgttggagtttgctggaggtctactccagaccctgtttgcctgggtatcatcagtggaggctgcagaacagcagatattggtgaacagcaaatgttgctgcctgattgttcctctggaagttttgtctcagaggagtacccggccatgtgaggtgtcaatctgcccctactggctggggggggggggcctcccagttaggctactcggtggtcagggacccacttgaggatgcagtctgtccgttctcagatctccagctgcgtgctgggagaaccaatactgtcttccaagctgtcagacagggacatttaagtctccagaggtttctgctgccttttgtttggctatgccctgcccccagaggtggagtttacagaggcaggcaggtctccttgagctgtggtgggctccacccagttcgagcttcccggccactttgtttacatactcaagccttggcaatggtgggcgcccctcccccagtctcgctgctgccttgcagtttgatctcagactgctgtgctagcaatgagcgagactccgtgggcataggaccctccgagccaagtgcaggatataatctcctggtgtgccatttgctaagactgttggcaaagcgcagtattagggtgggagtgacccgattttccaggtgccgtctgtcacccctttctttgactaggaaagggaattccctgatcccttgtgcttcctgggtgaggcaatgcctcaccctgatttggctcacactcggtgcactgcacccactgtcctgcacccactgtctgacactccccagtgagatgaacccggtacctcaattggaaatgcagaaatcacccgtcttctgcatcgctcacgcctggagctgtagactggagctgttcctatttagccatcttggctccacaaaagtttgtatttttctgtagttttattatgatgttcctatatgttgttttctttgtatttattctactgatggtttgcagcagttcttaaatctgtggcataatgtctctcattggtttattagacagttccagctgctataacaatataccatagattatgtggcttgaaaaacaaacatgtctctctcacaggtctagatactagaagttcaacatcaatataacagcagatttgttgtctcaaatcctggtttgcaaacaacaaccttcttactatatctacaaatggcagggagagaacagtgtggtctctttcttcttataaaggaattgatcccatcattgaggtttcacacttatgacctcaagtaaacctaattaccctccaaaggccccaactccaaatatatttcagataagggcttcaataaatgaatctggggtgacaataactttaaattcatagcaattgattttggcaaaccatggccagaagtactgcttctgctccatactctatattatttccttctacgactccaattatacatatattaaatatttttttccatattttatgtgtttattgtaatcatctttgttttgtattttacattttattctccctacttaaggctatgtattttattctaatttgagttcactaatcttactgatcttatattctgttttgtctaatttgaaaatacacaagtctacttagttcttaattacataagttcatttaatgtttagttttagttctagaattttcatttcttttatgtaattcctggctctctgtttaaattctccatgtttttatgtaacttactgaacttgtcaaacaacatattgaaatatgtgccttacacatccactccattatctctgtatctcctgtgggtcggttggtctattttcattatgtatgtttccctctctctctctgtcttcctctctttctgcctttatatctatctgtgtgtgtctctctcttttcatgtggtattgcctatgtagggatgccttatatttttcttgaaaaattatagatataatttgaggtttatgtcctgttacccactgagacaatgtacttttgctccttgcatgcagtaagagaagaggcagattattttaattcaatcagagattgaacagatttgaagctggaacccatgaatatacctagatctaatgagtaaggagaaaaaatgctgctagtagggccataagagaataatgaatgaggaggccacccaaaaggaaccatgatgggatgaagtaaacagagggaaaaatatctaaacttttctctcctgacctctggtatcctactggtacctattatttgggggaactggcaccttaacaatactgagtttttcagtcattaaatatggtatatgtctgcatttattttgctcttcgtattaatatgtttgggtttccataacaaaataccataagctgggtagcttaaataacgtaaaattattttctcacagttctggagactgagaagtccaataacaaggtgccaacagggttagtttctgttgaaagctctcttactggcttgtagttggctaccttctcaccctgtcctcagaggaccttcctctgggcttatgtgaaaagagagctagagagagaaatacacaaatacacacacacatgcacacatacacagtgagagagagagagacagagacagagacagagagaaagagagacagatgaactccttggtgtctgtttttttttttttttaagaacactaatcctattgagctaggcctacacctgtatgacctgattttatttaaacttgattacctctttgtagtccctcacaatacagccacattcagaattagagcttcaacatacaaattttgtagggatacttttctcagcaatattttcccagcaatattttgtaaatgttagtgtaaagctcttggacatattttgttaaaattatccttatgaattttggttttttgggtatttacaaataaactgtatttttaaaaattatcttgctaggtagagcatagtggctcacacctgtaatcccagagatttgggagtccaaggtgggaggatcacttgagctcaggagtttgagaccagcttaggcagcgtaatgagatcccgtctctattttaaaaaaaaaaagtaactctcttaattgtttgcttctggtgtatgaaataaaattgcttatgtttattgacttagtatcttgctaattgctaaactaatttattagtctcaatagtgttttgtagattttttttggatttcctacatatactatcataacttctgcaaacatggatttactttttcccttttaatctttatttatttttattgcttgattaatttgttatgatctctattacactggcgtatagaggtttaaaaagtatatatatttgccttgttcctgatcttaagtagagaacatttgccttctatccttaaatgtactgttagtggtaggttttttgatgattactttatcatattcaggaattattctgaaatcttttttatgtctagtttgttgagcattttttctcattaaaagtgttggattttgtcaatactttttcttaaatatatatttatacacacatacacatatattttatatataaaatgtttattttgcatatatatgtgtatatatatttccattgctaggataaatttcactttgtaataatgtttttatatggttatatagtactgtattaagtttggtagtttttttcttaaatgtttttgcttccctgtttgagagacattagtttttaattttatttttaatcattttcaaaaatttgttgtgtcaggattttagtattagggctaagctgatctgataaagtgagttcagaagcgaatgtggttctcctccctctttttaaatagtaaacttcaagtaagattgatatcattcgctctttaaatatgttttaaggaatttgccaatgaagatatttggttctggcattttcattaaaaattggctttcaattattaattcaacttttttaatagctaaaggactattcgggttttcagtttcttttttgcgtcagttttggtagtttgagtttttgagaaatttctctattcatgttactgaatttattgacatacagttgttcatagtactctcttatttgtatttttaataattctaggctctgtagtgctgtcctttctttgagtaattatattttctgttatttttcttgaccagtgctgtgggattttatcaattttattaatcctttcaataaacaaatttctgggtccattgatttttttctaggttttatttttttttttagtttatatttcatttattttcactctaatatttattattttcttctttatgtgatttttggcaatttaaaattttgaaagatctggaaatggtatggataatttattgcaggagcaataaaagaggcaagaacatcaattaggatattgctattagagatgatggcccaaataaggcagtacaatggggatagacatgagggaataaatttgagtcattgtgttccagaatcagaattaagaagatttgatgaaagattggggaaagggtgttagcagtggcaaatccttatgggtgtgcagcaacctcaattcttgccttcttagatgaaagaatttgactgaggggtttaaggcagatgaagagactaaggcaagttttatagcaagagtgaaagtttatttaaaagctttggagcagaaatgaaaggaaataaagtatacttggaagaggactaagcaagtgactggtgagatcaaatgcatggtttgaagtttggactggggttttatatgttggcatacttctaaggtcttgtgtcccttctttcctgattattagtttggggtgggctgtccacatgtgcagtggcgtgctagcacttgggaggggaacatgcacagtgtgtttactggaattatacgcaatgctcacttgagttgttcttcctttaccagtctagcattcctagaccaaggtcatataccagtcaaactctgtcattttgtctcatagtgcacatgcttgagcccactcacccaactcctgatatcttattgggaagctgctgatcactagtttcagggttttttttttttttttttttttctagtgggagactgccttttcctggtgctggctgagattaattattattttagagagacagttaacaactttgcctgaccatcacttgatagtcgcctgacattcctggtggtggtggggagccctctcctgccctgctcatgtctgtctactgtaacaagggtaggctaagatcaatttttgatcaatatattgggttactctgcagatggtgttactgttaactaaaacaagaagtactggacaagaaagtttttgagaagcatgatcatttctgttttgtatattttaagtttgaggctcctgtctaacatttaagtggccatatatagtaaataagaagataaatggatttggataattgtaaagatgtctgagctagaaattatgattttagagtcagcagtttatagtgcaaggtattctttttgggtacaaaataaaattgaaattctatttatatttttatcttattttaatttctacttctgcatgttttacaatgcaaatactgtgttattctaataggcatgcataatgcattacacaaatatttattatataagccttctcaaaaatattttttcagagggcttgagatcaaaatatttggaaaactttacatctttcatgaagcctatttaagtaacaaatgtagaagagcaagaattgagtcctgtgtaacatcaacatttaataaaagagtaaagaaggaagattttagccaggaatatgagaagaggtgatacaaataggaaaaagaccagaaaagaaaattgtcactgaattttagaaaccaaaaatgagggatggttaggaattccctatattttattctcaatcaacaaccaaagagatcctattaaaacccaagttatatctggacacggtggcacatgcctgtaattgcagcactttcggaggctaaggcgggcagattgcttgagctcaggagttcaagaccagcctgggcaacatggtgaaagcctgtctctaccaaaaaaacacaaaaaaacaaaaattagctgagcgtggtgcctgcctgtggtcccagctacttgggaggaagaggcggatggatcacctaagccaaggaggttgaggctgcagtgagctgtgatggtgccactgcactccagcctaggtgacagagtgagtccctgtctcaaaaacaaaacatatgtgagatgacttctctcctcagaatcttccaatggctcgtcattactcatcataaaagtcaaagtcattgctatagtccacaaagacctactgggtctgactcattactttactgaacatatcttatacgacctgaaccatcacttactcggctccacctgtgccttgaaaccaccaggtataagctccacaaagtcctttttatttgctgtttttacagcctgagatgctttcctccagatacctgcatagcttactcttactcaaatatcactttctcaatgaagtttttttgactagccaattttatattgtactctaccaccactcagagtgcccaatgccttttcttttgcatttattcctcagtacttatcaccatctataataccacttatgtttaccattatgggttttttaaattttttctttttttgagtcagagtcttgcactgttgcccaggctggcatgcaagggtgcaatctctgctcactgcaacctctgcctcccaggttcaagcgatgctcctgcctcagcctcctgagtagctgggattacaggtgcccaccaccacgcctggctaattttttgtatttttagtagagatagggtttcactatgttggccaagctggtctcaaactcctgaccttgtgatccacccgcctcagcctcccaaagtgctgggatgagccactgcacccagcctaccattatgttttgtttctgtctgtcttttttcactagaacataaactccgtggggagaatttttgtctatttttttcagtgctgcatccctagaacctaaaacaatgcctaacacataacaggcacctaaaatatttgtggaaatcaaaaatatgtactgagtgtatcactttatattgcaaaataaaataatatttatttacctttagtttgaagacacatcagcaataaatgttgtatgatgctaataaaaatattattgaatgtttactatgtgtcaaacacagttttgtataactcaatcctaacatagagtctatgaaatcattattattattttccctattttataaatgaggatactgaagcacagagagaagatataagctgtcctaggtgagataatgagaacgtcagcaaataaggattcaggactatatattctacctccaagggctgctccttaaccatgattcagtattcattgctgcctcttacctgccattacctacacagaatcagggtaataaaaattttagtcatttacagaaacaagaaaagtgagtgacagaccattagatagtgtgtaaactaaactttaaaatgtagaaactttaaataatgtaatataattcatattgaatttatatataatacatatatttatacctaatacatatacatacatatataatgtataaatatatattacgtgtgtgtgtgtatatatatatatgtgtatatatatatgcacacatacacacacacacacctccatgggaaaaaataattttcttactgatattgtatgaatctgatagcccccccgaacctttctgataatgataaaataaccattataatgctgataatgcttacttactatatttcaggcactatgctaagcaatttagatgtattatttcatttaattctcaaaacaactcagtgagataggaactattattaccccctgtctatagatgatgacaatgagtctttgggaggctttgcaagttggcctgagtgaattgcaagtaagtggattgacagatggacgtgagatgagaacctaggcagtttaactctagaaatcactcttctttgcaggttgacagtgaaatgaagtatccttcagtaaacatgttgagacggttatctatgaaaagaaatgagtgtagttccctaactcttgttatacctcaaaatagattctgagagatcaagaaagacaatgtaaaatgttcaaccatataaatagtcaatgaaaataaaagtgaatatttataaaagcactttctgagctaaagtacaacagaaggattgcaaaggaagagaataatagaatagatgatataaaatgaaaaccatctttatgataacagaaaaaaaccaatatggcaagcaacaaaattaataaaaaaactatatcaaggagttaataaatcaattaaattggtaagaaatactatgaatttaattcataaatacacaaaaacctgattagtttacatgctaacaaacacggaaaacattcgaaacaaagtgtttaccttaacggtacaacttaaatgaataaaaaaatgataaaatcatcaataaatggtaaatgatcaaaaaaatatttttaatcatgttatgaatatgttaaaagataaatgtatagctatatgtaataccacatataactatgtaactgtgtatatgtggataaaagatgaaacagaaggctaataataaagagcaaaagtcttttgactattctccaactttgtctattcatgagagacaaggcactattaagcatttatatttgggctaataaactcttcacagctcttgtagtattgcaatgacatataaaaataaaggaagatactaaagcacagagatgtcattaactcctctgtccttccacccaaaatctctattttgtttcttctgtggttcacttctgcagcttaacacagtcattaaccagagccaagcaatgaatttagattatgcttcatattctatggattggataccatgaccactgtcctacttgatgggaaatgttcttagcttcaaatgtaaatgggtcctccctttagctaaattcctttatcctatgaagtttttgtttcatttgttttgtgttcaaaatcgcactatgcatttgatcaatttgccttttgtgttgttgctgttgtcttctggtttatttaatttttgctcccagaatcctcattctagagtctccatcctcctgctcgaaatttctctctagggtttcaaagagggctcttcatcatgggacttcccttaacatttgctcttctgtgaaaaccatttgcttcctggattccctctttcttggtagattttgttttgctaacaaggatatgtgagtggtaaattttccaagttcttccaaattctgaaaatttcttaaactgccttatatttgattgatggtttacctatatataaaatttcaggacccatatcattttcctgaagactattgatagtatttctcccttgtcttcaaacatccagtattgctgatgggaattctgataccattctatttcctattcctttctctaggacccaacattttctttctggatacttttaggatcttttttttagctttgttatattgaaatttcataatgatttttatcttggtggtttctttttccattcattgtattaatatgcaatgacttctccattctgggaatttgtcttctattatttttgcaactttattcccctccatattttgttctttttttctagaacttttatctcatgttttttatttcatgtgttttatctctctaacgttttatctctctaacattttatctcatgtgttttcttatctcttgttttttcatacatcctttcttttaaattcttcttttattgagacagttttaccattaattttaaaagctcttttaaggttgacatctgaacactaattaaaggttattttaaggtttctttaagatatttcctggaattatcttttactcttccaacattaattcttctctatgttgattttagcctttctctttaatgttatagtttttattttaatagtttagtgttccttgattagccatatataggggaataaacaaaagcgaggcatgagaatggatgattggggtgtgtgtttgtgtgtgcatatgtgggaggtgtttttaagtgaacaactggagaatcagccattaggatggagaaaacctacctgccagaatgagaaaggctctttgcaggtcaacaacacctgtctgtttcagatttgtgggaaagtggtcattctgcatatggaaaataaacttaaaaaaaaaaaagacaaatagtcatctgttttaattctatttctcacttctctcctgccatagtatctgccatctaacctagatcttctcatgggttctgcagagaaaatcaactccgttcttggttacggccctcctccatctgtgatttgagctacagcttcctccattttgtttcacttaccacccttttacatacatacacttagcagaaattcattgttatctcccttccttgagggtcctcttttgctgtggggtttatggttctattatctaaatgaatctcactgtattatttcaaatttgaaatatttgtaagagtatagggtttgggggcattattaagtcattagattttaaaatgcagaattgatattgtcacttttgggttacaatttagcaccccttttgggaagctattttgcaaattatacagagagccccaactgttaccacacagtgattatataagaggagctttaaatatgttctaaaattttaccaaataatttgattttttctaatgtatcctaaaaaaagaccataaatatgaaaaaaagtttgatcaacacacttttcactgcagagttctgtgttaatgtgaaaggttataagcagtttaaggactaggtaagtgatattccaactctgtagaatattttgcagatattaaaatgctttagaaacgtttagaatcacatagaaatacttgtgccataatattaaatatataaataggatatagagtaacagtggaatctcagttattttaaatttgcatagaaaattgtattaaaatgctaatagtaagacagtggaatgggaagtgatttacccattaaaaagaaacattctatatcatatttttgtctttcataaaaccacatatattataaacttccaaagggaaataaatttatgaatagcaataacaacaataaaagactaagagaaacatacccacatacacccacccattcccacccacatacacattcacactacaagaaccaaagagaactcattctcatttattctgacatctactcttttctaccctctcatctacttttgtcaacaaagttgaaatattaccttgataattttgtccccagtttctgctagagtgcttactgaatagagaaaggaaaatgagcaactgtaattgactatctcgtcttctttttcatgtttttcaaaatggtaccataataatttttaaaaacatcctatattcattgaaaattgatcttaaaatttatctgtaaaagtatcaaatgaaaattgaatcacaatctctttttctaaaccttcatgcttatatttattctttatattataatactaagtacctcagatggattcttataaggaagacatttgtgttaatataagaattctgagttgggtgcagtggctcacgcctgttatcccagcactttgggaggctgaggagggtggatcacctgaggtcaggagtttgagaccagcctgcccaacatggtgaaacaccgtctctactaaaaatacaaaaattagctgggcgtgggggcaggtgcctgtaatctcagctactcgggaggctggggcaggagaatcgcttgaacccaagaggcggaggttgcagtgagccaagatcgcgacactgaactccagcctgggcaacaggagcaaaactccattcccccaccaaaaaaaaaaagaaattattctagacctcgtcgtgaatcaccttagtaatatcatcaagaataaatcaagggcacatttcttttgttctgtgtgtccggctctgtaaatattttaatatttcttccacttgaatacctttttagtttttctgccaaacttgtggttttatctatggaattttctgtatatgtatagtagaaagtgttgcaatttttatttctctgggtaaaaaattcctatgggttttataaaatagtttattgtacttcttaagaattaagaggaaaagacaattaaaaatgcagttacagcaaaaggtcagaatacaattttcagtcctgcatattttctgatatgtggcatggtgtttcaaaagtcatgtaacttcacgatagtatttgaattgagtttgtgtgtgattgcttaacatctgtaaattgttaagataagttattgcacaggcctactttagtttagattagtttggaacacatcccagggtatttaatcagggtataatcctgcatagtgcaatttctaaaaggtgtgtttgtgtgctttaaataaatagcatttttttgtaggcaaagttacgtcttatcctcttttctaaaaaaaaatctgttaaaaatgactccctacagcactcttgtattatctatagcttcaggcaaatataatacttaatactgacttcaaaaaatgtactgtagaggtctgcaatgtttggtattaactgtgttgaaatgtatgacaatattctattgtaatcttatatatttttctttataacttatatgagcaatttattttttatttgtaaaatttgtggtatgattaatttgtagaactgaaaatagagactgggaggtgatattttgataaaaataaatattttaacattgccatggttaattttactttcagtttggaggatggattgactacacttatagttaatttaaaaatacaaatttaaaaatgttgtggtgtacaaggaaataagacatagaaaaagtttggaattatacagtattttactaaatgttaaaaacaaaaaaattaacaaagcatcacagacttaaatgaatacaaagtattttaagaatagaatttaaaatgcctatgctgttttgacatagtcactaattgtaaccttttgaataaactggaaatgaaattaaattgtaaaattcaacttatttaataataataaattgtgtttcttttaattgatctggtagcagttctgcacatactcaaaatttggaacatgcccaaatctggcagttagttctcattgacccattttttgtaacgtttaaaaatgtgaagcaatcaaaataagattgtgataataatttctagagaatattcaaatgtaaaatgaagagtatcctttacccttcatcagtattattgtgctcctttctgcttctttatttagctttattcaattttagaaactttgtaattgtaaatttgtgttttctggttttttaaaaactgcatatttatcctaagtataccttgatatttctgtagaaaagaacctacttgattttattttatttcttattatttattttgagatggagtctcgctctatcgtccaggctggagaacagtggcgggatctcagctcactgaaacctctgccttccgggttcaagtgattcttctgcctcagcctcccaagtagctgggattataggcatgcaccaccatgcccggctaagttttgtatttttagtagagacgggatttcaccatgttggcctgactgatctcgaactcctgacctcagaagatctgctcccctcagcctcccaaagtgctgggattacaggtgtcagccaccacacctggctgaaaagaacctactttaaatgatgataataagttgcttactattagtctgagaaatacaaatttaacgtcttcttatttgatgtaaaatagtcaaaatttcataccagtcttgttgaattacatgatttcaaactttcttattatggtctgtcagctaaagagacaaaaaacaaaccaaccaaccaaaaccttcccaccacacacgtcctgtccccactcagggttctgggcagaagagactcagtgtcactgactgttcatgaaggtcctggccctggagtactgcaccttttaatgttacccttaatatgtccatgttcaaacaatcaggacttctgagggacctactcagtaatagattttgtaaaatatacccttatttggctagcacttaaattgaagttactttccataaaatccttattttgatataggtttatgcaatgaattgttcatcttgtttgacatcttagtagatgagaattccgtaatattggttataatactttgtgtagacattatacctaactgcttttttgaacctagtacacttcattttatgactgggaaagtctaaataaatcaattaaccttcatgaattttaaattttttatagcaagtatttctcttcagtcttaatttttcctatattataattcatttgagttttctttcctggaaagcagttcttaattcacctgcagtattttccttttaaaaaagtgtattacttttttcctgtctttttcttattcttattttagcttcatcttattctatggctacagttacagtttttccccatttatctgaatattttcagtagttcattttcttcatttgacctactaaacaatgcttcttttactattttctattacttatcagttaatgtttctacgatttattcatcctgatgcaatatttttgagtacatgttgattgagtcagtatttgtgaaaaggaagcctagagtttggtaattagtttttcctgtggaggtagtttctgaagtagaaacaaacacaaaacacctgaagtgcttttggaggcatgtaactgaggcagcgatgtaaagtcacagcacaaagaaacagaggtactgaggatatttgaaaagacagctcatggagctgttagcacctatctttgccctgtgacagctagtcattgctgctattattattttttattatgataatcgtcctcattattacattcattttaaaggtcatcaaatggagaacagacatatagtttattttaagtggtgctacatcttataatttatcagtggatatgttgctaaatgatggttccccaatagctctccttggggaacattacattggagtggtcacatatgaataaactcagagtcacatttattgctttagtaaatatgtgcatggaaaattatattttatagcataaataagcttaaggttagtttatcactaagaaactagagaaaatatacacattgaccttttttgtgtgcttactttgtatgtttcttctatgtgaatatttttaatattgcctttaattgtgggtgatttttgaaaagacagactttttaaaaatacttgcaagtactgaggtttatgtatttacgtactgattctgtagttcctggtaacatttttctttttttttcctggtaacatttttctaatcagttaactaccttgcttagaacatttttgctaacactccagagtcaattataaaaaatatgacagatatatggtaaaaggaaattcagaataatcaaatcagaaatgctgagaaaaaacctctactctggctgctgagaggctctctagtctcagacaagtccctgtctaggcattcatatatttgactgtgacttgtgggaggaccattttcacaagaaatttgcaaggataaatatgaaaatgaatactgttctttttttcttaaatatattttaagatactgaaaaattatttccaagagggcataaaaatttatattgttctttcttcttcaaataggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagaggtaatagttctttcaccctgtaagcaaaaggcaagattttgctaggagagcaaagccgttttcaagaatttaacttctattacgaggaatatgtggaagtagtacttctcaggccccacatggaaaaacaaaaggcctgaggggcgttgtctatctctagaatgtattccttaggagacctttgttgaaagcatttctttcatatcatgcacagatgtaaacatgaactaagtcacccagctgagctaccaacttccaatgatgaactcagaaaagctcttagatcatgtttcacttataaacctagccctttaattaaaagtgtgctctgagaggatgtgatgggggaatctgacctatcagaaagtatgtggacacatcagagaagccttctttaagggtatttcttttatgctgagctctaaagagtgactttgaaattaaccaggagaagggaaggatgggtgctccaggtatctgcacaggcacatggcctgaaggaacaagcccaacgtgagggcctcctaaaggatagctgctggctacagtgcaagtagcagaggcaatgtggaggagaaaaggctggtgaggtggtgaagggacaggttacattttatagcttttattgtaggtgaaagggaagccactgaatatttaaacagggacgaatatgatcagattatttactttgattgattcattcaaaaatgtattcatgggcaaacatgaagctatgcactgggaaaaagtgttgacaaagaagacagagcccttatcttcatgaggctcatgattttggggccaggacttttgttagcacctagactgggcttattgtttttgtatgtgtaaccattacttggagaaaggaggctccaaggaaagcttttgaaccccttttcaagcaaagcccatacagtaaaagatcaaggacttcaaagttaaataggtctggattctagtcctggctctgccacaataggcagtaaaaactcacttgcagggttgtggcaggtattaaaagagaacatgtgttcccaagctggcacatagtaggctttcagtgaatgtagctattattcaagccagtagtcattgtgtatttactacagataaacactgtgccaggaaccagagggcataaagatgattagaacatacatggtcccttttctgacaaatcctagggaagagaccacacactattctagggaagacagacacctaggtaattaacaaggatgctaatttgatcaaagctaggcaatatgtatagtattttgagagccctaggaaagaggaagtgacttctcaattaagctttgtaagatactcaggagttgtaggggagctacacagcgtataagagggcagtacaagagaatgagtgttactaagctatttggagaaaggatagaaaggacaccagagatatctcagggaacgtagaattaatagcatttggtgacaaattgttgtgggagaagaagagacaaaaatactgaagctgcagtttggaactggttggaagatgatatctttaaataagatagagaatttggagctgtaaagtttctaaagagaaaagagttctgtttttgacatatagtgaaaaactataaaaatttcaagaacaagggctgaatagatactttttgttctgactttttagttaaaatttgaagaagattgatagggacaaataactttactaatgatataaattcacaggaaagcaatgaggaattgggaagtacagaagcaggaagagaggtggccagtgtaaagagctgggcaacttcagggagaagcaagattgaaagagacactgtttatttgttttaaattactgaagaattcttgaccgtattttgtactgtcaaggagttagaaacagaaaattaaaggtagagatgagaaaaagtataattagtagagcaaagaatcagagacactggagaactccttccatttgcatgacactctaccctttcataaaacatcttcacagatggtgtctctaatcctcacatgaaccttgcaaggtaagtatttttcagcatttcaagaaaagtaaattgattcaatgtaaacttctaacaagagcaactatgcttcaatgagctgctaaatgtagtacaagcatgacactcttatgaaaactatatttggtaataattaatatgtgttcccattagatcccttaccttgtaaaattccaacacccttacagttccaccttcagatccaaatccctataactaattattgtaactgaaatgatttaagactggaatgagaagaaaacatgttttttatgtctagtctttataaattgctctccttgacgttcctttgtatatcatagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtaagggggcggcgccggccgtgcggggacttcagccaagtgaagaggcgtgggcagaggtgcaggtgctaggctagttgctgggttcagcattgaggctgggaatgctcacagataagatagcgttaccgccagtggaaggtcttatttttattaatttaattttattgattgatttgtgggattttaaaacacaacaagctccaaacttaggctacaaaagttcttggtgattttgcattctgtcattctggtaaatttggtatgcagtctaatatttttaagatattattttagagtggatttattattctgtgaaaaacaatttgtttgctagaaaatgaaaattatgccttataaaggaagtagacattaaaaaaaaaccacatcagttacgtaatattacagttgcaaaggtagtttttttttttttcaaacttcaaattaacctttctcacaatttgtgaacagattacagtttattcttggacaatacggatttgaactgcatgggtccacttatatatggatgttttttcaataaatatactggattttttttttgagaattgcagcaattttaaaaacttgtggacgaaccgggtagcctggcaatattttaataaaataagaaaaagttaggtatgtcatgaatgcatactatatatatagatactagtctgttttatcatttgctatcataaaatgtacatgaatctattataaaaagttaaaaatgataaaaccttaaacacacacttatagactacgtggcgccatttgcagtgggaagaaatgtaaatatgtaaacatgcggtattaaatcatagctgcatgaaattaactgtagtgcatactgtattactgtaataatttccttagcctcttccagtgattttagtgttgcgagcaccactttaaaatgccctgtgatgcttatcatctccctttgagcagtttctttctccagtaaattgcgtggtatcttgtggttctcacgtattttttgtgatgtttagtgcaataccattaactttgaataataccatgagacccatacagagtgtcattagtgacactagaagtgctcccaagaagcaacgtcatgacattacaagaaaaagttgaattgcttgatgtgtaccgcagattgaggtctgcagctgcagttgcccaccatttcaagataaattcaaccagtgtaaggactattgttgaaaaagaaatttgtgacgctgttgctgcagctacgtcagcaggagcaaaacccgtgcactttttgtgaaaaacttttatcttgccttaaaaatgcagcttttatgtggctgcaggattgctataaaaatgtgtatctatagactctaatattaggaaaaagcaaagtcgtcatataacaaagcagaaggatagtcaaggacctaaagctagagaatttaatgccggaaaaggatggcttgatcatttaaggaagaggtttggcttttaaaaaatgtcaaaagtagaagcagcttctgtggaccagcagagacgagttctagatgccattaagaaaattattgaggagaaaggatatgtgcctgaacaggtttttaatgcaaggtgctttattctgggaaaaaaaaaaaagtgccaaaaaggacatttagtagtaaggaagagaagcaagcactagtatttaaggcaggaagggttaggctagctctactgttttgtgcaaatgcagtaagggctgcctctatgtataaaactattaaccccctgagtgttgaagggaaaaaataaacaataactgccagccttttggttgtacaagaaggcctagacaagagttattttcctggactagatacatggatgttttgtccctgaagtcaggaagaacattgctagtaagggactgtcttttaaagttctttttatattgaacaatgcccctagctacccagaaccccatgagttcaacacgaaaggtgttgaagtggtctacttgccttcaaacacaaagattccagtttggcttctggaccttaaaggctcatttgacatagtactgtatggacaagattgtaacactgtggaagagaaccccgataaatagaatatcatgaaaatctggaaggattacaccattgaagatgccatcgttgttatagaaaaaaaacatgaaagccatcagacccaaaacaattcattccttctagagaaaattgtatcagatgttgtgcatgacttcactggcaaatcaaggaaatcatgaaagagattgtggatatgatgaaaaaaaaaggtgtggggtgaaagggttctaaatatagattccagagttaatagacaccacaccagagggattaacagaagataacttgatggatgagtgcttcttaagcaatgacagacactgaggaagaagaggtaaaagaagcagtgccagaaaacagattgacattagacagtctggtagagggttcctgttgttcaggactccttttgacttcttttaccacatggatccttctatgatagagacaatgacactaaagcaaatggtggaaaaaggattggtaccatacagaaaccaatttttagagaaacaaaaaagcaaaaatgtcagacagaaattactatgcattgccataaagttacaccaggtgtgcctgcctcttctgcttcctctcccatctcctccacctcttttgcctctgacatccagagacagcaaggctctttttccttctcctcaatgtgaagacgacgaggatgaagacctttaggatgaagacatttttggtgatccacttttacttaatgactagtaaatatatgttatcttctttatggtttccttaataacttttcttttctattgcttactttattgtgagaatagagtatatgatacatataacatacaacatttgtgttaattgactgtttatgctatcagtaaacagtaggttcctgtcaacagtaggctattagtagttaaggttttctggagtcaaaagttatactcagatttctgactacttgggggtcaacccctaacccctgtgttattcaagcatcaactgtacttcacaagtattgtatcaagcaaggtgttatgtatggtgttttgggtagtaactttgaggtaaaaagttcatactccaaaagttgtgggaatattgtgtgatggtctgaattttcactatataatgctgtagccccatgtagctatttaaattaaataaatgaacttaaaactcctcttcttctgaagaactagccaaaaagcctggtgctcgagaatgattatcacaaaaagttccattagatagtgcttatgtagaaaaggtttcaatgtaatattaaaattatgtgcttagtttgaagattctcctcattttgcttctgttcactcagatttaaagtggccacagtcctaaatttaatggtgctggtcatcatccttgtagaagtgttggagcccttcagtgtttcttaatgtttttgtatttagggggactgtttgcagtttttggctttgtttgtaattgccaaattgcataataaattatatacaaaatattataatttaagaattacttcacttcctcattctatgtccgaactgcatgtatatatgtacccccccccatatatatgtgtccgaacaatctcatactatatataggaacaattaagaaagctcattctggccgggcgcagtggctctcacctgtaattccagcactttgggaggccgaggtggggggattttccgagctcaggagttcgagaccagcctgggcaacatggtgaaaccccatctctactaaaatacaaaaaattagccaggtgtggtggcatgcgcctgtaggctacttgagaggctgacacaggagaattgcttgaacctgtgaggtggaggttgcggtgagccgagattgtgccactgcactccagcctgggcgatagagcgagaccccgtcaagaaggaaagagagaaggagaggaagagaggaagaaaggagggaaggaagagaggaatgaaggaaggaaggaagggagggctcattttgttattattgctgcaacccaacttaaaatagtgtctttggaatgtaatatatgtatatgggatcagtcagctcaccttccaatgacttctctttataagttgcatattatttatgggcttgtaaaaagtcaaatggcgggtagattatcttgactgccttttgtgccttaatattgttgtatgaacacatatttttccctgaggtaataaagtaggtattaaatagaaatgtagatatacttaatttgtgtccagatatcctttttgttttttttttttttttggagacagagtctcggtctgtcaccaggcggagtacagtgatgtgatcttggctcactgcaacctctgcctccctgcaacctctgcttcctgagttcaagtgattctactgcctctgcctcctgagtagctgggactgtaggtgcgtaccaccatacccagctaatttatgtatttttagtagagacaggatttcaccatgttggtcaggatggtcttgatctcctgacctcgtgatccgcccacctcggcctcccaaagtgctgggattacaggtgggagccatcgcgcccagcccagaaatctcttgatggagattgatatgtgtattagggttctctagagggacagaactacaggatagatgtatatataaaggggagtttattaaggagtattgactcacagggtcacaaggtgaggtcccaccataggctgtctgcaagctgaagagcaaggaagccagtctgagtcccaaaggtgaagaacttgcagtcaggtgttggagggcaggaaacatcccacacaggtggaaggctgaaagactaagccagtctagccttttcatgttcttctgcctgcttttattctggccgtgctgggaactgatgagattgttcctgtgcagattgagtgtgggtcggcctttcccagtccactgactcaaatgttaatctcctttggcaacaccctcacagacaacccaggaacaatactttgcatccttcaatcctgtcaagttgacactcgatattaaccatcacaagtccacccttgtcaacttgaacccatacacatctgaaatcatatgtaatcttcaaataaagacaataataaggtaataattatgccgaacataatacaactatccttcgtacaaccagaaagtaccaatccccaacccaaatgctgttacatagagttaacaacactgaaatgctgatatgaagtcaataaatcttatgtcacatgataaaggaaaaaggaaataagatgaagatattttcttagcacaagtgtatacatgcacaaatatgttcttaacaaaataagaactcatgacaattacagttctcatttctgcacttggtcacatggccatagctggaattgatgactaccttctactacccattctttatttcctttgccttctgcaagcacctcagcagtttgtggttttttacctggtagagtcacccagaccatcattcctgagggtctgggccatttgtaatcctgcctggattgggctgttgtagttttccatttacctcaatcacagggcatggtaatactaagagacgccctaagggatctcctgtattccatgcatacttttccttacctccattatggagtagtagactgatttcatcttgatagtccaggtcattcacccaagccaacactgcaattcccttcttggcctgttgacttaaaggtagcagtggccaggtggcaatattaacttacagtttaatggaatcattgtgtctcctggtgacaggttccttcctctggaactaagacctttagaccagcagaacataatgttatgggaacaggaagcaaaaattttgctagtgggtctctagggatgatggtgagtgttgccacttccacttctaccttttgattcctggacctgtgaatcctggctaagggagaaacagtaccatgtattggacactgattcagagcatacacagccctctggagaactttgcctgagccctgcaaagtattatcacctagttggtgttgtcattgcgacttcaaaaggccattccactgttctatcaatccagctgcttcaggatgatggggaacatggtaagaccagtgaatttcatgagcatgagcccactgctgcacttctttagccgtaaagtgagtaccttcatcagaggcaatgttgtgtggaataccatgacagtagataaggcattccatgagtccatggatggtagtcttggcagcagcattgcatgcaggataggcaaacccatatctggagtaagtgtctgttccagtaaggacaaaccactgccctttccatgatggaagaggtcgagtgtaatcaacctgccaccaagtagctggctgatcaccccaaggaatggtgccatattaagggctcagtgttggtctctgctgctggcaaattgggcactcagcagtggccatagccaggtcagccttggtgagtggaagtccatgttgctgagcccatgcgtaacctccattcctgccaccatggccactgtgttcatgggcccattgggcgatgacagaggtggctggggaaagaggctgagtgttgtccacacaacgagtgatcctatccacttgattattaaaatccttttctgtggaggtcacctgttggtgaacactcatatgggatacaaatatcttcagtttttgaccactcagagagttccatccacgtacctcttccccagatttctttgtcaccaattttccagtcatgcttcttccaagtccctgaccatccagccaaaccattggccatagcctgtgaatcagtatgtaatcacacatctggccatttctccttcatgcaaagtgtacaaccaggtacactggtcgaagttctgcccactgggaagatttcccttcactgctgtccttcagggatgtcctagaaagggggtgtagtaggctggggaagctggctcatgcctgtaatcccagcactttgggaggccgaggtgggcggatcacctgaggtcaagaattcgagaccagcctgaccaacatggagaaaccccatctctactaaaaatacaaaattagccgggcatattggtgcatgcctgtaatcccagctactcgggaggctgaggcaggagaatcatttgaacccgggaggcagaggttgccgtgagctgagatcgcgccattgcactccagccttggcaacaagagtaaaactctgtctcaaaaaaaaaaaaaaaaaaaaaaagaaagaaagaaataaaggggctgtaggggctatagtgctggagctgtccgccttcatttggtgcctgcatatggtgcagaaccatctgtgaaccaggctctagtctcctcttcctctgtcaactgattgtaggaaactcctgatgagaccataggtgcatgctgtgggggagaaggcagggtggcaggagtggagatgatgggcatttgagccacttcctcatgtaacttacttgtgcctcaggacctgcttgagcctgatcacatatatgccacttccatttgatgatggaatgctgctgggccccagtttatggctagatgggtcagaaagtacccatttcacaataggcagttcaggttgcgtggtgacttgacccatggtcaaacattcagtttccagtaaagcccaggaacaggccaagaggctgtctctcagaaggagcgtagttatctgcagaagacagcagggccttgttccaaaatcctagaagcttctgctgtgattcacctatgggtgcctgccaaaggctccaaacagcatctctatctgccactgacacctcagacaccattagatctgctggatcatatgaaccaagtgacagagcagcttgcacagcagcctggacctgttgtagagtcttcttctattctggaccccactcaaaactagcagccttttgggtcacctgatagatgggcagagtaacacacccaaatgaggaatgtgttgcctccaaaatccaaataggcccactaggtgttatgcttctttcttggttgtagaaggttgccaaatgcagctatttatcctttaccttccttagagggaatatcttgacaagccccacaccacaggacccctagaaattttactgaggtagaaggtccctgaattttagtcgaatttatttcctatcctctggcatacaaatgtttcatcagtaagtccagtgtgtttgctacttcatgctcacaggatccaatcagcataatgtcatcaatgtaatggaccagtgtgataccttgtagaagggaaaagcaatcaagctctctcagaacaagattatgacacaaaaccagagagttgatatacccttgaggtagaacagtaaaggtatattgctggccttgccagctgaaggcaaattgcttttgatgggccttatggacaagaatagagaaaaaggcatttgccaaatcagtggccgcataccaagtaccaggagatgtgttaatttgctcaagtaatgaagccacatctggtatagcagctgcaattggagtcaccacaacttggttaagcttatgataattcactgtcgttctccaagatccatctgtcttctgcacaggccaaataggagagttgaacggggatgtggtgggcatcaccacccctgggtctttcaagtactcgatgatggcactaatctcttcagtcactccagggatgtgatattgtttttgatttactatttttctaggtagaggcagctctacaggcttccatttggcctttcctaccataatagtcctcaccctaccagtcagggagccaacgtgggggttctgccagctgctaagtacgtctgtgccaattatgcattctgttactggggaaatggccacaggatgtgtccggggacccactggacccactgtaagttggatctgagttaaaactccattaattacctgacctccataagcccttacttaaactggaggaccacagtgacatgctgtgttccctggaatcaatgtcagctcagagccagtgtctggtagttcctgaaatgtctgatcattttttccttcctccagtgcacagttaccctggtaaaaggctggaggtctccctggggaaggataggagaaagagtaacagcataaattgtcgatagtgtagtggggtcctttctcaagagcccccagctttcccttcattcaatgggtgctgggtctgtaaactgtctcaggtctggaaattgattgaagggctgtgattctctgttttaataattcaaattagtcttttttccactcaacctggaagttttctgcttatataaattaagaatgcagtaggcgtcctatcaatttcacttctaggaacactgtgattaattagccaatgccagagctctacgtgagtcaggctattccgattgctgctttgcctctgctgtccattatggtagctatgcccaccttgcctttgatggttgagtgctgcccttggctcctgccaccttagtatctaattattccagttgcacagatggagggctgaaaggctaagccagtctagtcttttcatgttcttctacctgcttttattctggctgtgctggcagcttatgagattgtgcccactcagattgagggtggtctgcctttcccagtccactgattcaaatgttaatctcctttggcagtacccacacagacacacccagaataatgctttgcatccttcaatccaataaagttaacactcagtattaaccatcacaatatgtatattctcccattccttaaagggctcttcaccagtttttattgaatatgtgttataaatcacagtgagcatggaatcagacataattaaatcctaaaattatttacaataacagcagataatgaaagaaacctgactggtggcatgggtagttggagggttggagcttgtctgatgtgaagaacttattgcctcaccatgctgtttcccctccttgggaatttatcattctggagactttggttaccatttgggttgtacacatctctgaagttagtgttaaacctgtgcatctgggaacacaaggataccagacgctcatttatctgataaagacaacctggttcctcttaacataaatgatctcattctcaaataaattgtgtgactataccttaaagtggtcatcctactctaatattttaaccaatctcagcctttacaaaatgaaacacaaagagcaacaccttttatcactgtagcatggagatttgcttatttcaaacttaattagaaatgccatctgtaatagctattaataactttattagcaaactccaccattgcctactaagggtgattttgggaaccagccatgataatctccagcaccttgtgacactgcacaagttacttaacttccataaatctccattttcttattagcacaactgaaataaaagtatctacctcataaggttgttgagtggtttggatgagataatgcatctataataggatgctaaattaacattcttcatatctttattttgcctgtggtactaataccatatatgtttattatcataattatgagataattatcaatatctataatatacaaagaaaagggaaaagaaacagttttgtatgttatgagccccaatagagtgagaaggcaaaggatgatctgggaagaaatttttttttagagtaattcaagttttcttgatatttagtttaaatgacaattgaaaatctaacactttgtggaagatgtgttctataggaatacatttaaccgaggaggtgaaagatctctgcaaggagaactacaaaacaccgatgaaataaatagatgacacaaacaaatggagaaacatttcatgctcgtgtagcagaagaatcaatatggttaaaatgaccataaccatccaaagcaatatacaaattcaatgcaattcctatgaaattaccaatgtcattcttcacagaattagatttgttaaaaagaatagtatgtcatttttgaatctcaggtgggggaagattatcctcatggaataaaatttaaaaggacagtttatcagttacacatataagttaaacatttaacacagtacctggcatatggtaactacttaatatatgtgtactattattgtcatagatatatactactatttgtattttatgctgagtttgttcttatgtttgttaaaaaaaggtatttcacattttctatgtatttactgaggttaaaaaaaatatgcttcctactctaatggagtttatattctattgagaaaaataaacaataaggaataattacacaataaaatacaacttgataaatgcctcaaagggacatttctccttgatgtattgatataatattcctatgtgttttgctgtctcacaaaaccaaaaggtaacctggtcaaaatggcatctgaaagataacacagcctttatagtcaatataatctttcaaatacagtttaattcctttgaatacacatgcaaagcacacacacacactgattaacaatgggctctatctggtgggattatctaaaaattgagattaacaaccacgttttacaagtgattgccattcatactgctattgccaggtgagaaaaattgggcatctcttgtcttttagcttataaatactaactaatataaatctctctaaatggaagaaaaagtgaactaaatcctgcttataaaataacagttaaagttaaatgaaatatgtaatataattcattgaaagaaggtctactgaagattcatactgaagattcgtgcctgtgaggaattgagtaaagaggcctaagagtaaacagtgaaattaaggtgctgtcttgatccaagggaaagccacttatacttaaggaacttaatatataaatcctaaggcagggagttggaagaagagcctggcataggataacaggatttccttccttctttatcttctccatgctgactttcagtaaactgagaaagtacaacacaaattaattatgcctttgaatttctacagtgctttgtgaatggcttcagatgtcaacctatataacaaggggcagttggttggtttatagctgttactgctaggcagtgtttagcagtcttttgaggagcataaggtttctggattagtctaagaaatgatacatgcaagaatatcaaacaatgagtagctgaataagactgaggacccttaataacagatgtgacttttacccctaaatatagagatggtgttagggtaccaagtgtagattgtggcaatatgaataattgcctgttaagtttgggtacctgacaatcattggagaatcgggaactcttataagatgatacatcctttaaatgtaacttatgcaatgctttatatggtcacttagttcttaaactaaacgtactgggagtatcctctttgggcttcagcagtataatgcatactgctcacatagtgcttataattttgactagaagtgtattagtccattctcttactgctataaagaactgcctaagactgagtaatttataaagaggtttagttgactcataattctgcatggctggggaggcctcaagaaacttagaatcatgatggaaggggaagaggcacgtcttacatgacggcaggtgagagagagcgagagtatgaaggaggaactgtcagatacttataaaaccatcagatcttgtgagaactcactatcatgagaacagcatgggggacaccgcccccatgatccatcacctcccactgggtctctctattgatacatgtggatcatggggattacaattcaagatgagatttgggtggggacacaaagcctaaccatatcaagaagttattggtttatgtatatttcctgggagcaaagaattcattttgtgttcttctcatagtcctggtattttttcttgtaacattaagagggtttgcaattcaaaaatttggctattatttattcatgtaataatttatttaataaatatctaaaaagaacctactgcattatgagtgcactcttctagctagtcaattgaaaatgccatgaatgcaaggaccatggctatttcctctgtctgtctgtctgtctgtctgtctgtctatctatctatctatctatctatctatctatctatctatctaactggggactttatagagagacaggatgcttcaaaacaaaatcaggctctgtggtaagaatttagctacatatattttaaaaattgtaaccttaaaacaattacaacttaacccatttcccgtttgccctaaaagtactgtgctggcagccagctgcactttttttttttttttttttttttacctatacaggaaatgggttaaaaggagctttctcttcaaatggctgtcaaatctcagcatttgtttttcttactccatgagactcccataaaatactcataaaagtgatgagaaaaggtgaactatgagtagatgagatgtttatagcagatggaaaggcgaatatagcgtgcttttccacataagagcttgtcaggtaggcatgagggtgtggtggtggagtagagagctatttgccataaagcatctttgtgaagacttcaggctcagagacatcagattcaatggagctgaagtgagagggagcacttcaagttggcatgttcattcagtatttgttgacacacacttttacatcactcttcttaccattcccccttcctctttattgccttgcacacactaaaggcccaagatttaaatcctaggtaaatatcaagaagcaattcagcacactgcttgagcaaaaatcagatactaggagtaggtgcctccccactgtggaacccccatccataccatcctaaagttgagcttcacacctcattcatcctaaagtgaaagctatccattcacatactctattcacaaatgtcagagatacacttagtatctaccagagcagcctatctaaaatgatctacgtggaaacactcaccagccacacaggaaaatccactgattggttgctcattttaaatgtgaatgaacaacaaaacccaaaagataggaagaaccacgataaaccaagacacattgaccctggaaataagagatcattcaagagcagaagaatgcttaaaaaacaaacagaacaaaatgccacacatgttgctcaagtttagtataatacttcctgaaatgtctaacccacagggaaatttgttcacccaaacacacaaatattctgtgtaaaatacttttttaagtattaaagttattaacagaactcaagataaagagaaagctctgggtaccaaaatttatagcattgaagtgcttcgacaaaggtgactggacaaaatacaagattatatgaccaaactcagtatcacacacttgcctacaggtatggtatctgggcaattctccaagccaggaaataaaataacctgatcttaggcattaaaacaaaagctgaagtaaaagtgatgaattttgaaactacaaagaggcaaccattaaacttacctatgaggaagcccatacagccatggggatgcccaaagatgagtacaaagattataattgtgaaacataagaggaactccaacaccattaaagatgccaaggaaaaggggaaaaatgtataagcttttggaggttaaaaaataaaccaggtcatatacaaaaaagagttaactgcctttatagttctcatcagcaatgatgaactacagactgaacataaactacagttgatgaatgccttcaaaattttgagatttctctaaaaacaaaatagaacaaccatataatccagtagtcccactactggtatttatccaaaggaaaggaaatcagaatatcaaagggatacctgcgctcacatgtttattgaagcactattcacaatagcaaagatactgaatcaaactaagtggccatcggtgcatgaatgggtaaagaaaatgtgcatatacgcaattaaatacgattcgcccatatgaaagaatgaaatcctcttatttgcagtaacatggatggaactggaggttattatgaaataataatcatcatcatcatctgcagtaacatggatggaactggaggttaagtgaaataagtcaggcaaagaaagcaaacatcatatactctcactcatatgtgggagctaatagaattgatttcatggaggtagacagtagagtgataattaccagacatggggaagggtgtgttgaggggagagggatggaaaagagaggctgctcaatgggtacaaacttacagttagatagaaggaataagatctaatgtttgatagtagagtaagtatactatagttaacaacaatatatttcatatttcagaatagctagaagagaggacttaaaatgttcccaacatatagaaacaataaatacgtgagataatggatatcttaaataccctgacttggtcattacatatgctatgggtgtaacaaaatagtacatgtacctcataattatgtataaatattatgtgttaataaaaatatacagaatcaattatgagcaaagtaattttgaaaccgcaattctgtattcatctaaactatcaacttcaaagttctcagaaaacctgcattttattctcgttctgagaatgttatttaaggatatatgcacccaagaaaactgaataataatcatgtagtcaagacaaataataaacaagaaatagtagaactaacccagaaattcaatgcaaggaagtccctgaatgacatgtgcaaaaagaagtttgttcagattaaaactggaggtcatttccaggaggctccaataagaaagtctgtattaagaagaaggtcatggattccaagaaatatccaatgactaatgaatgagttacatgacatcatagacttgttaaagaaaggctgtgtcttctttcaacaataaaaaggggcaattaaaaattgataaaaaataaacttaaaaaaatccttgtccaaatgtgaagcaagaaaaaatatgatgtaatttaagtaactgatacagccaattgggccataaacttaactacatttttctctgagtgcctgacagtgcatctatagaaaaggaaatttaacccttgcacattattgccattttcttggttctagggtatttagatgtaatgatattgtaaaagttgcttattggttttcaatttttagaataaaccctttttttcatttaatacttaaaaatgtcaacacaattgaatatgaatactgtgtctgcatgaaaataaaggtaaaactgacagatatgggagttgaaatgctctggagagggcagaggtggagggataggcaggaatatgaatagtcttatgtaaaatattgaagagttaaaagattgtgttcagattttaggacaagaaatagaggattaagtatgtttaaatatagaattgtagaaagataaaactattggcttctgaaaccaaaatgatgtaaataaagtgagcatcttgtctttaatcagttttaacaataggtaatattttaaaattagaaaccagtagataatattacaaataaagcagtcaacatatagagacaaattattttaaaattaggatgttttccattagaacgactaagaaaatatctaaaaataaggttgggaagtagaattgatactgtgggaagaagggatatgaggagaaatcaattactatagttatgcatgggaagctcttatttattttaatttttatcatatgcatgcattaatttgatatcctttaaaataagaaaataaaaaattctatctaatatttcttttattaaattgcaagtaaccaattttggtgtcttctggggccttccataattggtattttagcaatcagaacatcaaagagcagtgggttcacatggaactgtaaaagccttgagttctctttttatactagtttctctttcctttctcttcatatattaatttttcattgagcttccactatatgacaggcacttaccaggtttggggagtatattgcttagagcatagtccctgacctcagtggccctctcaaaagagtccacctgatttcttttgtgcttttcccttttatctacatctgccctgggccctttcccacacaaggtgaggaacacactttcagagacctctacctccacttcttaaccttcaatgaaaggctttctgtagtttcttctttaattactccaaaagaggaaagaaattgccatagggaaacatttggacaattggacaggttgacatttagcactaatgctcaacagttttacctggcctgactttttctggtcttatgaaggatagagatgagaataggcataaaacagaagagagactactgtctgccattgatgagggaaggataaacaattctccctcttaactaccgaaaaggagacatatgacttggggcattagatgcttcagtttaatgccttagagaaagtctgagaactaatttcttcttactgtggatatggagtggacattagccgttttaatcatctgtgcaatttaaatcttgagaagagattgaaaggacacaattgtgtgtgtgtgtgtgtgtgtgtgtgtgtgtgtgtgtgtgtggtctgagctaacatgccaatttcttatttctaagaatatgcattaagaaaaatttggaaatcatggtgagaggctggattttcagtttcaatttctgcctaatatataaacgaccaaaaaaagtctccttgattctaaaacaggagttatgacgaaacataagttctataaaaaggaaagaaattaagttggtaaatctaacatgattatacccaataatatttcttccaaattagtccatggctagaaatattagtcatttagttgcatttgaaagaaatttctattcttgaatcaggagaaactaaattaacatcagggctacattttcaaaaataatcatacaaattttatgtgtaatatatgcttacaactttaatatagaacttttaaaaagatgtgtaactaaaggtcattttaaggggaaacatttacgcttcaaagttcatttagaaaaagatttgatattgaagatttcagtatcacctgttttatctcagtaagttgttctttggtatccttttaaaatgcagaatcatactgcagtgtttttgacccattttatccagtgaatgaaaaggttgtccttattttggttcaatttaacagaataacagaaatctcagacctggaagagggttcagaagcaaacaaaaatctctcctttcacacactgttgatcagagaaggaaacatgggtattgagatctgccgaatttcttgcctttgaaaccctttattatatgcagatggaagagcttgaaactcatcttgtaccctctgaggacaagcatttactcagtccttctacttattctgtctgcagtctgggctcaaccctaacaatctaaattttaacatattcctgagtccacattccagagttgtgccttgttttggttattagatccatttccctagatcttgtgaccaaatctgattctgttgcccaagtcttcagaactgaagcttttgcttgccgtcaccagtccctgtccaggagttagatagaagctggatccctagatactgactgatgtcaactactgtattggaaatccagatactaccttccgtatcatacttattcatacctcgtggggcatttctgattcttactgctattctaggtttattgtatttagccatcttctttgtatgtcttgttttaactactgagctaaacttgtgcaattgtgtcttttttaaaagcacatgtttcatcccaaagggcagatctaattttaattccagtaaacccttctgaggctgctgtgtaccacatgagataataattgtattagtttccaagggttaccataacaggatactgcagactgggtgtcctaaacaacaggaatttattttctcatagttctggaggctggaagtctgagatcagggtgttggcagggttggttcctttggaggaacctggggaaggatctgttccaggcctttctccctggtttatggatgactgacttttctctgtatcttctcatgatcttctctctctgcatgttgtgtccaaatttcctcttcttgtaaggataccagtcatactggattaggaacctccctaatggcctcattttggtttaattgcatctttaaagactctgtctccaaatatagttacagtcggaggtaataggggttaggacatcaacagatgagtttggagggggacataattcaactcaatgataatattcataggaggaaagagaccaagtcctgtagatgtttgtgtacgtacatgataaatactgattttggcatttgtctccatggttgtctatgaaaaacatgatcatgaagaaccttattgagcagttgctttatgaagagggtttaatatcccagatcatgaggacataaataagttttaggcatagccagagactgataacccaggacatgttacttaacccctaagtctcaagttcaatcgttttagaacctggaaataataattgcacataccgcatggagtagttgtaaagattaaatgagattattcatggctctgtgtgccttgtacctgatacatagcaagtactccataaatattctttctttctttttttattttttattttttgagacggagtctccctctgtcgccaggccggagtgtggtggtgcgatcccgactcactgcatgctccgtctcctaggttcacgccattctcctgcttcagccttccgagtagctgggattacaggtgcctgccaccacatttggctaattttttgtatttttaatagaggcggggtttcaccgtgttagccaggatggtctcgatctcctgaccctgtgatccgcccacctcagcctcccaaagtgctgggattacaggcatgagccaccgcgcctggccccataaatattatttctatggcaccaaataggatgcatagataatatattttacagtagtgaggaaggaagcttgaatgccgacgtttaatattagagctggggtagattttgggcagaaagaaccaatgtgtcattctagtgagggagactggcatgaagaaggaaagacaagcatacacactgttctaggaagaataagcttatagacctgtagagagaaaagagcccagaggttacaggttgagggaacaggttatcctagttctgtcaagaactgggttaccttgggtaacagaaggagagggttggattagatcagtgatcctaaaatttttatgtacttttaaaattatctgaggagcatttaaaaatatgtgctggagtagcaccaaaaactaatctggtttagtcaatgtggagcagtgccccaaatttattttaatgtgtagttgaataagttcagtgcacgttgcaatcacttgagggaggagatttttgaaaaacctgctagtattcaggtcccaagcccagagattttgattttagtgttatgggttggggcctgagtattgttattggcaaatctcaaacctgacccttcataaattatgaagtgctagtcctcccatgagaatttttttttggtatcataagatgagcttccaataaaaagttgaatattaatttgaagacacatttgactgggaaagtatccaaaatgatttaacttatgtttggggaataaaatacagagttatatgaatccaggtatgttttggaacttcttaaccttcactttctgactgactagcaggtgtgaattctgcctgggatagctctgtagtgcttgggagcacataaatgagggagggattaaggaacagaagagtgactttgcatatatttggaacagaaactgaaagtcctgtctactttgagataataaatgggaaagtattgctcagagtcttgaggatcatacaaaggtagtaattgtaactgtcctaacactttgtcattccagtcggtgcggtggtgaaactcctgtagattaggttatcattatatacagaatgaaatccaaaaaacttcagccatgcccttcaatcttcacagtgtcttgtgtcttgacacaatcacctctagaactctgttcttcctgactgattagcatttatttcctgtatttcacacttaccatacacttttccatctccattatttggcagtgttctgcctttttaaaatgtcctctatctctagctgtgatttaaaactaaaatcaaatttcgccttctcctcaatcgttctctttgaatacccaattttattcttaatgtttgcatgtgctttcctaagggaaattaattataagcataaacggagaaatcatctttctacatttatatattgttttatggttactaaagtgatagtttatagttacatacatggaattatagttgttggattaagttgtacattgttgaatgtttcttttttaatttatagaagtaattagaaagtaagaaactaataaattttataatttcatagggagaaaagatgtatataaaagtactgctgaggatgattgggtttgaaaaagggtaacttttcttgtcttctaattcttggcatatctgttaagtttattgatttaatggccatgcatttgggaaaaattacttaggtcaataagtaccttttcattggatgacaagacattatttactttgtttcttgtgtaattacagaaacttctcctaattacagagaagtaattacttctgtgttctcaggattctgtttctttaattattttagtaatttggacattaatttttgaactacaaagaggtaactgtaatattcctaccattagacattaatttagtgtgtattctaatgacagagaaaaaaaattatgcatggaaaaaactacctgagttattaagagagaattgccattagatttaagaaagaaataaagcaacatcaataacatcaataataatagtgaaacacaaaacaggttaggaagctcagactgacagctaagtgatcagaagggaaattttaattggcataatccccagaaagaataagagctctaaattaggtgtaggggctgccaagacagctctttctttgggaaaccatgagttaggttagaaattagggactttggggaaactgagttgaattgagcatgagattgtatatttcacaattaatgggggaactagaatagtgattagagtggttcaaactcaaccaagcctggtgtttggaactgaaatcatgtaagaacttttctgtaacccaaataatgagtcaacttgtcaaatttatttaatagctgcaatcattacctctaactgacttatttataaatttagtttataaaatgtgattgcatcacaaagagtatcttggcataataaatactttatgatagatatggacaagtattttttatgataacaaactctataatataaacactggaagtcagcttagtttccaacaataagatactggttaaaaagcactgattataggaatattgtgtagccatgaaaatcttgttatatattgttatatttaatgacataaaaatatatttgtgatacttgagggaaagggattgctaattatatctatactatatggtatgtttttgaaaaaatgattacatatgtgcacagagaactaacaggatatataccaaaatgaatatacttatatttttttctgttgtctctttctgtgtgtgtttttaaacccctaccatagttatattctcttgtatttgtatttgctcaggttttctatttaccattcattccttggctttgcttttttacctttcatgcattcttaaagaccgatcaagttgttttctgtgtctcttcatttcttttagagcttaaggcattatgcatttcatttctatcatttaatgcaaaccttcacttttcaatgaagtacttaattttagaactttttagtaaaatctaaaattaaatcatatgtctatgaaagaagactttagcatgctttcacttttctcaaaaatttactgtctttattctatcttctatgatatgatttggaatttaagttcaacttgtgtttcaatattcacataaatagatatcagtgttattattatagttaatacttaattgccaacatgtttaaatgatttcatttttcttggttacttctcattttccctttctgctttatttttcttcttgtcagggcatgctttgttaattttttcagtgagcgtctgggggtagtaagaagccattagtttgttatcatttcttgaatgatattctagttgcgtatatagcatagacttttttcttccatagtttccagtaccttgatcccaagtcacaggtatagcacattgcaagtggcaaccctgggagagattgactggggttacttttagcctaattaatgggaggagctttaggcctggactgacttctctactggcaggacaggacattgcagcgacagtagcctctacccatctgcactacctttcagtgggttgggtggcttcagccactttcaccactttgcattttaaagattccagttctgcatttatcttatttacgttttgtagtatgactatttattttttgaaataaatattgttttagaggtagaagactatgtgtatttatatcttgacacaaagttcataaatatttttaagaaaaatttttgaaaattatttgagagaggaataaacaagcaagaagtagtctggtcctataggcaaggtataacccagagaaagtactggcctttatgttatttggttagaaattcagctgagatagaatttagggagccttctattctggaaaaccactggttttgatttgttttgtttaattcctaatagattttcaaaatacttctcacatagagaggacaacaggtggatacatataaatagaaaagtagaatgatgtgtagaaataatagagtgagacatacgctcctgtgtagcatttaattacttagcttgtacatcatgtaaatgatcttgactctacttgactatgtgctttctttaataacttggtattttaagtcttatcatattttgcctaacatttctacttagcttctttaatttgttgattttttttgtggagaaatagctgatgtccatgactatacctaggaagcaactaggtgtgtgggcaataggatgataaagaaggcactattacttcagatagcattacttgaactgtagttctgtgaggacaaataaatatatccatttaatggcgtttgaactgacaaatcagatttaaaactgtcaacatatcaaagggaagaaactaactaggacaccacttgaaattacttccagtttacactaacattgctgccaaggctgaggaaattaaacgtaggcaaaacaaacaaacaaacaaacaaaaaaattctccccaaaccccccaaattccactgagaaaaacctataaatgattcataaagataacattttttaaggcatagtggagtttgtgtgaaagaggaatctctaatctccaagtgccagaaatgaaatgagaaaattagatctgtaagtatgtgaggtgatacttcagcaatatgcctggataaatcaagacttataatggttgggggcttgcatttttaaaccacacagggccatgagaatgtttccctcctaagaagcggaaatggcaattttttaacctcttttttaaccttgcatctttatacaagaccaggacactcagagtgctttctccgtaatgaaagaaggatgaatataaaacttgacacagcttaggtaaatgagtaatcttatttctgtctgaaccgtgggtgaaaacaaaaacaagcaacaagtctgttgtaataaattgaagtctcattctgctcatctgttcattaagtggattttatagactgaatttatattgcctacattgtaatgtagtcccgcatcaagaaaataacattaaatttggtccttggtcagtgatacctcattctataatacctttcccatccagttttaagctcaaaactttttccattcccgtaagatcaattattaaagttacaaagaacaggcaaatgctaagaaatggagctcagagagctaaaatgttggctttgtaaattggaatcctttttcttctgacatgttttttgtcttttacagagaaatacagtaatgactaaaacatttgtgccaagcttgaggctgaaattgtcaacttctgattatcctttaaatatctaatcaccatgaaaagcactcaaaaggtctcctgtaggtaatgtgtaagatcagtcagaagttaaaaattggaggagagacattccatggtagtaggtgaatcaggtttattaattaggcacactacaaacttaccttttatatctttcttgatgttcctttcctacccaaacgtcttctctccaaatatcttaaaaatattatctctgaaaaattccctactcaaccctggctcacatcctggcactgtctgacattttgacatgtttgctattctgatcccctttattccatatccagtaattgcctcaattactccatatggttgggtcagggtctggaagctttagggctctgtagcttagaagacatcacaaatcaaagcaaatgatacagaccagttctcattgaagatctcttttaaacatgcttttcctttaacacactgtaaaacaaagaatagaattcattggatactcatattcatttatattataaatggcatcattactacactttgaaaacaataatttacatacctgtaacttaatttgaatttgaatttcagagcaatttgggatccagagcccccttgatagatagcgtcaaatactttgaatcttttttaaccttttaaatttttccagttaggcattttataaccggagttgcttctaatgtccaaatcacccttgtgggaagcctgtaaatagtgatataagaggcattgaagccttataactcaggaaattgtaattatgaaagaggttctcaatcctggaagaaattgaactaaatatattaatttcccacatcctaacattttgagaattcttatgtcttcgaaactaattttgccttctatcttgttattgttactccacaaattgtgtcttgaatattgatttattctgtttttagctgtatgcaatcggaatttactgggctatgtcagttggactttgtcttgaaatattttaagtttcagcaaaagaaataaacacaggccgggcacggtggctcatgcctgtaatcccagcactttggaaggccaaggcggatggatcacgaggttaggagattgagaccatcctggctaacacgatgaaaccctgtctctactaaaaatacaaaaaattagctggatgtggtggcaggcgcctgtagtcccagctactcgggaggctgaggcaggagaatggcatgaacccgggaggcggagcttgcggtgagctgagatcacgccactgcactccagtctgggcgacagagtgagactctgtctcaaaaaaaaaaaaaaaaaaaaaaaagggaaagaaacataaaacaaaaaacatttgcctccatatgattatgtagagttgaataaatggaactttggtacagaagctgtccatctgggtcaggaaaaggagagctgagctgatagtttgtggtagctgaatcacagatatcccagtgacagaacaagacatgagtcccttttattacagaaactacccaaaggaacaacatggtcctaaacatcaactcttaatctatgaaatgggatccaatacttctctttcttgttccttaggatagcttaacaaaaatcagaatacacagtattgataatgcaagcatttttccaactatttctgcaaaatagcaggcttagtaaatatttccaaaaatattgtttatgctcaagtaagtttagccagtgctaactttagctaaaaatgtcctcaatgcaggacttctgaccaccttttctggtaacgtgccttgttatttttctagaaaagaatagaatatgcagtgtgtcctgaatacatgtgattggggcccttttattttaaaccatctgctaacatctctgtaaactggtgttgtgagatcaagacatggcagagctatactatattctcatggaggatcttagccaacagcaaaatgtatgttctacttagtgcggatttatttgcctcaatcacaaactgccaagaacacagccttgaaccagatattaagtgagagtccccaaatttaaggaagtggtaatctaaagtgatattagctttgattattattgcttttgttgaattcaaattctggtgttgccactgacttgatatgtcatttatcatacctaagcctcggtttcctcatctgtaacatgggaataataatagcaataaacctttgaggcacagacctgttctatgtattttttcttttactccagtgcttagtatagttgatactcagaatttttgtttgatgaaagaagttctgaatgcatgcatgcagggatcagtgaaaattggaagaaataacagaatgaaatattatgcaaggccgactgtcccttgaagacctaaagggaagtgctaaacaataaaaagattaatgtgcattgggtttagtcaatgaaaacctctcagaggaggtatcgtgaacctgaacatgtttttatgccataacctttcataaatattatattctactactggttgtaaagattaagaatcttggtattactaaaaggatctggagtttccacatgtacagattaaaagacaatatatttgccctcttctgtccagagtttgtcctgctattgtttcttaagtgccaatacattaatacaatatagcagggctcacacagcagagttagccagtaaactcagtagtaatgtgttagttctacctgggcagtcttcattctgtagtcccataaagaatgagatgctagatttacatcctatcaaagtaaattatgtagacattctcattatttaaaatgattagcatatttgtctatatggaagtttacattttttacaagatataattgtgagcaacaggatattacataagtgagtcagctgtagattagtagagatgtttttcagcttttgaaagtactttggaagagtttggaaataatatatacatttttcatatagtacttcagtactgtccttaatacgctggtggtgtatggaacttagaaaatcaatacattattgattattacttcaaaggatacttgtaggagatttgtgatttgaaagtcagattaattttgcatatggaattaataggactatggaggaataaaaaggaatttctaagatattatatgtgatcaatatttcaacattaaaaatattggcatttgattgtaataggtttttatctgtactttctggctgtcatattagtaccaaagtttaatttgaaaatgaatgtttggtgaagtagaagccttaggttagtgacttaggaatttcatttccaggataaaccagtcttggtaatactccatgtctgtttctctacatggttgattctcttgttaatgctatccatctttgttacctctcagattcattttgaagcatatgaatattatttaggaagtatgaaatataggcaaatgcaaggtgattgtgttatttttgctatttacaacattttctgtattgaaatccaaaacaataataactacctgcaggaaaatatgcttacattaaaattacatgtgaaatttttagtttgtttgttttagtgaaaagactacagttaaggtagataaaaatatataatttttttcataaattaggaatatgcatctcatttatcagaaggtacagctcttcatatttcagaaatgtgtattagttttgtagcatgtcacatataataggaatctatatataatatataatatattcacatatatatgtatttgcatctgatagaaaaataataggaagagggaagctaccttaaaaagtttatgtaataagaggtaagtactatttaaagaatatgtaacagttaaaaatacagcctaagttcaaatatttcaagaagaaacaaaagtgtatttcttcataaatcaaagatataataataagtgctcccatttaattaattttaatggtactgaacaaaagcagaagagttaggttaagaaatcattctatgggccaatggccatttcattgtcataaaaatcctttatttagccttctccacaaataagctcacagcacgacaaaggacactagttagagtaatttgggcgataagtaaacagaaggaatggctaggagcatagtgtcatctggcagagagcttatttcctgaatcctgtggatctggttaaaacccaacagagatgccaatatgcttctcctcagtaaatgctaccagtccccacaccaccaggcccaccgaagcttgtctacagtattttatccaagcagtcctttgggtaactgcacagtgcctgcagtgacctgagtcagtcatgcaaggagactttcttgttctcacaccaatgttttatttcagtttccattttctgctggtcctgttgttcaatgatataagcagagtgatgaaggaggcgcttcacactcttcttagataagatcttgagcagcagagagtggtttaaacagcaaggcttaaatctctcaagctggatttatttccaagtttgctgtcatgtgtgcacctgggattcatgtctcttcagaagggtgggaagaagtgaggtctgttgattccgaagagggaacaattgaagctcgacgagcagttgctggtaagcaatagataatggtaatcccacttcattttgtcccagttgtacctaaatctatatttaacactccctctgtatctattttccagtcaaaatatttctattctctgtgtgtcaggtgcacagtgttcttaattgaataaagtttccagttaccaactttatctttaatctgttactctgaaatgagattgtagggtttataatatagctctaaagattttaagatgattaattatgtttatgattgattcctgtgtaatagccacatcaagggagatttgaagattagaaaatcaatgttctgtgaaaataattaaaaaaaaatagcaggctacctaattgtgcatgggtttttttttctgtaaatgtgttccatgctttactatctcatacaaagaatgagaaatacatgacaaattgcagtaatcattagtggaatgtcaatgcaaaaataggaagtttgtgtcacttttttaaaataatggttcctgggttcttgcgaaagtaccaaaaccttttcacaaatgcaggccttgacctaaactacaatagcacaaggtcaaatggaatatatgaagcaagctcaaaattgcatttgatgttaggttttatgtattctctcccaagggaaatcagttttctggtctttgatatagctgtggaatcacaactaagtatgaggctgtgaaatatataacccagaagaaggatatatatagctcaagatggaagagttgtagaaatattttaaatgagtaaatattgttaacataaattttggaatttaaaaaatgaaaatagaaggattttttctacttttacctagacagtggctccagtgaataacacttactactatgcatgaaagctcatagtatgtggtacccagaaataagtaaggatattttagaataaggtcaacattaatctcttctaatattgattctctgctttgattctgtaattttgaaatccatgaataccattttgattaataaaccctgtttagtttattaaattgcatttctaacagaaaatacttaataaaccaaacagggtttggtaacaaattgcatttctaacagaaaatacttaataaatccaaacagggtttggtaaaaaattgcttttctaacagaaaatacttgataaaccctgtttggatttattaagtattttctgttagaaatgcaatttgttactatttgataaattttcttatatcaaggcactttggggaactcacggtaattatactaaattaatataaattcatgagatggaatgagggacaaatattagattaatgacattcaaaatgactttataatttgaagtaagcccatactggataataaacaagagaaaagaaataggaatagagaaataaatatttttttaaatctcaaaactcaagcacaacaatagacacatgcagtgtattaaaatgttttatttcagttgacttgagcctacataggcttatatgattcatgcattctttttttttttgggagatggaatcttgctctgtcacccaggctggcgtgcaatggtgcgatcttggctcgttgcaacctctgtctcctgggttcaagcgattctcctgcctcagcctcccaagtagctgggattacaggcacccaccaccacacgcagctaattttttgtatttttagtagagatggggtttcaccatgttggccaggctgtttcaaactcctgacctccggtgatccacccgcctcggcctcccaaagtgttggtattataggcgtgagccactgctcccagcctgattcatgcattcttaaattctagtcaaagaacattatatggtagcgatttcaaccagacaaaatgagtatattggttgttgaaagttttgactccctttctattggttctcttctgtatacttgctggaccagcagatctatctctagaccatgccatctgtatgtcttcttaatgaccatatcataatggaagcaacttaagttcagcaagtataagacttcagccccaatagctgctccggaaaatcttcaccacctcaaaacatgggaaataaaagtatatcattataggccccccgctgcacctccaacaagtcacgagtactttcacaaaaactgacataactttgaagtaattcaacaaaataattgcagtaactcctaactactatggtgtagtgaaaagctcatacatggctttcaaaacagacaaaaccaagttcaaatcccaactctgctacttataaatcatggacttcgggcaatttaattaggttttctaaaccccatctctaatatgggataagtgttgttgatttttccatatgcctatgagaaataaattaactaaataaaattaatagacagtataatatttggcacttaataagcattcaattgatgtttatttcccttttgcttttcccaacaataacttggtcaggttttgactacagccagctttaagcataggcggaagtttgggaaaagaaaaaaaagcaaacagattctgagtgagaccgtaaatatgttcttttaagagagaaaaattgttcaaattagtcatttcatttaaggctgatattttgcagttgtttttggtaatgagatgatccatggctcagttttaattttttttctcatgagataattatttttgacaagtacatgtaatttaagtaaacacagcaccatttgttttaaataaatgaaagatgttcctaattttctctctatcctcatttggccatttcattttctaaaacaaagtagaagcagtccaccttgatttttcagcaaataatccctagatgattagagaagtgtatcattattcattgctgtttctgggatctgaatgttgtactacaataaaaatgtaattgagatagtaacataatttcaaatcaactaattttgttgttactgttgctgttgttctgtaacacaaaatatgggtggatgaagtaaaatgtaggtgacccaatgagaggataattattctgtgtctcagtgagaaaaaaaaaatctattgtattatgaattatgcatctacagtcctcaaaaatatgcatctttaaaaatatcagaaatacgagccaccttctcctgtccccagctctctggcaaaacctgtttgaggttgtccttttgccctctggagatgagccaccgttagcactaggctggccgtaccagaaaagcctgaagaagcacttttgcctgtgttcccaacaatcaattgtgtatactcttggtttatgctttctggtgccagttgtcattgagctgagtaagattcctcagttagggaaactgcagaggaaatgatctgttacacagggcttggcaggaccattgccagtgattgataatgggaccaaatcatttcaggtgagttttctgtggtctgacaggcatctgctcaaccttgtcatcttaatccatgggtatcccagtgagtgtcagtgggaacaagatgagctcctgaacatttgcctgagtcttttcttctgtgttagctttaaggaccacaacgtttcatctctctggcttcaggaaggtagcagcttctgtgcattgttttaggaaatggttaattgaggagctaaaagagctttagtgtatgctacactgggagccactttagtacagcacagagcactatagattaatgctgtaatcaatgagaatctgttcactgcagagatctgttttgatgacagcagcacttatggccttgtttagtgtcactgttgtataatgttggacactgcaggcttttttggctttgatttagaatgcaaggaccacagggaattttatttaaaatgttgtattttggtggattttttaattgtgttgtgcatttgctgccattgctagctgaaatttaatgatttgatgccagtggcatttagttaaccactccgatgctgctgttatgtttgctgggtttctgcagtttctactacttcatacattgcactcaggaacaggtaaactaaattatattaatctatggataaatgtaaagttaatgtaatttattgtttaattatccaaaagagtaagatactaaaatgtttcatttagattctatcagtagagaataaggatgttttgctttatataaatatgtaattttaggatgcaataatgattacttgtattacataaagttatttttatgatttaaatgtttatctgaagtacacattaaattatatacattttagtattacatttaagtcttaacttgagatatatagataatatacaattaattcagaaagatacatttttcttctctgatggatcaaagagtttgctttccctatttagtgactttcactaaaattagaaaatgtcagagcttaatcttcttgaaaatacaaagatttaagtatatatagattgttcttttcaagtgtttagaaaaaatgctgaccaggtttggtttctcctaattgacagtcctgattatagaacacattcgtggaaatgcctgtgttttcggtgatgttaagctgtggactaaaggggaaactgttcagatgaggggaacagagagcccaagacacaaagaaggaaagagaagtgtaatcttttgcatcagagatttgggtgtgtgaccttgggttaaaagagtaactagtgactaaccccttctggcccttgtttcccttctgccagtttggaaaaagactctcctgttattctctgtaggaatggcaaaacattttttcagatgctcaagatcatctattgatgattttcatgtagaaaaaagacacaattattaaatgttcaaaggtatgcagttttcctaatacaagaggtaaatacagcggtttttttgctttttttttttttaattggcttcattgtaactattttgccaaataggcattgagtaagtttgaggtgtcccaagggcacctactattaagactgcactccttgggagaggaaagaggcatcacagttgtgctgcagcctgatgaggacctggacgcagagaggcactggggctctctgaaagtcggccagggacaagggctgtcctcactgctcacttgctccccctcaggttcagtgtgtattgctgagggcagctgaagagagctcctgccttcttttctcagcaaatgtttttcaagaggtctactttgtgctgaaggcaagctcaaaatccaaagggtcagaggcaaatggaaaagtagccaccttccactggcaaaaatatgaatcagattgctgcctaccaaatactagttaatgtttgtgagtctagcctaattaaatatattttttagtgaggatggaaggattttattgtaaattgaacaatgtgcttacagagtggctaataattgccagtttataatgatcatgaatcttctgttgatgtttatacttgctgtttcttcttaatagtagacacccaccattatgagaggaaggctgaggcaatgatggttcatgttcccagatatatgtacatgagagacgaaagaaaaagagaaacaatgtgattgatttctctgtctagttctgaggaaccagtctgaattatagtctctacacatatatttatgagggcaataactttattagtaaagtgattatgaattccatagaagtttgtctgctcaagtctcttccaacttcctgattttatggggtgctgctgtttattagtgcatagttaggaagatcttcaaggagaatagatattttcattttgaagtattacctgtgaatgttcctggcaaggagggttctgttagagaaatgaagaagtcatttggaaaacaaaaacaaaaattaatctcaatgaacagcaaatatatattctcccctatccttccccaggtcatctgtaaacacttttaataagtaaaacaaatgcttgccattctcaattttctaaggctagggagattgggaagaagcatgtcaatttatcaaagaagatacattaatgaaggaatttgtaattatttgatactatgataattgtcaagaaaacttttaaatacttatcatcatgcctgtaagttgtaggctaatgaaatggtttcagatattatataacctgcttcacgtaggccaatcttttgtctttaagaagggaatcatcataattatattatgagtgggtcaattacttgcagaagtgtaaccaaaaatcttgattgcgtagttaatttaaataagttttagagaaggttttacgtgacttctatgagtcttgaatatctgggaaataaattcttatgatgaactgtaaacattgaacaaatttcaaaactgacttcagaaaagggggtatattgatataatgactggtgagttttaacaaatgtatttcaatactataatatctgtcttatattttaggcttataaatagctttgagggtttttttttgtttgtttttgttacaagaggctgttagccctgcaatgtttgtggtttttctctctagagaatgcttagcccttgaaacttgttcttctgagtaggttcaaattgcaacaacttttttatccacttaattttttttttacttttatttcaggattatgttctgtaatcacttatttagattatataaagtttgttattatattttctatattttcctatttagcatatatctgaaattgtctaaggtattcatcagagaagagatgttagtacatttgtgtgtgatatttctcttgcctattctatattaaaggcttttgaaaaatataattcattggagtgttgctaggtcatgaaagtgctttttgaggtgagttcccttgctctctatatgtactcacaaagctcattttctctgagtatggttttttgatttcctaagtgcctggcttaaatagtgatcttcatgaaagcatactgctgaggctgaggacctgcaagagaggataattctgggagctaaaggtaaagcaacaagtccatatcataataccctactcagggtcactcattcctttagtccctttaaccatttgttcttaacttggagagagatcagaggcctttgagaaataaaggaagcaatggactcttgagggaaaaaatacttttgcacacaaaattttacttgcaatttaaaagagtgtgtggatcccctaaatgtaattatggaccatgtaaaaggacttgcataactcaggtttataatcctttccttaaaagtcacaacaaagaagtacttgacattcagtggtagaaaaagtcctgcctacacaaaggtacaccacttctcatctatggttagtggataaactcaagaccagcttcaaattgctcttgctaaaaaaacaaaacaacaacaataaaaaaccttagttactagttggtgttttcattggctctgccattttatatcataaacaaatacacccaaagcttaaatctccaaaagataaatatgtgatgattagacagatcattggcataagcaaaaacattaggaatgactgcaaattcattgagcttgtttctgtttagaatggcttgacagagactaggtttctcttgacaataggcttctttgacaaatacgttgtgatttcttgatttcagaggctagttttgttttaggcagacatttagttatagagatctctatgtaaggtttgttattatgagattttactgtaatcagagctattcaattaagacataaaagtgatggaaaaattaagcacagaataaggggctctaaaacatctatttaatctgaaagaccctttgagtattggtaagaaacatgtggtttgtaacaagaatagtctttctgaagtttttgcttgaagctgtcccctttgagtttgctatatagagtctttaaacgtaatatctttattctccacagatttcctggatggtttaacaaagctaaattgcaatggatacagtttgcatacttgtgaactaagtacacatccatatgtgcgatctaaaatgtgatacagtgataattatgtcagagattatggtaggcccaaagatctggggtgagtgtgtgtgtgtgtgtgtgtgtgtgtgtgtgattttttttttctcattaaaactattagtacatcactttgagaaacaaatagaaccatagaacttcttggtaataatggaaattataaaggccaataagatgtttttcagtgtttttagtccctttcaactgtaaataatgcaaaatggctagcctagggtagtaatgagtttctcatttgaaaactaagccattagaatacagttgcaacaattatcacaaattatttacaaatatatttcaaacgtgaataataaacattttatttataagctaaatgctacttatggtcttgccagttaaaaagaaactgaggttgagtttaggaggtgctattgactggctcttttattttgaaatggagatcagactttagttttatttatagtatacctgtatataacataatgccttgttttataaaagataaaattaagctatgatattttttcttaatactgagattattataattactataatttggtatttctcatggattctatatttctccagctcaatcctgctgtgatcaataagatattttagctagcatttgggttggtttttacggaaattaggtgaaatagaatgattttatattgttaagattggtgatattattaggtcagtcttcaatgtgcacatttttattgacagaactgagttaaacatatttactgtctttgtgagtgatgtcaccttatgtctcaattgggaacgttttgttatggatttataaaaaattataaaatatgaaaaattgactttttaacattactgaaataatattcaatttaattttttataaatgtaatctttcaaatggtaattttaattttcagatttagtgttattgaatagtttatcagtgctaatggtttgcaattttatttttttgacctaatgtctcttaatttcacaatttaattcagttacataattctctaaaaagatagttttgttcacttggtttgctctttcttaaaagacattgatttaagaatctttaaaagacaattcagctactctgtgtggggagtattatgcaaagagcacttgatcttttccatttttttgtactgcattcaaaaaatatcaggaaatagaatatgcaaagggataagagttattatttacagtgcatttaatctttaaattaaattcatgattaatctgaagcaatatttaataaacagttgctgtatgtttctgctttttgttgcgttgataaataatgacttaattgtaaaaacttagcttctgatctcttcttatttacagctgagtttttcgatgtgccagatatttgccaaccagcttattgttatgattattgctatttgtttacattgttttaattaaagtttatctcatcagaattataatttaccaacctttgtttttaattaggagggctataaagggatttcatccttgtttttataaaaatttacatgctgtaatatttttagttgttgcctaatggatattgttttaacatcaatgttttgccctttaatccagttgttttcatatataactgttcatgcactccttaacacaattatgttcatagagctacacacagtatcacagtgttgagggcacatagactcttagctgatttgtttgtttttgtgtatttgtttgtttaggtttccctgcccactttcttgttaataattattgctgtcaatgtgcttgtttgaacaaaccattttcccatttacagtgtgcatctttaatggttttgtggggttgaataccaaagaaactcttgtattattgtggctataaagttatgagcgaggtgctggtgtgtttttctaggaataaagtctaggagctcagattttgttctattgctttttgccagatgagaagaccttttcacttacttcccatcctttggcaagactctcaaataaattaagataacttgctatttactgtaaagtaatacctgcacatcagttccattttgttgttttctgttgaatcaaagttattttgagtttgaaggagggaaaactgcattttaatgaaaatagagttacaataaatatactaaattatattgtgtacatatcatttagtaagattttaattgctatgttaatatcattttaaagcctattttaatatcaaaagtgatttacagtagctgcgaaaatgtaaaaatgtagccaagtgaaataaatttaaaatacatagaaaagatcagtaaggggaaataagggtaaaaattaggctgcatatttaatcacaaatatcccaacacaaaaaagtgtaattcattacaaatgcacaacatctttaatacaaaataagccagttgcaggccaggtgcggtggctcacacctgtaatcccagcactttgggaggctgaggtgggtggatcacgaggtcaggaaatcgagaccatcctggctaacacggtgaaactctgtctatactaaaaatacaaaaaaattagccaggcgtggtggtgggcacctgtagtcccagttactcgggaggctgaggcaggtgaatggcgtaaacctgggaggtggagtttgcagtgagccgagatcgcgccactgcactccagcctgggtgacagagcgagactccgtctcaaaaaaaaaaaaaaaaaagccagttgcgtaagtgcacactaattattcctgataccaacaccaaaagaaagtttcttttctgttatttcatagaggagattatcagcaggagcagaagcagcatgatccatatgagaatcatcgtcaccatgatccatatagtaaacaacctgatatagtaatgataaaggacagtacaatgaaaggaactgtaggtgcagtgaggggagagggactgtctagaaatatagtgtgttccaggtgcatggttgtttgatggtgggaattaattcgtagttttgttttagaaaatataaattgatttaccacatagccctcacaaagacttctgtatatattgttgctttgtgttaaacatttcaaaaatttgtagggcagtatcttcaaggataaactctctaaagtgtacttgcaggtagttccatgcagctagttattgtgaagtcatatatttaaacagccagtaaatctgggaattggattctcttgcatctgtgacaaagccaagaaaccagtgttgaacaattttagtctaggtcagtgaggcttacttattttttaaagtaacagttccaacatgaagatatttttaaataattatattggaaatatagatttaaaacggtttattcagtcaaatatttaggacccctggaagataattcctttcttgagtcaataagttagtctttgaccgacattaacgtagtttgctttttaatgaaacatgtatatacaatctatatggatttgttgatattgcttctttatcctcatttttttgtggtttatcttatttcagttatttacttctgtcacatggagttggagtacagttgaaagaacatgactttataaagcttgaccagtttttcattgagtcagagatttagaccagtgactgcaatgttttgcaacctgatttcctatagctgtagttttggagttttattaatatggctatctagaagttttctcaacaacaatgcgaaggcataaaataaaatgttctccaaacttctgtgtctggtgattttccactgccagtcaaagaatttccaacttaaaaataaagtcctttaatgtatctataaattatttgtttgcatagccaaaataaaaacaaagacaaacaaaccaaaaaataagtagaataaaacagaaaagaaaggcaaaaacaaactattcatagtcacttgagggatctctggtgtcaaaacttgtttatattacccactatttgctacagtataaacttttctacttttttgtagattaatagtatattttaaaataagaagtatcagtcccacataattacttctgttttgttctacatatccttaaaattcatctttattatcattttactattttcatttatatcactaaaagcatgtatccatctttacattttttatttccttgtctttgggatatagaggcaggtaaaaattgatttgacattcagaatattatttcaacttaatgctgttttgctagtattgcctgggtctggataaggactaatattttcctttatcaaagatatttatatgtagagtttgttcttgtaatgtctttgctgtgaacttgcccagcacaacaatttcttaaacctatggttaacatccagtccccaaacaatgaaaacaaataaaccccaattttttccacagggtttcctggctggttattccgagactttgcacttgacaacctgttctcccacgtgaatggaatactcagtgtcaatgtggaagcctggtcagttggaaagttgcagtaaaatatttccttctgctgtacagcacttcccaaattcttatttatgaagagtcattgtgttgaaacaaaacaagtatccctaagattgtcaattttgtgatttgttatccaggttatcttactattctatatttagatcctgggagggaaatttctcagttattaggcctcaggtcatatttacacatgaaatttattcttctccaaactgttttgtgtggaaagcattttggccattatcaatgaccttgaagacttttcttcagatacattttcattgtcatttaatacagataatacagtatggtctagatttcttgaagaccatgaccacattcttattttataatcctaaggcactaagttgtgtgcgcatgcatgtgtgtgtatgtgtttgtgtgtttgttgttcaagttttccggaattttaatttataaaatttatctaaggcattatagcaccaggccaatgtagaggtaagaaagatggcattgaacatcatggtgttttgggaatgtttctggaccccaaagcttcatgtgatctcaaaatctaaatttatataaatgtacataacttttaaaactaggaagaattaatctgatgactgatgtttactgtctccaatttcttttaatttctcaatatcgattacccttttcaaagcaaacccacaatgttttctgttttctcaaagccccattatctacggtatttcatgtttaaaattacaatagttattttcttactaccatcaatcctgctattgtttagataatttttaaaggaatataaactaaaaaaatgaattaccggaagttaggaagcttacaacctattagaaaataaatattaaaatatattttacatctaatgtctactaaataatttttaaggtataatacaagctgtcttcaaggaaacattgttagggatatcttgaacaatctggccaattaataatttttacaaacaacaggacttcagcatttttctaagcccatttcaaagcatgttttgcaaagattacagatattacatctattttggttacaatcactaattaactgtaagtctgatctctaacaccacgatttcatattcttcatctcaattgtgtaatgagacattaagctctatttctaaactcctttacaattcacaatactgacatatctcagttaatcctcatgaagtgtttgtgaggaaaggcactattcttattttgtaaaagaggacaaggttaatagagatgaggagatattatcaagagaatgcacctaatatggcagatttaggattagtcacaagtctccaactcggagtacaaagttctttttactgcataatcgctgattttataagtgttatatgaatatgattataaatattagcatataatgttgatggagaaattaaaacataatgaagttttgttgattactcaagatttcaaataagtaaactgctgggtagaaaaatatatttttcttagtttgtacgtgctattagaattgacagaaatgcttataattatataaaaatgcaaaatgtttttagtatacatttttatactctgacaatgtggatttctgtggtgctctatagttataatgcagtttcgtgcacattatctcattctaccctcagaagaaagaggggttctatgagagttagttaccttctgagtcgaatgactgagctcatgattcagccagaaattttgattctgagttccatataactgctttgtagagttgtgtcatggtggtgtttgcatcccaaaactttgctctcaaattcaacaaactatacacacaaccagaaaaagtactgcctctaccaaatatgttaataaagtttccctttcctggaccagctactgagtttccttgcctgtgtcctaaaattataaaacataaggatggcaccacagggcttcaaacaaatatttaatcactctctggggtagttcaactccggaggtttcattgagtacgaatattttctgaatacaaatatctttgtcacaccaataacttaataaataataattgatgcatttacatgaatcaacttaataatacttcagtttacctgaattatcaaagttacatatcagagagaaagacacaggggatgttcttggttttaggatggaagcagagtgcaattatgaacaaaggggaacttttaaaagggaaatatttttctttttttaaaaaccacttcactgaggtatatttgacatagaaaaaactgtgcatatttattgtatacaacttaatgagtttggagagaaatatacactcataaaactagcaccacattctgtgccataaacatatccgtcacctccaaaacttccaccctgtttattattatcttttttgtaataagaacacttaacgttaagatttaccttcttagcaaatttttaagtatgacacacagtattgttaactctagacacaattctatacagtaaatctctagggtttattcatcttgtattactgaaactttgtaccttttgacttatacctccccgtttcccctgttccccatctgctagcaaccaccactctattctctgtttccatgaatttgactattttagattcctcatataatactacttatactcctcattatgttcctcatataatattttccttcttatctggcttatttcacttagcacaatgttctgaagtttcatccatgttgtcaaaaatggcaggatttccttctttttcaaggcttagtaatactgtgttgtatgtttataccacgttttctttattcatttgtcagtgaacattgtttcaacctcttggctatagtgaatagtgctgcagtgaacatgggaatgcagatatatctttgagattctgatctcaattcctttggataagaagtggtattgctagaccatatggtagttctatttttaattctttgaggaaagtttatactgttttccatagtgactgtactgattacattcccatcagccatgtagaaaggttccaaaatttctccacattctcatcaacactgacttctttttaaatttttataataggccatcctaacaggtatgaggtgctttctcattgtggttttgatttgtatttctttgattgttatttatgttgagtatctttggtggtaaacatagctgccatccaaactgaaatttctaacatgcatttagaaaacaatagcgctaacaaactcctaatggctagagataatatgcaactctcccaaggatttataccttttttttttggtcctggaaccaaaaccagaaatttgattttaagttacttaaaattgttaaagaagttcttgctgaagcccagtggtctgaagaggcctctagccctgctttgggccttgagctcaagggacaaaaatctgtattacctaattttatgcagtgtttgccttcagatatgtttagggagtgaatattggcctgaatttagaataaaattaacagaaagtatttgaggaccagtattttcactatactaggcactttgacaataattcaatcatgaatgacagtaattcagttgtgaaagataatttatgtaaattttgcaacagtacacatagatttatttataaaatacactttaatattttatagattgtatgattaatgattaaatttaacaagtatgtcttcgcattttattgtaatgcctagataataagccctattaaataatatttatttcttatccctgacctgtagttaggtgaaattagactttctaggactttgctgtatagcaaattattgcttatttatcccaaagttagctcctctattatgtataatttagggtaagtggaagcacacttttccattgcaggcatggaaacatcttaaatagacttctaaaatatgaagaaacatttcaaaatatattttcagtatattaatccagagttaagagtttatcttagttcttagacttcagattttaactcttgtgtatgagactgtttcccaaatgaatatccctgtaaaatattaaaatgtttatatttttaatatcacagtgtaactaaaacagtatttaactcacgtatgctgaccatggtatgtgtccacgtgtcaatatcttaccttgtctcaacttaaaaacctattcttagaactcagttggctttttgtgtatgcagtgcataaaaacattcaataaacatattttgtacaatgcttcattcagttccaactcacatcctgctatagaggactcaaaaaagtaaaagaggaaaatattttaagaggttcaggaaatacctgggaaggataattgtgatttttggtctgtgaagtttacatttttttgaatgaaaatctattctattaatatctagaaagaacaatctctttttgaaggtgaccacatgtatgtatttgaaattgctattcattgctgtgttgctgtgagccaatcttagaattggtttgaattccatcttttactattattcattataatgatgttaaaaatatgctgcatattacttctagagatagtcaagaagttcaaattttctaatacttcaaggctttgggacagataagctttcctttactacctgcacattaggtacacattccacttggtcaagtagagctgtcatgtaaattgctaaatagatatttaatatatgaaattagaggaatggtttttttatatttttaacatacacatgctcaatcgtgcctgtatattattttgaagggatttttgtttaattggcattgatcgatcttattgaaatccattgcgctttaacactagacatcatgatacacaattctaaattatagagatagagttacatgtttatgccttgttacatactctaatcataatgacctgggtttaggaaacactggttctctttagagaaaatgtatgtgtaatttagctgacttttatttctgcactgatagttgggtgtttattaagtttaataacctactttttcacaagggatagtataaaaattttaaaatcgctcacaaaatataatgctcaaaattataacacttcattgaacttggctagttatgaacttgagacatttccatagacacaagcagctgacgtatttcctgattctaaattaatggtaatagtgaattagttcctaggacgttttattgactgtgaggaccaaggtgcttttgtattgactccataagcaaataccatgaatttatcattttgcagctatgccacctggcagccaatatctttaatcaactattagaaaagtgatcaaggaaaatgttttgtgttaatgaaatattagactctgaatattttaggagcatgttttgttgagtgttgcttattccgttaataatagtgaaatcttagttataaagacaaattaagagtgcttcaaagttcagtaatatctttcaaacagtaattagagggatagaagaaacaaaggtagtttacaactaagtatttagattttagattttattttttgtaagtctttaagcaaaagtgttatattttaatgggtaatgatgaaattagtgataagaaaactattagccattcagaatatgaaggaagtataattgtatactaaaatatatacaaatattgtatgctaaaataatgaatgtgttttttacatttacatttgttagcaatatttagtagatagctacaaaactgtgtatggccaaagttggaaaaaataaaatttgtttaagctgcaatatctgtagcatccattttattacgggatactgtatgagtcctggctcctcactggaatcatctgacagactatgtgtaatatttatccagtaccaaagcaattaaattagattcttcattcagcatcattattctgcaaagcttatatatcatagaatagcactgcttgatagcactgttttcataataaagtgtgttgagtatcaccattgaatcttacccagaaacatcagcttttggtcctttgcctataagaacagttttttgcagatcgaatattcacgaatatatgtatctcatatggtggttcaactccatgttttactcatatttgatttataatattaatagatttacttaggataatatgagcgaaacaaggggttgaaccgccatatgagaaattggggcatgaaccagagaagaatcctgaggagtagttttcaagacctaagtcaggttattgagggatacaataaacttttgttttcttgaagtgtttaaagtagaaagaatttttgtcatttttttaaacttcaaagactttttaaggtagcttttgaattaatgatcaatttttctttttgggggaaatataattttctttctcttcaaatatctcagtgtttctattaattttcacagaatttcaaaatgaatcagcattcaggaagtcattaggcatttttactaagtatatgaaattataggatagagttttacaaattgcaataattaccttttgaattataacatttgtgttagtagtaatttcaattttattaatatagtttttctttcagaacaagctgtcataatactaaagagagagctactttaagaatagtcgtgaacttttacaaatagtaaatatgaaagagaagaaaagttcttttctgacttcctaatattccattaactgaggtggcccagtaggagtatagagatttatcttttttggcatcaaaccatgtatacatttttaaagtatgtgatttggagagagatatggaatctatgtgaagtaaattttaacagaatatagttttttctaatgaaatttctaatattaacccctgcatagaatatactactgtaatctacatgaacatttgaaaaatgtttattgtagtacctgtataaataacgtttaaggaaaagggaagcagttcctaaaaaattgaagtgtatggattgaagtgtatggaattgaagtgcctgaatattttaaatattattaaaaattatttcatgtagcattttgtttatagtgcctgtatctgcagtgcctgtcatgtacatacaattctttacctatgatctttacaggcatcaaccaagcatattttcccaacagttgatagctcattattaactagcatgctttactcactttatgtttttctctttcaagatctatgcagagaaaaattttattgagttaatctgatgttgaaaatttaaaagggaattattcccctgctttccctaatatctcttctcatgtaggttacccaatttttctccggcctttcatcctatacaaatactgaaagcactgatactttccattgaagttttttcagtttttctcagatgccttctttagcattatattgttaagccaaaagatcaaaaataaaggttcataaacacatatttacaaagttagaacttttgagtactctgtcatttgtagccagtcttttggaaaaagttatttttcatatttatttactcatcactgtgtcccaaaaaatgtatgttatgttttttagttgatgagagaagataaagatcagataataattttgaaagatattatttagttcagaaagtataaagagagacactatattttagtacttacctcatgtcaatgaataaaattttagccagcatcactagatagcaggttgtggctgggtatggactgtcctttaaggctaggaggggcagattaaccctgttttttttttttctgtacatttatatgtttccagactgatttatgagagaaaaaggtagtcattcattgtatgaagtgcatttgtagcatacgttcattccagtgattcaagtcacaacctttgcaacacaggtgtgcatcattctgcgatgtacacgctcaagcttatgatattaaaactctttatagatcgaagaagtaaagcttaaagtgatacactcttctctttaataccattacacttttcattctttttgtattgcacaggtgatttggattattactggttggatcctgccacgtggcacagccgggagacatcacctattagttcggtaagttttctggaaagtgtgtttggagtttagggaatatgtgtgctcgttaattgtcctttgtctgatatgtgatatctgctctattattcatttggtaagggcaaatattgatttcatttaagatagtacaattttgaagaaaaaaagttattactggataattataacaaattttaaattaagtaaaaaacaattattaaataattactataagtaagattgagatgtttggttatggatattgacattaacaagtcaacatacagaatcagtttttttatgtaagcagatatatttttaaattttaattaattccattttagaactatttaaaaatgtatacttatttgccaaccactttaagaaacttttagtataaatttctgctacaaatgaaatatagttctaaatgaaaatttttataagccaaggatggagtccactgaaataatttcctctagagtgtcttttaactgaagaaattgcatcatgctgcaaccaataacttgtgtctataggaaagaaagcaagttgtttatttttaaaaaatttaataggcctttttcgagcagttttaagtttacagaaaaattgaggagaaagtacagaattcccatacacttccttactccacccctttccacctgtttaccttgttattaacatcttgcattagtgtggtccatttgttacaactgatgagccaatattgatgtattattattattgactaaagtccatagtgtacattagggtacattcttcatgttatacattctgtggtttttaacacatttataatgtcatgcgtccaccattacagtatcacacagaatagtttcactgatctaaaaatccctggcaccacttattcatccctctctcctttcttccccactaagtccctgacagccactgatcatttagtttctatagtttttccttttccagaatgtcacatggttagaatcatacagtttatagcttgttcagatttgcttctttcacttagcaatatgcatttaaggttcttccctgtctttttgtggtttgataatgcttttatgtttgtttttatcactgaataatatttttgtctggatatgcccagtttgttcatcaattccttaggattttaaaatatttttaggttgatattataaatgaaaatatttttcaataatgatttctaagttactctgccagttgttcctattctcttttattttattttttaattgacacaataattgtacatatttatgcagtgcatagtgatgtgtcagtacctataatgtatagtgatcacatcagggtaattagcatatccatcatctcaaacatttatcatttctttgtattgggaacattcaatgtcctccttctagcttttggaaactatatattattaactatagtcatcctataatgctatagaacaccagaacttattcctcctgtatagctgtaattgtatattctttaacaaatctctccctaccctttccttctccctaccttcccagcctctattatcctctattttactttgtactactacaacatcaacgtttttttagcttccacatgtgagtgagaacatgcagtgtttaactttcatgcgggaactaacatgttcctggcttatttcacttaacataatgttctgcagttctatccatgttacctctaatgacaagacttcattctttttatagctgaatgcattacattctgtatatattactttttaaactcattcatgttttaacagcatcctgtaacgtggcaaccatctaaagagggggaccgattaattggacgtgttattcttaacaagagaacaaccatgcccaaagactcaggtgcattgctgggtctgaaagtaagtatgctggtttaaaatgtttcttaaagggtgaattacagtatggtctgcattcatcggagtttctggcaatgatttttaaatgtcatttaaatattttatataattttattgatatagcatatagatatgttaggaaaattgaataaaatttagggaaactaatgtattctgactataaagttcaggatgattttttgcattaaaaagatttaaatggaaagtagcataggtaatgtggacttttgttgtaacttaagcagcaacataaacatcattaaagggatcactttctaattacaatagttttgtaagaattttttaaaaattaatgtacttaatagtgctgtcttattgattattaccattaattactcctgctatgaaataattctgattacctccactaatgggtatgccactaagaattgtggatgaatctcaacttttggtgatattctcttcattttaaattatatatatttgagcccctgcattggaagaacttaaacatagattttaaaatattctataataaaactcagactttgatagtcttatgggcatagatacatgtttcagatgagatggtcagctgcagagatgcatttaggctattaagctttgcacaatggtaaattgcttcccaaaggtgtcattttcttgctttgaatctacagtctttatagtcatagacctacattttactacacatatacaaaagagattaagatctgatcaagaactgatcttgacaatgggatattatcttcatgtagaaataataattcaactggtacacatgaatttggatgataaagaaaaatgaattttaatgtaaacagtgtcaaacacttgctgtttgatactaagtagggaagacctggcacctgtcttctatgtatatgcattatttatggtgcccttttattgttaggtcactttaagacagggctatttaatcttttagcttccctgagcaacattggaagaagaaaaattgtcttgggtcacacttaaagtacatcaacactaacaatagctgatgagctaaaaaaaaaaaaaaaaaagcaatgttttaaggaagttaacaaatttctattgggccacattcaaagtcatcctgggccacttgtggcccactgacagcgggttggacaagcttgcttttaagaaatcactacagcctgggtgcagtggctcatgcctttaatctcaacactttggaaggcaaaggtgagagggtcacttgagcccaggagttaggaaccagcctggtcaacatagcgagaccccttctctacaaaattaaaattaaaaaattatctgactgtagtgtctgcacatgcctgtagtcccagctatttgggagcctgaggtgggagcaacacttgagcctgggagttcacggctgcagccatctatgatcacatcaacacactcctctgtgggtgacagagtgaggccttgtctcaaaaatagaaagagagagagagagaaaaaaaaaaggaaggaaggaagggagggagggaggaagggaaagaaagaaaagagaaagaaagaaatcagtacacaaacttccttaggacacatagtcatctcaaatatgagatgttttgttttcaaaactgtgctcccagctactttaatcaaaaatgtaggtgaagccctggtggctcacacctgtaatctcaacactttgggaggccgaggcaggaggactgcttgagcccgggagttcaagatcagtctgggcaacatggcaagaccttgtctctacaaataattttaaaaattagctgggcgtggtggtgtatgcctgtggtctaggctacttggtaggccaaagttaaaggatcacttgagcctgggaggtcgaggctgcagtgagctgtgatcatgccactgcattccatcctgggtgacagagcaagatcccatctcaaaaaaaaaaaaaaagtgcttcacttcattaatgtttctacatgcaatttcaagtgtatcataaaagaatgtaggattaattcctcaaactaataagcttatgttttagtatgagtcttggaaacttataaatttgtaattatccaggttgttggaggaaaaatgactgacttaggacgacttggtgctttcatcaccaaagtaaagaagggtagcctagcagatgtagttggacacctaagagcaggtaaagtttctttttttaatatttaaacagtgtgttctccatgcatgaacatgaattggtggttttcaatttggggttagttttatatatacatacatacatacatgtatgtatgtatatatcaattaagtcactaaattttaatgcacgaataaagacttatttcctgatataaatatttaccaattgcaataataagtaactctacatcagcagcaatctggagagtaagggtaggaatcttctttttataaaaataaatagatgtaaaatatagaagaattactcatctttgtagatgatgtcataatgctacaaaacttgaaatctaaaacaatttatctttgagaaaaaaatcttatatcactatttagttatttagtttatattttaagctacagtaattaccaaatttttttcagagtggtcctaaaacacttattcaggggcagtgttttttataaagcataatcataatcacatttcttatacagattgtataataaaatattagtaaatttaaaagtgactcatgtagatgtgctaattcttggtatttagaaatttatttttgttgccctataactgaacatgacacaatgaaattatttaatatatgtaaatgtatcatatattaaatagtaacacattttaaaatccatttttggtaaattgtttgcttttcatttttgttaaaatcacattaaaatatttcttccagttgacttgactgcagagcttagtagaaatcttttggttagatggctgtttatgtatttgccagacaactataaaggaaacagagttggctgagctgtagaattaaagattaataacccataacacaaagagtacatttccaggtgatattcttaacttttaaaccttaagtttgtgattcttgaaaactttggcaaaatattctaggactcttaaagacttttcagtatatttgtttaccaggatatcagttcaaaatcattttcattttttttttaatttgacaaggacttgctgtgcaggtgtataggaagaaaactctaatcggatttttctccatttgctatacaactttgaatatgtatagagatatgttacactgttatttcttatgaaggaccagttatgattcagtaggaaaataactcaatcagggttgactctgtcagtaaactgagtgtgtgtttgtctaatgactcaaaaataagcctcagaaagtctgagaatcccttgttggctaatgtaaaataactttaactacagaaacctgagtttgcagaccacattataaacattatatacacattataaacacattattatgttttaataggaagttacttaggaagtaaaagaagaggggtgttctatataaaatatctgttagtgattcatttcatttaacacccttatgagccaagagcctgagaaacttaaatctgaaatgttaaaagctcaacttaaagaactataaaacagacaagtgtacttttcattctaagcaatttatgtattcgaagaaagtgaagtgattttgcagactcaatcatatatcctatttgatttacattataatttaggaactgactaaatatttgcatttatgcaaatagaattatttgcatataaacatccttagcctataaaactacggtgcaatcaatgtgacttttatttaacatttgcaatcttgttttaatcttgcaatatctttatccagtcctgccccgctttaagtctgtgcactctactgctacttcatttaaccttctaaaacacaaaaatgacactgacactctgtttattatgaagatccttcggtgtttcctagttatcatttgttcaagtcaaagctctgtagccttgtcctctactaacactttcagctgtccaggatgttggtccacctgtaggttcctgtcaggctgtttcccacctagaagatgtggtcaatgcctcttgtctacctagttttctaccactcctgttgaaggcctttccatccttcacaattcatctgaagttgccttaattctgaagtggttcctaatatctcacctggaacaataactaactactatgtccctggcaccacttgactctatttctggtcctcaaatgaacttctattgttgcatataaaatattttattagagttgtttctttatcatttcttcatgaccaaatttaaagacagataaaatgtcattttcatctttgtaccctcattgtctacatccctgcttgattatccatacataaataatgtaaaaaaagcattatggtttaggaattattaatctgtaaataaacgtatgtattaacttaatttgatattaaaagttatgcgtccaggttgccgcttataaaaaggagagttttaaaatgcagtgcttttgcaaactgctggttgcagctcattattgggtagtaaaatcaatttaatcgtttgcatctaccactttaaaaaattgaagtagaacataatagaatagaaaaatcagggtaagtattgtttcataaatgttttttagtgtatatatatatgtatgtactcatataatatgaatatatatacacacgcacatatatacatgttcatattatatgtgtacaggatcatgatgtcaactttgtttcttggtcaaaatattttgaaagcactcttaatatattataaatttgtaattattatatttcttttttcttttttttttttttttttttttacagtgaagtatattcattgcctatttgaaaagcttttctaggtaacagcttagggcagtctattagaattggtggccgggcacggtgactcacacctgtaatcccagcactttgggaggctgaggtgggtgcatcacctgagtttaggagttcaggagacctggccagcctggccaacatggtgaaaccccgtctctactaaaaatacaaaaattagctgggcgtggtggtgcatgcttgtaatcctagctactcaggaggctgaggcaggaggatcgcttgaacctgggaggcggaggttgcagtgagccgagattgcgccactgcactctagcctgggcaacaggagtgaaactccatctcaaaaaaaagaattggtgattaccatagtattttaccaaaccaaagcagcatcatgtactttttgcatatttactttttactcttcagtgagcaaacaattggaaaaaataattactttaaagtaatactagcaaagcaattttcctacttttatttaaaaaattctaggtatacattgaaaagattttatgcttatacttggctataaaatgtatactgatgatattgatccagtatttcaacacaaatttactttgctcataaaatgttctagacactgagaacaacaaaataagcatgagcatcaacaaattaagacacctcagtgcatcgaggttgaaatatttcagctgagactaccattttgaagtgaagagtctaaggcagagaaccgtttggtacctacaacttcttaaatatttatgaaaataaatactttttttcacgtgacctatggtgtgaaaaccctagttaaaataacaactgtaagttgttagcctgtatttttttaatgcaacatcttttaactccccttgattaatcttagaatatttaacaactatgtactgtattaatgtttggttattttaaagtgtgttctaattgtactttaatgttcacaatatagattatgtatagtacatatgtgttttgaacatctggaagtgggttgactgtcatgcaacagttttacatctgcttgctttgtaattttgccatagctacctgcgttaactgatgggtgtgaattcaaatcctttcatgcatttttattctgttgtgcatctggtgaagacactgaagcatgacttgtaattgggaaattcatgctaacaaatattaattgctctttcttccaaaaataaaacaggatttatgcacagtttaataagaatctttcaaaaatagagccgcctacatttattatatggagggcatgctgctaattattattttttaatgtttccaaataggctgtgctaattccatcccatagcatgagattatttttatatgatttctggtatatctcaaaagataaaggtagttttgtattgtactgtttccagtcaccagtaatattctgggggaaaaaaagaaaaacaaaagaaaagaaaaagtgtttagaagaaccatttagctgacattatatggcaatcaatttgcttttgaaagcagagcctagacaattaaactatttgtatatgttttgcatttctttgttaaaaaagagaaaagatacgaaaaataaacagaatatataaggtaaaaaaatacccttttttttaaattcaaggggatgaagttctagaatggaatggtaaacccctgccgggagctacaaatgaagaagtttacaacattattttagaatcaaaatcagaacctcaagttgaaattattgtttcaaggcctattgggtaaggctaaaaaaacttacttcttaagtttagtaaattacatgtattagtagggttttaaaaagaattttatacattcatacagtacatgttaacatggatagtttttgcatcaattatgggcatacatttttagattactaaaaatttcttaattttttaactggaatactgagtttacttcactacattttagaagctccacactttaacaattgtaatatcaaaaaatatcaatatgtactttttgcaagtgaaatataaagtaaaatattttcttttaatggcagatatatttaagtaattctaatttaataagtagtatttcctttaagagaggcactaacaaactcctcttcttgtgatatttaaaatattaatgatttcatatgtctacatgaactttttattattctacgaaagaataaaatattttttctgtctctttaaccatgagtaatttcaacttttatttaaaatcaagcaagaagtattaaatattttaacattttaattggtcataatgatatttttaaaacctcaattttcagtacaatttaattatctatagccagtgggatattttctatgtatgtatatagatttccccatatcgttgcctttttctggcaaacccacatggtccaaaataaatattcattttgccagtctataatttttaagggcattttgaactgttttattatacttggcttaatgtttgaatgtgttcttggaaatgattctttttttccctattctccaaaatttaatacagccattatttcaaggctttttatgttgaaaaaatgctaacctttaatttgtatcggcctcatgaatatatgtcaatgcaaaacatacaagaagatataattatcataattctcaaagaatgaaaatgtatgatcatatatcaaataatattaatatataaaactctaaaataaaggcaagcttttaaccaattttaactggttattattaagagtgaacactgaagacatttgcaaaagtgttgtacatttccatgtagatttttaaaataacaatactacaatttatgctagttttacatgacatatgttctagtgctgaggtaaatataaggctggaaaagaggtaagtaaattggaaaatgaatcaaaagtatgaaagctaaagtttagaatcaagcattgtgcacttgccaaatactttcaaatatatagtggtttaaaagtaaacagcaaaaacagaattgattcatggtgacttaaaaaagtaacagacaattaaagtagactggaataacattatttttactttttatgaaaattaattaagaagtaatcatctgcacagccaaattctaaactattatagattatagaattgaaaggaacatggaatacaaaaattataatttaaagattatagaattcaaaggacatggaatacaaagattataattgaatcagaatcaaaggtagtatcaactttctttctagtgaatacattattggaatcctagaaaaataattttagctgctttttttttttttaaagacatggtcttgttctgttacccaggctggaaagctatgttttaataataatatttaatgtagtcctgtttaacaactataattaaaggaaaaagaaaatatttattcataatgtagtggcatagtgatttcaggaatcattctaaatataacttacaagcacattgatcagtacacactaagaggcatcagccatcttgaggtattgactttttttgtgaacccaccaaatacaatatccttgacctttatgcttttaattgttattaaaactactctactacctaactggtaaatagaactaataaagaattccactggatatgtaaacatccagtggaaatttatgcctgaaaatattgctgaagcaattaacataaataaattttaactaaaagtcactttaacatattttcaacaactttgccaccattcttttttcacaggcatgtaaattccaaagtttgtacctggctttagaacttcaaattctgatttcataatggactatgaggctgattttttaagaagtcatactatctaaaaattgttcctggatttttttacaatttaattttatttgcttgcattaatttagaagaaagtagcagaatatatagttttttctgtgttttgggtattgtaaattagtcttttaattcattcaaatgattttatataaatgtatagtcatacaaaaatatataataaaatttataaaatacacagcataggccagattgtcatttttaggaagtataaattatagttggttatgagaattactttgcacaaaatagtcaaaatgacaactgcagagaacaaacagggaaaactctttttgttttcattccccccaaaagtgaaaagaaaaagtgaagtcagctcataaggtaggtggttagaaattcttaaaaaatatgcttataattttgttgggactagctaactccagtctgctttaatatgtcatgttaatatttgcatattgttaatcttaaattgatattaaaacgtctttggaaaatgagaagtaaaatagtcctatgcagtataatacctaaaccaaggtgatctagggttcttaaggtcatagtgggtaatggattaagttgagattatagtacatatatttcttcagagtaatttgtcagtgtggcaggaatgggtggtctcacaagtcactttctaaccatatggtaaatagtcatatatttagctaacttcagtatagagatatgaatctctataaagggtatatatgtgtatatatattatatattcacatatataaaataatttggcttttttgttgcaagcttgaaccatttttactttccaaagcaactcatccttttcatttaactttgcccatgatattcaccacatcattttattattgagatgttcccatccctttcacttggtaaactctttcagatgtgtttgtaaagcatattactgatgtgtaaaatttgtgtcattttgatttcctataattgaaggaaagtattacctttaacattttttatttccaaaacctgctgttttggtagtaaaaatattgtggtgattttaaccacaatattagtctgattgttgtcatgttaaagttttgctcttaaatatgtaaaaacttttttattgcagttttttttgtgtggtgtttgacattcatgcacattagtagttgccttaatagtaactcctattcatttccacacctgtaaagacccagcaggatttttcacatcacgtataatgggctatgattgcctcaggcagggtcatttaactaatgggattttcaccatatcctgtttcttttagtgacattccccggattcctgagagctcccaccctccactggagtccagtgagtataaggtttctttgttattataaaagtattgaactaattgaaagtaaagatttctaattttctttagttatttgatataatgaattggggttactatactaaagatgtctccattggtactagatgttggcaatgatggcaataactggaaatccaaagaagtcctacttcaggatttttcttcctctacttttttatgtgattaaaaaaaaaatctttactgggaatactcttcagcatcataacagtcaggacccttacagagcttaatatatcaggaatagttctagttacattaacatttattgtgatactggattattcagtttgattgctaagcagctcagtctcaagagcagcctagtgaagaaactaggtagacactttaacaaataattgtattactgaataacaaagtgtgtggattgattttggaagtgaatgggtggagtaaacttcattaaacataataggtcaagagattgtgaaaccagagggttgaaagaattatctatatgggaatttaagtcgtttctgtatgacagaagatgatattgtgtgcaataaaatatagacaattaagttttcaatgataatgcagaagtgacccaaatatttactttgcaatggatgggaattaagttaatacttgggcttgattccccaggtgttcttacagaacccaagttaaagaaatagaaaataaaaggtgatttaggggaaaaccagtgatagtgattagaagggagaagaaaatatgaaagtaggataaacaaggaaacagacactaggttatcatataaaatgcataccatcatgttctgctagaggtggacccagttttggctttgagctttctggtgaccaatacaaagagggaagtgggactaattgcataatttatattattgatatgattaaaaaatacactgattgccataatattacaaacaagcattattagaaataacagtgttcctgttctgagacttaaggaaaatgtattttaaatatacctgggaaaagacacatagtaacaattttatatagctgttttttatcactaaatgttttcggagggcacaaaaggatgacatgagaattaatttgtacttatagaaaaaaatgtgcggattgcacatactcaggcaatgcttcataaacagtatttctcaatgaagcattggctaagtttgaatggtggtgagttcaaggttgtacttgctggatcaatagccttctataaacactctgtattgctctctgtgtcagggtatacttggaacagtgaagaactccaccaagtggctgagaggagacccagcctcctccatgtgaagttgaaacaaatcactagtggtgaattacttgaagcagcattttcagaggttcaggatactcatttataagatcaaaactaagatagatggggaggccgaggtgggcggatcacctgaggtcaggagttcgagaccagcctcaacatggagaaaccccgtctctactaaaaatacaaaattagccggacgtgttggtgcatgcctgtaatcccagctactcaggaggctgaggcagaagaattgcttgaacctgcgaggtggaggttgcggtgagccaagatcatgccattgcactccagcctgggcaacaagagcgaaactctgtctcaaaaaaaaaaaaaaaaaaaacctaagatagatggtatatctgattttaaaacagtggcaaagtcttggcttagatgtggcttataaattatattatgtatgcattcattttaatttctcagtaaggacagtttataatagatgatccattagccaagataattagtgttaacaggcactatcttccttatctctgaagcagacctttacccatatgtgaagtcatgcaagagcctgtgcaataccatgcactccagaaatgtagatcaattctttccagttgaaataagcataatacttcgttatatcattcttaatattttttaaatagacaactaaagacaatctatcccattaaaagtaggttctgttatcagtgatagtaattatggttttatacaaataaaggatgcatttaacattttattaaaaatatttcctacacttacaaatattacttacttttttttctcattttaggttcaagttcctttgaatctcagaagatggaaaggccttccatttctgttatttctccaacaagtcctggagctctaaaagatgccccacaagtcttaccagggcaactttctgtatgtattttttgtacatgttggaggctgttagtatttgcatacactgtctgagtctgtctttaaatatgttcgcctttccttgaagcctgcaataaatacatagtcatttaacaccataatctacttcattagtttttcatgcattttttattattcctttattcacatatttattcagaaatacttactgagtgcttgcagtgtgccagatactctgaacattaattgatgaatggtaacataagtaaataaagagttcatattttttgtgtgctatgtaaaagtttctaaggtaaataattgtttacacataatattaggagttcataccccatttatgtaataaccttatgagcctagagcctgaagagcctaaatttggaatattctttttaacttcctaaggcatttggcaaaactcttcgttgccactgaaagctctctgaaaaagctaccattttctcactattgccttattatgtgatctggggaaacctggagtgaagaaactagggttaaggataatgaagaaccatatatttgtagattatgatggaaaatgtgatgttgatattataatttaaggacttcaaactatttgtttcaaattgttacacaaataatgaccttttgctcctctgataatgtgtggatttctgtggtttgcctttgtggttttctcttgattttaatgagacagagaagatatatgtaagcttattgctcaagggcttttatggttttaacttttatttttagtatattgaatatctttgtaataccctttgggtttatctgccggccatctttttcttcagtgtatgtgtaaatctctcatattctccacatattttgaaagaggatggaaacccattctggttctgtgaaaccccatcttaggtatcaattgggaatcagagaaatggatttacacagatccaggtttgaattcttaatctgttccttaccatgaaaagctaatcctatgttaaattagtttattttgttttaatgactctcaaatatgttctaacatatacctattaacagcatatgcttacttaaacataaaatgaaaagtaacttctaaattaaaggaaaaaaattaaagttaacattgttaaagtgtcatcaccactgccagggcagatactgtaataatgactgataaaattccaattcttgtgagtttgacaataggattttagtacgttacttccccattattctttggtctactgtcatgaaatcttggttaatagaaatatcatttggccttcttgtagtttgaagatgtcatttgtgtattgtatccttagttttttcctccttctctcatgaaaaataacctgtaatagtttaattctaaaaattaaatgacggcttggtgcagtggctcacacctttaatcccagcactttgagagactgaagagttcaagactagcctggcaacatagcaagacccccgattccacaaaaaatttaaaaaactggccagacatgatgatgtacacctgtggttccatctacctgggaggctgaactgggagaattgttggttccagcagtttgaggctgcagtgagctatgatcatgccactgcattccagcctgtgacagagtgagaccatgtctctaaaaaataaaaaaataagtgagaaaaaataccaggaaatactaaacggtgcctgtataaaataggcccacagtaaatatgttttatgatctcttctaattctttgtatttcttattcctaatatccaaactcttgttttttttaattttaactacctgtgacaccagagaaagcatttagtcacgctataataatttagacacatataatcttcaaactcttatttttaacatttaagaacaataataatgattttatgtctccctcttcccttagttttttggaaaaattattattagttttattttataaaatgatatgtgagaatatacagtaacactgaaggcctgccagttgtaggttatgtttaaagtactcaaagagaaaagtaaagttctgtgtgtttatgctttcaaattggtgtgtttttagaaatatctgtaattgcattatattgtaattcaaaatttcctcatttaaatataacttgaattttgttttatgtaaaattgtaatgcctcatgatttttacaaataattcctttcctcattgctcctaggtgaagttgtggtatgataaagtgggacaccagctgattgtaaatgttctgcaagcaacagatctacctgctagagtagatggacgtcctcgaaatccctatgtaaaaatgtattttcttccagatagaaggtagtgaataattttagaaaaaaaaaatcttaaaatctgtactaatagaaaaggtagaattttctcttttgggatgtttttaaaaaatataatagataattctgaggagataaaagtacattatctctgaaaaaagaagtccctcaagtgttggaaattgtgttggaaatatttgaaaataatctgtcaattaaaaaaatctattaccttgtttataggtatattagtctttgatagcgacacatcatttagaatgtacctttgtatgtgtccctataattacaatactgcttatattgtaactgaagttagaatattattaaactctattatctttttatagactttccatgagttattagttaaaataatataaatatcaatggcagttttacatgtaactacagtagatggcagcatgtacttgctttttcatttacaaaacatacttatttttcagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagaggtgatgtatattttaaaaactcaagtcaaatagttaataaagttttgtgatatttattatgattactattacattatgttttgataaaggtacttgatttaatttgagaattaccctctcagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagtaggttaaggtccttttagttgccacaaagtaattatgctgtaatgatctaattagtgattaataattcaagatgttttttttaaatgttttattagagatcaaaatactggaaaattgttcatctttatgaagcaacttggcaaaactgtttctacattttcacaatgaaaataatgtagatagcatagcagagtaattgcagagctgcaagccaaaaacctctgaattaaaattcttgcacagggccaattgagctgttggttattgactgatggaataatttctgtcatcactggtgagttgccacctgtgaagtcttaataactttatagttcaaagattttttctccccccaccgagagagagtctcactctgttgcccaggctggagtgcattggcgtgatctcggctcactgcaacctgcacctcccgggtttaagcaattctcctgcctcagccactggagtagctaggattacagaagtgcgccaccatgcctggctaatttatttttgtatatttagtagagatggggtttcaccattttggccagcctgatcttgaactcctgaccttgtgatccatccggctcggcctcccaaagtgctgggattacaggtgtgagccaccatgcccagccagttcatagatattttaatagttattcataagaaatgttgtttaaaatattagaaggtatgtttattgctattcatctagtgattgggaaaagctatttttttctgtacttattgagtaatttttgtgtcataactacatttctaagttaacagctgaaagaagcctcattttggtaatctggaactaaattatttttctcacataattaaatatttcatgttgatgcttccctgatcagtaatttcctcaaagttaatgtttaatgaagtataatgactaatttggggagctaaacataaatattttataaagggccctgatgttttttcattaatataggctgaatagagctccagccaagaaatgtctctgaacctttccactcagccctattctctctgaactgcagaggaaagcacttaattgtgtagaaaacaatgtactgtatatactgtgctgaaggcttttagtataatattttaattaaagaattaatctgaaaatcttattctgtgaagtccccttgtttctatatgtctttggtgtaatgaggaaaaaaatactgataaaatgttatccttagagaacaaacatttcttttaaaattagctcagtgtttactgtattagtcttcataagttttcagtaataatgcaattcactttttaaaaaaagtttgacagtgctctttacgtttcataaaccaaccagacacagaagtatctctttgccttactgttgtgcaggatctcagcgaatcagtgatagtgacatctcagattatgaggttgatgatggtattggcgtagttcctccaggtgcgtgggtgaggagcatgaccctgcttcactgtgctgctttgcttgttttctctgtcagcttccggacctctttaggatactaaactgaagatttatagcacagagaaatcagtattatattattccatggtgacttacatttcaaattattaagaaagttttaaatggactagtctctactaattagcattcccatagtgaggttcttccgtagaaacatgtctaactagtgaaacaaatcattatttcacaatgctctgagcgtaagtgaaaatacgaattttattttgaaaagatggggttattaaataaaaattccatttttctgtgttttatatttgcatttctatgattttccttccaccatttctgaaaataatgtagccctccatggaatatactgagaaaggtgcatggcggggtttaaaattgcatgtggcatggctgtaacttttaaagcttttgtgatgtgttcccactgattatacctagaatgtgtgtatatgttttaatacaataatatgtttaagaaagattaagtattaatttgaagtgaacatctctttgtcattgtgtaagttagtaaaacttttgtgatgttgtagggtttaaatgtttctcatctgacttctgtcagaaaagtgtaaaatcaagtggtaaagacttactttcttggcactaattctatactttttaaaaatttactaatgagaggagaagtaaatatgcaaataagaagaaatgaaagagacagtcttaaaatgtataaatatgaattttaaaggcagtttttaaagacagtatatatatatatgcccttgatatatatgccctttatttacataatttctcagatggcagtgtacttaatttgagggcaatggttttgctcaaattggtagattctacgatactaacttcacagtttggagagatgcatacaactattaaaactgggagaaaattatggagagttctctaaaatcaggtttcatttgttccctataattcagagaatatatggtatttatttatttatttatttatttgagacggagtctcactctgctgctaggctggagtacagtggcacaatctcagctcactgcaccctccacctcccaggttcgagtgattctcctgcctcagcctcctgagtagctgggactacaggtgtgcaccaccatgtacagctaatttttatatttttagtagagactggatttcaccgtgttggccaggatggtcttgttctcttgacctcatgatccgcccacctcggcctcccaaagtgctgggattacaggtgtgagccaccatgcctggccaaaaatgtagtatttaatcactgtgtgaaagtagaaaatattgttaaatttattattataaatctagtgctgtgaaaatctatatacttatatattaacctttgatgtcagtgtatcagtgagagatttagatcatactggagagaaattcacttttgctctctgtttttatttcttagaaggccatagtaattacacacattctcaacagaaaggttcacacaaaatgtaacatcatattagtttgtcatgaaattcaaagagtaaagtgattataaatttaaattcatttgggatattcaaataggaattagattatacctggtagaaaaatcatcacctctaacaggaatcttaactattagtcagccttaatgttgtcattaccaatttatctaaatagaatttgcttcggtgagtggttcccaaatttcattcacctgaaatttcatatttttagttatgagacagggaagtaaatgatgaataaataaatggccaattaaataaatgcttgcacaaatgatgagtttcttcctctttctctgagagagcaacatggataacgccttgtgagaagtcaaagtgagttatggaatccactagagatgggattagtgcttgagtaccaccaaggagcactgaattctaaatatacttatattccatactgaaatataccatgtccctcaaagtgtttgcaaacatgcataatctctgttatcatacaaagcaatatttttcaaataatattgttcatttttatttagcatttaaaaatgtaatgagtcaaactttaatagaatatgactagtaacttataaaactgataagtaatattttatgtttcaaagatctcctcataaattaaaggagagcatgtaattcattaatattttcagatatactcttcattgatccattgtaattatgtggtagtatttgtatggcaaatataactagtcacatagtaacatgcaatacattttaaatgaagaggaaaaatgagtcagtaaaataagggcaagaagctaaaataaagtgaggtgataagttagcacagtgcattcttatgtacttttagatgttggttacaaatttgcgtctacgtttcctagcatccaatatgaagaaaaaatttgtttagatatggaagtcgtcttctatatatgtttaatgtactcaaggaagttcctggttgtttattatctagagaagctcaaaagctctgtacaaaatgttctactacagccaaaacttaaacttcctaatgccttggcttttctagaacacgaaattctctgtttttatttgatgtgtttactatctttttccagttagggaaatgtagcaggttttcagcagttgagactgccagagccacattttattaactttgtagttatagccttattgttatttaaagtaaataattttagctagttaagaagaataaaaataaccatatacagaatgccctcatctgaggtgaggaatctagcaacttcaaccagaaaatgagaaaaaaattctctaatctctaaccctgagtcaactaaaacactgggattaccataaaatagtttcatcccagccgggcacggtggctcacgcctgtaatcccagcactttgggaggccaaggtgggcagatcacaaagtcaggagttcgagaccagcctgcccaatgtggtgaaatttcatctctactaaaagtacaaaaattagctgggcctggtggcgcacgcctgtaatcctatctattcaggaggctgaggcaggagaatcacttcaacacgagaggcagaggttgcagtgagccaaggtcatccagcctgggtgacagagcgagactccatctgaaaaaaaaaaaaaaaaaaaaaatttaatcccagtcatggttctgaagatagagtgcatgttgtcaacaataacgtaaacataatgtgaagaaaatcaaattttttgtaaaaagcaactataaatgtaaaaagcaaagaactttttctttgtaaaatgcaaagaactataaatgtatatttatttaaggtcattcactatagagtcaaatgttaaaactttgaatattatagcatatgttatattcaaaatgactttgagtcaccaaaatagtacacattgccgtcagtatactttttgaattcagaactttctaagttacattaaaagttgttaatatgttaaaagtttcaagatttcacttgtttccttaaagtcccttcttaaaaggataaaagaggcattaatttctatataaccacaaagaatccaggaaacaattatataccttttacagcaagatgccaaaattctctaaaatttattctgtaataattaattatacaaaatctatttatataccttgaatactcacttaaatctcgaaatagggctcataagtcaatattggccttccataattattgtgtaattgataccagatagcaattaaaaatgtttaagtaattcagactatggattaattgtctttataaatagtcacccttttttttttacaatgagctatgtattaatagtgtattcactacatgttaacttagttggtctctttctagccttaatattataatttctagtcttaaaattacaatataatattacatctgaataacagactttttatacaaaactcaatagcttagttgatattttgataagaaaaaattaaagtatttcaaattataaattataccatttatgaatattaaacatgtttttatagagtgacaaaatgtttgtatttctttagtctgaatattgtcaaagtacacttaatgaaatgtttgaagtcccttaaaattcggcataagatcatggattcacaatatataaactgctagggactattagcctgcctttaatcatgatgtttcataacatatttttgagataatgtgagagttgtcaagtaaaaaatgaacaacagttttagcttcccagttaaatttaacatatttatggtttatgtatgttttatgtagttgtaaatatagtttttttttttactttggccacataatttttttattttccttatgataataaaaaacagttacccttgtgaaaaaattttaaactctaaactcttcttttggttttgagattactgtcttatcttaactaaatcgcagacaatataaacctttttacttcagggaaaaagtgactgttataatttattttaaattgcaatatgttaactatattatcttagttatgctaattaaaataattatggagtagtttcagatgtgtaaggcagatttggcgattggttcttcagaagggtgcattttctctacattattgtgatagtcatcttcagtcatatactacatttgaaaattgcagtattatttgtggtttgcaaaattcacaatgagtataatggtgaagatctgctactcttctttgttaattaaaactggaacaatatatttgttttcttattaaagaggccacctgcaatccaactaaaataatttattctctagaataaaaatcgaaatgaagaatttatttaaatttaaagagactccaaacttctaagcattgacttgtatattaactatagtttcatgtcaagcacttcatttgtgttgctaagtcacgaactcgttcattatttaaattgaaacagtatcccaactcatcgtaatgtctgaggcatcaactgtcatattcatattattatctccatggttcctttgagcaaaactgtaacctgtttcaatgcatgtatatgttacactctgtgtaggtatacttaatatttttgaagataaggctattaataccgattgcatgacatttattcttcatagatcaatggctgctttagaataattttatattcctgtgttaatgtttgcattatagaagaatactgactaaattttttctgtgtgtacttttgccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggtaggctttgaaatgggctcagtgtccctgacagtacatttttattataatgcagtgtaaattgctgcaaaactaactgaaatgaaaaaatagtttggtcaaattatttttttcagaattaattgtaggcaaaattttttttattctttatccaacctatgtggcagtctgttgtttaatctgaagaaatttcccagggagcagaagttgtttatgtcccaggaatagtttttgaataattgtcttgtattctctttgctagttttctttcttgttagaaaaaaatggtaacaaatcagaattgtggagagaagtggcgaagaggataaggttaagagacagaatggactttgaagagatttaggattgtctctttgaagcactttaaatgcttggaaacataaataaaacatatagtgctctacttcattttactctgatatacactcctgaaattgtaattaattatgccgataaaaattgattttgatagaagtatgaaagaaggttggagaaatgcagccacaggcaaaaactcatagaaaacaaatacccttaactcattgataagtaggttttgattatgatgcaaatacttttcagtgtttatttgcatattactctcagttccttcactttagtctgtctgcctgttttgggaagatgatacaatttgacacataagaattttgtaatcattttaggagtttagatgaaattcatccaacaagaaggtcacgttctccaaccagacaccatgatgcctcccgaagtccagttgatcatagaaccagagatgtggatagtcagtatttatcagaacaagacaggtatttgtcaaaattatgatctcaacgttatgaattttttgttctgttttaatatatacagatattgtggcatagcacattagagagtaaaagtatttatcactcaaaaatgagctgctctcaagcaacaactgttaacatattgtaatagaaatgtaactctaggaaatatttggctaatattatattgttataattatccaatttcttttacaaaatcagaatttatgcttagacagctttaaaggtacagcttgttgacttagatattgacctaaattatagaagggagtctgcataaggagttttcaaatattttatttattgtgggtcacaatatttgaggtatgaagtaatcataaaaattatgttatttatataatttaaaacattgtggatacatgccatttgaaagttaattgcagagtttctatgagaacttcaataataatgtttctgttatatacttcttttcataaaatctctttctagaaaatgtctatagaatacaattattgagatgggttcttatggggatatgtgcttagatttaattctgcatttgtgaactaatatttcacggaaataattactataagtctacattatgaatctgttgctctgcgtgcccacagactttcttcttgaagtaaccatatacctgtacaattagcctgattataagctcaggatctgatttaaggttttataatacccaccttgttgaatattctcttctggctttttaaaatggagaaactttcagtgaggagaagggtcatgatagtggtgctaaataatttttcgccatggagtcaaggacacaaagtagaacttcttaacctacctaattgccatcctactgtggaaagtagcgttgtgaccttcaagaatggagtcacaataggtactaggatgaagagctgctctgaggaataggattccagacatctcagcttgagttgaatgagggctattttatcaacattcatttgggccaccatgaatttaggtgaggagggaaaacacagggctacttgaccagggcagtcaatatagtgaaattaatttggatatagataaagtattaattgtaaaataaaaattctaatcaattatattgttagttggttaataagaaacataatatggtattgcattttcagtggctataaaagccaagaaaactatcacgctttaatttgttataaagttataaaaatgttcagaattcccattagtatcaggccaaatttatagtattaaaaaaatactcagttgtctataattggaaacagagtcctatatcttatttgaggaatatttaattttgttttgttttaatattctataaaatcattttgaaatacaatggcaaatcagcaacagctaggacttcaaccataatatttgtactttattgtttaaattttttaaatgcttttatgtttatttttgtttaacctctcaagcaaatatgctagtgcagacaatctggtttcttcccttttcatgttttcattggcataccattggcataacccatgtctcataatttatctgtttcactcaccacccatcctgtctgtgcagtgagcttcttatgctgcccagagcaaaacgaggacgaagtgcagaatgcctacatactaccaggtaaatacagggatttggtaatggtgactgtgtgtgatgactctctttccattctattattcttccgtctctcccttagtggtattattacaagcaagtcaaataaatttcccaagtatttgaaatttgttttgttttatattgaggttatggaaaaggttccaaatatatttcagttccgattcaggctgactgctttgccatctgtagattcaaaaatccagagactagtgggcctctctgggactgtttgcgttcctaaaactgaggaaccagtttctgcaattaaaattctaaatgctcactgtgagtgcccccaactttcccacacatattcctgtctagtcacaagaggtctaatctgtgtatggcagtgtcattgtttcataattgtaagtttgctctgttttagccttttttaatttccttttagaatttattgttgtttatattctgtttgcttttgataaaatctttaacagttcacttttaatggctgagcttcagcttctttcttgatgaaaagtgaagatattcaacctgatcttaactatcctagcccaccagttgtcagaaatgctgcagtacaaactttcccacaaaggcatataacagtatgaatgcctctttagaagcgacaaaagatataatttttgcttctaaattggagcttagagcctgatgctttatgttaatctcattacatctttaatttcatatccaagtaaaacttcttacagattactcatggaacatattctataaatacttaatgtatatttgaaatgaatatagaagttaaggaagtagtaagtcagtgaaacaaactaacacaaaataatcgaactcaaatattttagccaataaaaagcaagaggaaagagaaagaaagaggtattaccgcagtacttgggatgcaaagacaaatgcatgatttattatgtctgtgtgtaatatgtagttctgcccaataatgcaaacaaaattgggctaataaaaattgtttgaactttttacagtctgaagttatactactcataactactgccatgtttgcttggagtgccacaggaaaaaatcgaggaaatattagttctgcttgctgagaaaaaaatgtaaaatcatgcatattgtaaaaacctactgaaggtcaaagcatgaactatccaggtttattattacttgttcttgacaaacagtttcttaaaataatggtttatttactaattctgaaagttttctcacactcctcttgatgtgactaaagcttcaaaagaaataaaaaacatgcacacaaaacaaacacaaaaaaaatccttatattttaagctacttagtgtgtgcctggcactcagtgtgtgaatatttctaggatactcacaccagtggtctaaatataataactaaaaatatttttctttcccttattttgtacttgtaaaatattatatacttatataatattatataatagttgcatcattttatataatcttatacttaagattggtgctttgctaataattctgagctccacaagtcctatttaatagtctctgtatgttgactttgcatttcctgatttaagcaaataatcatatttgtatgtatacaatttaaaaataaatgagtattcagcgaggcagataacatcctgtggacaggtactacgacaataagatagggagtggaaggaagctgagctagccaaatgtgtcagtgcgaaacatatgtcaccagtgtcttttctccttcctgtctttcattctctaatgtgtaatgctaaaagtatggagatagagacaacatgagttcaaaaatacgtgcatgtatgtatatataatctcttctgtgtttatattcatgtatttataaaaacattaatttatatctgtataaaaatgaatgtcaaaatgtgtacatataaataaccacaactttatatggatatatcaataatatagtttggtttcatataaactatggacacttattatttctataactatccatggctaaaatctaaagctttcaaaatacatcataccatgttcacttaggacttataaaaataaaatctgaggatttactagtctctagtaaacataaggaaaataacatttatttaataacaagcacagtgttaaatatttaatgtactttgtcaatttcctgacaataattatatgttatgaatattattatcctgattttagagatgaggaaaaaagctacgaaagtttattttacgactaatagagtaaggattcaaaatcagatctatttgatatcttctgtttaactagtttttccaaaaatatgaaaacttgtcctatgagatgtttcaccaataagagtttttgtgagtcaaatacattttggaaactttgcaactgaaagtgtctaccttgaaatttaatacacacagcatattaaagtcatgttctaaagaaatctgtatgtttagtttcttttctcccaaattgtttaatttcccaacctttttttagtaaaacgtgtctcgaggaagtggtagtatagagaaaatgctatagttgccttactgtatcctactgtgtcctaaatattgtgtacatgttaccacacacccctgttaagtggaagttatttcccacattttgtggatgtagaaacaggcttggagacttaatcgaattacccaggtcacagccaataagtggcaaagccaaggcaggaacttgaacattcagactataaattttgtgctattttctagctgtttcccattctatgttgatcccattcttgaaaaaaaaatcacttttgaagcaatgcttagaaaagttttatagcaacctattactaaagatatttgcctgaggttaggagttgaaaagaagagtcgactgtctagaaaggaggctaaatccttagtttcagtaaaatttgtcctcaacttgtacttaataaggaggaagctgaagcgggcagatcacttgaggtcaggagtttgagaccagtgtggccaacatggtgaaaccccgtctctactaaaacacacacacacacacacacacacacacacacacacaaattaggtgggcatggtggcaggtgcttgtaatcccagctacttgggaggctgagagaggagatttgcttgaacccaggaggcagaggttgcagtgagccaagatcacaccattgcactccagcctagataacaagagtgagactctgtctcaaaaaagaaaagaaaagaaaatggcattttagttcattttttaattgaagttttaagggatttcctttgatttgatcattaatataaacatgattaaaccagtgaggtgtttgatgtttaggaagcctttgataaatgtttattcccttccctcttgattatgctttactgctagctgagatagatgatggattttcataattagtaattaaatttatagaacattattaaattatcaaaaaaaatatggctggacctagtttgtccttcatggcatagacagtccagaaaccctcacagattttaaaggaatcagatgccgttgggccaattttctgccaattcaaaatccatattctggtttgcatctaatgcctatcttaccctacttccaaaggaaaatttcctgtggttgggtctggatccagacagaagctgataagtagaaagagcttgctcctttgcaatcacttcttggcctttttctgtttcctttttttttgctgcagtctggtactatgaccagctttgtccctggaatgctagtcaacactttgttttgttttagaacattaaaattcttttagtcatattgtaactctaaaattatataaattagttgatttttacttttagctatgagtttactttcgtagaagtaggcataatattaaatcagagattaagtagcacatttacatattgatcaatgataattcatagagtttggttagcaggtatttttctaattcagataattaaataataattttgagtattttatgaagtcaagtgtctatgatttcatattttaataattgtagtcttcccttcaaatagttattgtggttcttttgagaaaaaaatgaccaaagatttatctatatagctttataggcctcctactttctgaatatcttaataaaattggtttcatatatatttttctgtttcctgcgtgtttgtgttgctacgttccagacatcttgttaggcactataaaacattacctcccaagatgcctttattacagagcagttctcactggaatatttacaggtaagagccctaacagtgagtcccacccagttataaagtaattcctaatcccttgcctactaaaaatagaaaattcacattctaataaaatattaaataggaaatttacattctaataaaatattcttttgaaataattatacagtgagagacattaaattaatgatatctaaaatcgttttaactataaaacttagtactagaataattctctgaatgacatctactaactcaaatgtcagaattctagttgctttgtcatttgtatattgttgtacttgttgattttaattataatttattttattttatttttgtgtaattttaatttgtggagctcaattctgcctgcacatactaagaccaaatcagtgactagacaggacatttcccttcatcatgaatgctttaactcaacagtattgagatttactgatgaaatactggttaggtaagaacatttggaagtgatatcttccgtttcccttgtttattgttgtgaaccaaaaaagttgagttgtaaaattatttctcctctgatgtccttcattttgttttggtgtggcatctgttcctggtaatgaaattttaggcattttgttttagtgctttctgtatccagtttttttcataagtaggtgtgatttagtctcatttttcagtctgagacacttttaaaaattatgcaaagcaatttaagcataatctttgtttagcttcattttctaaacaaaattttacactgtcattctgtcaactctctcacacccttatgaactgaatcccagtgattctacattttgtgtaaaggggacattattttatgctttactctctaacatggtcttcctttctttgttttctctgtctttctcttctaccactggatgcaatgcactggcactagtgaactgcagccctttcttgacagggctaggagtgctagtaccaactgcttgagaccagatactagtttgcattcaccagaacgagaaaggtataaaataaagactttcttaatttcttatcatttgtactagtgatttttttcagtcactttgttttgtttcatgacagccttacaggtttattcattcatgtatactttgctaactgtctacatttccccttcccttattatacatgtctatttagagatatgcgtatgtggataaacccaagggtacacatacacatatttctatgaatgttgttgcaaatggcgtggtgtaatttgtaactgcttctggctgctgcttttccccttttgttgctgttcagtcattttattgactattcaggaaaccttcagtatgctgataatgttataaggtccagtgaattatccgaaggggaggatcactttcctcttagtaccactgataaatagtatttataggtttaacaacaatcttctataaactcataacaggaagtatttttaaatagaatacttcctttgtatatctacattcatttttaatcaatctactctttgatataatgttttaccttaaattatactttgacaacaaaaaatgatgttattcataaatttcctgatgcctaacaaaaagaaatacatatatatgtacacagacaattttgcttaaaactttaattaataaattctgatatattcattgatgttgtgttacactatctcctagctgtaagcatctaatttttccactgtgatggaactcttttaatagacttagttataattttaatagacttagttataattgatagtcttgtttataatggctatctctttttaattagaagtcattcagaagacatttgcatactacctctttacaaatcctgaagaaaaatatttagttgtactaatgtaacccgctcctccttcttagtaggctacttaaagcttttctttaggtaactttctaatctgagtctattcatttatttatgagatatttatttctggaattgaacaataggtacacgtgtgtatataccttgttttagtgccttaagaatttacttttaaattgtgtattcttttacatttgtaaactgtgtaatagaaaaaagtgaaatttaatttctgtcttgtatccctttacttttgtaatataaattttagttgaaaggactatagagtctctaaaatcataattggaattgttttatcattctctttagtcaaatataaccccttccccaaataatttcaagagtagcaagaaaattttaaaatatgtttagttattattttcttatatgtttctggttagtagtaaaacaaggatagaaattctcaagttagtggaatcttctgaccatagcagcctgacatttttaatattacccatatcagtgccatctgatagaaacataatgcaagctgatactttaatatttcgtagtagccatactaaaaggattaagttaattttaatttttaaccctgtatattcaaaatataattttcacatgtcattattatacaaactattagatattttgcactcccttttttacagcataataagccatagatactaaagatagtttgtacttgcaccactcccactttggactaaccacattacggtgctcattggcttcatgtggtttgtggctcctgtactggacagtgcaggtctattcttatggtgagcctgtctagcatatgttcccttgtgacactgaagccacagagtttataaatctccatgttggcaaatttaatctgtcagataatacccttaaagcaggtcaaccagcaggcaaataatctagggacagttattgtacagattgttgtaaagtccaagtgggtgtatttaccttgaataaaagaagaaaaaatattgaaaacatatattcactctacatattgaataaaaaggaatttttcatttaaaaactcaatgaaacaagtcttggtattatcagtgatcctaagtttattgggatcactttattgccaagaagaacagcaattattttatgtaatgtaaaataaacaattattttatgtaatgtaaaataaaacttagataaggtttcatcaagtaattacagaagctgtagatgcttattggtttggaggatagagactacaagtaccctttgtgaacacgcctatgaagcagctttgaagcagaagataacaatatcaagagtggtgactttgttatctttggagagtgcatctaaagcccctagacagtatgcggagagtatgagaagggaggcttagagggttttcgaggctacttaatttttctaatttaccgcagggattattgtattaatgcctaatatatacatagtagataaaatgttagagcaaatgttttaaaaacttaattttatattcttaagagatgaacattatttctacaaatttgtcaactatgtatggtcaaacgattttgattaacatttacatgcctttataccaacttaactcctaacctttaacacaagttttctgttaagataaagggtgaaattgtcaaagcacactcagtactcaatataatacttttctaatgattcagaagataaaagagcagcattcttttcctgaaggaattgaaaaccatcagatacacctatcgtttctcccttgttacatagtttggcctactttaacagatgagttttgaataatgcatgtaaaaagcagtttggaaaggaaaccgttttagtttaggagcacctccatttcatgttctgttgattacacagatggaaaacatgcttatgggttaccataattcagtgaattattccaattcagttatgcttcttaaatcaatatatttgaggtttatttgtaataagaaataatttatcatttatatcttcccatttcccttgcttccctgattggcaaggagtgagttacaggcctgctattaacctttgcttttctaggttttcaaacaaattgttacttacatgttcagaagcaatgatttttagagccactagagaaaacttacttttcttggatggtttaccttcttccttggcctttcagagcaatcatatccttgatgaaggcttatgaaagggtagtttaaacttaccgcctgcattttttaccttccagtaattcctgtaatctgtagctgtactgaagttcttctgtggtttacattggctccctagttgttcagcaacatcttgcaacattttacattacccaccctgtcacttgaatctctcttccattaagtacctctacagattttcttaaacctctgttatgatgtctgctttgaaggcttgtcttactccgctgtcctataaagataggtatttccctagctccacctccagttttcttcttttgccccacccatactgtactgttccttaaattttatttctataaaaggttcccactccaatacatatgaagacaaccctccactatgattgaccagaccctgtcaggcctaaatttctaaatgatgatgtctaaatcaacttcattatccccacttcagtccctttacagcaaaatccttcctctttctaaatttttctctcattttatggttttgacatataaccagccacacaatctgcaactacttctcttcctgctccgtcacaaattcagtcacaataaattcaatcaattccttcggaacaggtccctcaccttgaatatattaatagatagcccttctccagttccagtgacactcctgctcccattaattttcttaagttctaatagtctttattaacttatatctcattttcttcctattaaaattaaaatattcttcttcctttgttgtctgattaaaaattctgctcactgttcaaaaatacaggttaaataccatatctttgtaaaacccttcttaacctcctcccctgtcctcagtcccgccaccaacacacgcacatacttccttttcttttgccagtcagaattatttactatcttttctgggcccacctaattttatatacttctattaaaatacattgtattttatttagtactgtagtatgtttgtgtcttccactatattgtgatattcttccacgatatcaccatatagtggaagaaacacacacactagccttaagggaaaggaagttcttggctaaaaatcaacagctataaattgaattgaaatagatatcataggtcttgtttcagagtataactatgtgtattaattaaaataagttaaatttagtttaaaacaatattgggggaaaaatatttaaggactaaaatgaataattagaacagacaataaaaatacatatgtgtgtaatcagttatctcattttgtttggtttttaatgttataatttctaattgagggcagggataatatcctatttctcttttccatctatagtgacaacatgatgtattttttacttggtaaatcgttcatttggggagtttaggggcttaaaaaacaccttctacttttcacttcaaagttggattgagctgtgagttagacccaggtactagaaagatgggagatttaattttcaatataagtactttgaacagaattgaaagctgtggctttgagtctgcaagatggctaataactaatcccagaatcagccagattcactgagccacacaaacttctgctacagggtcaggcctcagatctcatcactgctttacaagtttgtttgttgtgctgtttgcaggcatcataatttggaaaaaggaatccagaaagggctaagtttcctgtgcccaattctttaccatggtcacctatcatataagccactctttcttccttggggtgcaatgaggaaaggcttacttgaatgaatttccctcaaaatggaaacatgagacttaagggaaaggaggttcctacctaaaaatcaatagttatatatcaaattgaaatatgtatcatagatcttgtttcaaagtagaagtactgccgtggtggctcatgcctgtaatcccagcactttgggaggctgaggcgggcagatcactaggtcaggaatttgagaccagcctgaccaacatggtgaaaccccgtctctatgaaaaatacaaaaagtagccaggcgtggcggtgtgcacctgtggtcccagctactagggaggctgaggcaggagaatcgcttgaacccggggagcagaggttgcagtgagccaagatggtgccactgcactccagcctgggtgacagagcaagactccatctcaaggaaaaaaaaaaaaaaaaaatatatatatatatatatatatatatatatgttaattaaaataagtgaaatttagtttaaaataatagggaaaaaattttaaggactaaagttattaattgaaaacacaataaaaatatatatgtgtataatcagttatctcatttgttttggtttctaatgttgtaatacctcatatttttaatttgtgctatttatggaattaatgacttacatttttatttaatgccttttttagatagttaagcttcttagccatgttctgccaagagatatgcaccattgaaagacgtgtgtatatgcaagtacaggtattaataatacacatatacatttgttttaaagtttatcaatgcctgggggagagggaagagctgcaacataagtatcatttaattgctttctgaggcctatcaattctcaatccccttatgtcaatagcactgtctatttcttggttaaggttctcattattctttatccccaaagccaatagccttatgtcattatttacttaaacattcacaaatatttgtttattctgtgctatgcataatggatgcaattatcaaaaaacaaaaaagcctcactgtatttccttctgcagggagttcacagcctttttattcaatcctgtagcctccagagtgatctttcttcttttcttctgatcacagtgaaaggagtgggctcccaagaaatagatgttcctcaattaatgaatttagaatacctgatactaaagtatgaataatttactaagtaactaagcaatgaacttttaggtaggctggtttggaaatacaaatcaagaaaggaccggtttagttcaactttatgattaaaatctccaacgtagcctgccatattagcttgtaaaatgaaaatagaaatgaaagttgaagctatgtatatttctcaataaccagagttgggaagagagataaagattctaattttggtcattccttgtaatagggaaaaaaaccagaagtagcacctattatagaaagcatataaaatatgctagtatatttaaaacttacaaagatgtgttattaaaacttaagtgacatcttttcttaggacaaaagcttggatataaattgatcctgctctcgttgtatccactgtatgtgggaaaaagcaaacagatttattatattggtactacatatcagcatattcagaaggactctaagtgtacaaatatacgtgtattaaaccaaatattcgtttaaaattaccttttaatcgcttgcattcacaattgcttgtttctaaatgtacatctttctcctccacagctttcactgcatgtttcataattatgccatttttacttgctttttctttacttttatgtttaaataagcacaaggactggaattttgccctaggaagcaaggttattcataattctgtccagttaatattgttacttcacagaaaaatactaagtctatatttatgtttccaaataacaccaaaagttttaacacaactgagtatataccttaatgtagaaaatgctgtcgtcgtaattcttttccaattattttacaactatttcttcattttatctataaacaaaagccagtacagtgaaaagaaactttttaaaacattcagattggattgaccaatcctttaaataatttttaaaaattaaataaagttaatgcaaaatgttatttcatcaacatttatcacctttaagagtatgttccacacatttttatcttctgctcaaaatctgctattcagtattttcacttgcttcatggcttcttcaaagcctgacttgaatcatgccaagtttgtctatttaagatagattaaacaaaggcttccagagaatttcagaattgagtatctgatgacctcgcatatcctgagtgacagaagccctttgctatgtttggccagatggtctaaaatattcagtaaaccaagttatatctggcaagttttcaaaaagaaaactttctttttgaaatggtaggactagactcctttggataattataaaatcttatacctaaatgagtcctttaagactatccagttattccttctttcatacaagaaagccaatatctagagaaaaatatcctgttagaattttcatatataataaataaaaaattttaattctgacccattcagtgtcttatttcctcagttttaactagatgtttgaaatttgtgtctgtgcacagacagaatctaaaggtagcttaacaaaggaatgaaacagttttctaacttgtgtttactgttaatcgcaagaaaagtattgtaaatgctgagctaaaaagcatccatttaattgacatacttttgcaaataaaaaccagtgaaactaaaaaaaattaatgctaatttatcatttcatgtatctatgttctttgcttttatttatcagtatcgtttacttacagcttttaaagttcagtaattagccctgtggtttttgacaagaaaacttaagaattcacttgtagttttcccatgaattatttcttcatgtcacggtttcaacactgaagaacacttttatttcttctacttaactgtgctccttactttgtattaaattcacacatccccacctttgcaactctacccagtaatttcaaggcctggtatcacaaaatcattggtagcttattaaacctatttattcaaacataagccatattcctaaagatgcatctttaagaacttaaagttacattaatatttgtatatttatagattaaatatgcacatagaagcacattttggaagaaaaaaactacacttaataggcggattccaaacatcttcccgaataaattgtttctttattcacttataagattataggttttatgttcttaaagtattgtaacttatctttccaaggcttataacagtgaagattttaaattatggagcaaagaatctacactttgcctttatggggtgcttttccagtcctcttgttccatgtattcttttattttaggagttactaaatgtcctgttttttcctgtcttgttcactgggcaaacaggggtagatggtccccctccctagataggagacgacctcctagtcccaggattcaaatccagcatgcgtctccggagaatgacaggtactagtcaactcctcctcacagacaagtggcttctagaagcttataggccaccaactgaaggataaccaagagaaaagttgaatatgatgtactttattccaggagccagagccagatatgttagatgtagccaactctggtaaagcacctcagaatatttactgaaatgaggatagcatacaaatggcagagtttaaacccagtgaagtcaggatccattgaaaggatgttctgttttgaagagcatttgattgtgttttgaatttctggaaacaaatttaaatactgtttttgttgacaagtaaataaaaattctcaggtgctttagagtatattaaaatctgtcacagagcctatttgttatattggttgatggttttatctcagttgtcttgttttgctgctgtgtacacttgttaacaatgaagtttaggctttgattatattaaataatgtctgtcttattaagtaaaatacctggtttttatatattttataaatattgtattgttaaacacaatattgtccagggctaaggggtcagtccccaaggtaggtttttaaaaatagcatcagtgctttgaatccactttatgctgatatgtcagaagtgccacaacatatattttccattactttgttattcttctcagtgtgaagttgacccagttttcctattttatggtatatatatatatatatatatatatatatatatatatatatatatatatatatatatatatgctttatctttaaatgtgttttcctgactggtcacaaaggtttttgggtgtttgagatgcttctcttctggttcaagcagaaattcagccaacgcattggtaatatttattcagcagataagtagacgtggtatctcagaagcagcataattagtcatgtaaatgtacagattttttttagtgtgtgtgcgtacggcagagtaatttaagccctagttaaccgtgacacaatttattttatgtatttgtaaacaatcaagatatcctcaggattttagcttgaaagaaaaaggaaacattgtcaccaagaaaaaaattaaggttgttttacaaatactggaaaagactacaaactgatattttatgaaggtttcaggaacattttagcatcttttaatctctaagatacttgcctcaatatggtttacatttacatatttggaaattaaatataattctttctgctactgtctgatttctaggatagaaattctgggactagaaaaactagtaaccaatctaaaaagtattacaaatgtagagtcttctcaaaaaagaatataaaataattgtgtaaattcaataaaaatttatatctatattgctactcatttattcaataaaaacttattgtacccctactatgcaccctatccaaatggctaggtcacaacagtgattaagacagacaaagtcctggccatcagggaacttagaattttcttttagaaaaaatacttctgtgccaggcatggtagctcacacttgcaatcccagcactttgagatgccagggccaagtggggaggattacttgagcccaggagtttgagatcagcctgggcaccacagtgagactgcatctctgcaaacagtttcaaaattagctgggtgtggtggcacatgcctgtagtcccagctactcagaagggtgaggtgcacacacagtctgtgagcccaggaggtcaaggttgtagtgagccatggtcatactactgcattccagcctgggcaacagagtgagaacctgccccctccgatccccaagaaaagaaaaaaagaaaagataattctagaaaacctttgtatgtattccaaaacaaataaaatagtagatttcatcttctgtattgattgagtataggaaaattaaacatgatgatctttgtaatgaatataaatgtaagtttatctgggcattgattaagcaaaatggaaattcaaataatactttcagttcttacatacacgagatgttattagcttaatttagtggtatatgaattattccatttgattgtctcgatagtatatgtaactataagagtagattttgggaccagaaatgatccttttagataagattattaaaataaattattattaaatacataattttgaatacatattttgcttttttatgataacatatttatagataagtcctatgttcgaccaaaataaatacactttacatctcttgatactattatttattactatagagaatagagaattatttacaatacaattttattaaaatataagacaaatatgtacgtataaaatgagagataaattatgtccactaatgctacattcataggttatatgtcaaccacttggcaaatcgtaatgaacgttggcatttcatttctcatcagctttatttactcattcagaagtttctaccaatttctaaatgaagtaaatatggcatcagatttggatatagtgaatgttcataagaatttcagcgttaggtgacttttattgttggacactggtagccaggaaaatattctaaagttaatgacaatttatacaattcaactttggatatcttctatcagggccatagttgattattttgaaaataacattgtaatgcagaacgtaaattattccttaagagagttatccagtacattcaaataaattgaaaagcttttagttgccctcttgtttcccacagcatatatgtgtacacagacacacaatttttagagaaccatttctccataatttaacagtaagcattctcagtttttctcaagtgataccatagatttatttggaattaacatgaaggtacttttatctaagaatattttctagaggccgggcgaggtggctcacgcctgtaatcccagcactttgggaggccgaggcgggcggatcatgaggtcaggagatcgagaccatcctggctaacacagtgaaaccccgtctctgctaaaaatacaaaaaaattagctgggcgcggtggcaggcgcctgtagtcccagctattcgggaggctcaggcaggagaatggcgtgaacccgggaggcggagcttgcagtgagccgacatcgcgccactgcactccagcctaggcgacagagccagactctgtctcaaaaaaaaaaaaagaatattttctagaaattgaggaaatttaaaacattgatgaagaaaaaatacataaatttggaatcccaggggatgttttcgattttaaaattgtagtgaaaatttccttgtagttttatttctaaaaatgttgacccttaaaaaatcatcattccaataacaaagcatctctttagaaataacactattttaatacatgaaaatgctaatgaacctatatatacgtaattatatgagtgtaaattaaatgtagattgagttgtagcttgaaattaaccaaaatttgtaagtagccatttagaaaaaatatattttaatatggccctgaagcatcagagttctgagtttagtgcttacagtttaatcaatcgtctttaagaatgaaaggctagtgtaagttattattaaataaaactttaaactattttggtaaatgttttattcaagaaaatgcaatattttcattgggtacattttgaggtatattttaacatgtcactggctttacaaatcactgcagttactatcttcaatattttgattgagaatggtttttaatctatctatctatctatctatctatctatctatctatctatctatatatgatttttaagggtacaatttagtagtgcatgactcaaataccaaaaatatttggttaaataatcttatttccagaactttaaatttttcaattaagtaaagcatcccactatgtttaattcctgagttgttctgctaaagtggctctagtttcttttgcagataaccaaatttgtgtagtttcctatacctattagttggtagcagctacttgtctataagaatcctcaaccaagagtatcaagtgatttcttttgatttaaaatgaattaatcttatttctcctttgaaaatattctgggacaaacaaatcacaaactttttgcttccaggattcatggcagttgccacatattttcaaagttagtgtagaaccacttataaataaatacagtacattacttattatttctttttgttctataatatcctttattatctgtgcttttcaaaaatactctttctttgaatgaacaaagtgtatccatgaactaaaatatggtgagtctatttaatagctacagtcgtatacataaatatcaataatatacaggaaggtaaatgtatcttaattgcatgcatccatcttcactgcataggaacatctcttatttaggttgattctattcaaatttaatttttccttcccaaacttaatgagtaaatagggtgatagagatttgctttgcacattaagacagtataagccatgtaagtagtaagccaaaatatagacatattcttatgatatcagtgttagctctaattaagtgaaaacattatgtagtagacttttgttacagtatttccaaggcagaacagactatgttttcattgttataaaatagtcttaaataattatgattttattaattttgtcctttaataaaattttagtattttatcctttaataaaattttaatgccttcagaaaagctttatttaccaacgtctttagagagttaccctaactgaaattagttattgaaaaggaaaagaaaacacatagattttaacaattacctctgtttttcatcagttcattttataaatcttcacactaaattaatagaaaggaaataatcacagaaaatggaacttcaaaagaattggggtttaagtagaaacatcccattttctgatttttactctagctttgatttaataataaaataattgcttttataccttacagttgaatgtacttttatagctttaaaagaatttctttagtacattgtgaactagaaagcataaggccaaaaatcacacaactattaagttgtgaataaagggagaaaaactcaagatttctgattcttgcatgtttaaaaccaagtaaatattctttatgaataatattgtaaagataaaaaatttatgccagaacaaaaaagcatgtttaaactaaaaataagacataatgaaaacactgaaacagtgttgtcttgttcactcgtgcccagggatctctcaaataaacatctaatcattcaaaatgaacatgtggcagagtcagcagagaacttaagcacataggggtgtgatggtgttatcctcatcaacttattaaggtctatcatagcttggatgagacacttaaacttttgtggactaagtttcctcatctctaaacttaactggttatacatgggatagctgaattttaatgtcctatagactctaaaattgagtctatactgccttgttgcatcatgttaaaacatccattaggccctggataatgactgacagttcattatgtattattcagtaaaccaaaggtcatgttgtatttaagtattttatattttgctgaaggccagaaaattatgcagttttatttttaaatttatttcatttgaggcaaactagattttatagccctagttagttcttttttattgtaatttttgggctttcaaatttaatgataatactcaaaatattaccttttaaactatccattcaacaaataattattgagcaactaccatatgctaggtgttgatattacactgataatccaaacagacacaattcctgaccacagggaacttaaagtggtataaggtagaaagtaattcattttagtatgatctattttgtgattacacaattaatagtttcagtagtatggtacatgaatataggtggattgttctaacctttcctattttatatatctcaatccaatttattctaagacatggctgtgttaaaatatacaatattttggctataatttggattcaaaatagaaaataacattagaattttctattttattctctgctcctttacagaaaattattgcaattaagtgcatatcattttaacttaatttacgtattcttttaaggggttagaagaattataaagacatatcctttgtagttatctttagaagaatctttaatggaggtaaatttcattgctatttgaagagaaaaaaggggcatcctcaataagagggttaaaaatgaaaacaaaaattaaaaggttagattatgagcctttgcatgaatatttgttatccagttatagagcactggctctaagttttatatttttatagatgagtaagaaaaccctttgccttcaagaaacaaatatttaaagcaatattttcatagcaccacttgctaattccaagtaatgcaaaaaacatagtcaattctagttctgtgtaatactacaaatactacaatactgagtactactgaaatatttaaaattagcaaaacctgtgtgtgtgtgcagtggtagtggtattattgccactttttaggtaaaagaaaactgaagcacagagacattaagtaatttcaccaaaatcgcctggctagccagaacagagctgagattacacccagttcattattttagccatttatgccagagatacaacatgattactgttgttcagattatggactctcagttcacctcctggctagatgttgaatgaccatgtaagcgagaacaaagtgttctctaactctcaattttcttattcttaaaaaggataaaagagtagtacctacctctggattggaaagaagattatatgagataatgcagataaagtgaacatgctatcacagagaaagctctcagtaaatgttatatattattaatatcataatcactgttacaacaatcattgattactgtgataatctaatatatgaatccattacattttaggagatgaaaagaggaggaagagtttgaaagtttcacagaggaaatgaaatatcacttgggtctagaaattaatagaagttgccagggatcagaagaaaagcaggctatttcaaaaagatgccaatagccctttgattgtgcagaagttttattcaagggtccaccagattctacacaatttctctgccttctcctgcaaaatttttcatctgaatcatctctcttgacccctgccttcttattatttcctattatttcttcccttttcctgagatactttttctctaacaatatacatggctatctccttcactttacatctttgctaaaatgtcaccatttcaataagtcctttccaaccaccctacttaaaattgcaatatgctcctgcccctaaactcccaccttcttaccctggtttacttttgttgttgacatgtatcaccttttcccatactacataatgtacttgtttgagctactttttgttgtttattttttgtcttgtatcaacaaagtgtacatttcttgaaggtagagagaattgtgtttttttttccacagacatattccaaccacctagaacagtgcctagtatatatacatgcacaagtgtttgttggatgaatgaatgaatgagtggaaattttaatgacagtaagttttgtgggtcttcctgaatctctccactctcatctgctctacttgtgctgaagatgagaaaaggagcatttgatcttccagtcagttgccttgagcactgtggggaccaagcataaatttcccataactatttttattttgagctccaatacctcctgagcctgcagatctaattactaatcctttcttctccccttacttctcatcttcccactatgcttatgccttcttccctgtgcttcaggaacaagattccattcccaacaaccatgtctcattgatttcagccatgaaatcaatcatggaatctctgcccccctaccacccatgatcccctctcctgaccacagaagcaataaagtaaataagaaccttaatgtcagagagagagagtcatctgttagtgatatcccagcacctgatttcatggtttcatttcttccttccagaacagatacacacataaggcatgtgccagaatctctctcttccactctctttgctgtatagtatagaacagaaacagcttaggagccagataaacttagattttaatcctagctttgccactttctaactgagtagcctttccctgagcctgtttcttcacctataaaatggaaatgacacattcttaaaggattttcatggagtttaagtaagttcatatccccctcagtgcctgacatagttatccctcaatatattgagtacgctcttttccaactggtaagggaatatgatgtctcactcctctatttcttccttttttatcttaaaagtggtatgtcagattaacatgagtctgaaaacacacagctgaaaccctgaattgaaggggcaagagagtgtgaacacaatttctggcgaaagcggaagagattgggagagatgagcagtcccagaactctgtaacagcctgtgaaggcttgtaccttgatatgtgttcctagtgcctagcagaacttggtatatactagatacttaattaggatgtcacacattaataagtaaagacagatatttttctcaacattgttgggagaaagggatatcagtaaagaaaaataagcttaatttgtagataattaatattaaatacacattcctagggtttctctctttttttttgtaataagtgtgagcttcttgaccacaatattttacattacttatttcaaatatatggtactgaagacattttaggctaattagacatatgtaagctgctgtggggaagcaaactttttatagaaaaattatttctgtgggaaaaatgcatttcaagtgttcagtgcacatatgtacttttaaaaagtagaataaactggggaatatgatttgtaatgtgattaaaatgctgtgtgcttttaaaaatgctatgtaatttataaaagcatctttatgaaaaattttaaaatgattttaatactttatataaatactttcatttatataaaacatctttaactgtagcatttttcttctcttttcttcacaatttgtgggggacaaatcaaaaaaaatctttgtagcaccaagtttcaacttgtaaaagtagggggcatttcacccctttgaagcctttcagcacctaaactattaccatcatcacatttatcattattacacttcaccattgcatttgtttgctcatcagcagaggccgagttgctcagtaggggttcatattagatcattgttgtagacgtacttgtctagactaatgaaatgtcagcttctcgtgtcttctattgggcaacttgtgtcttccacttggcaccaattctggttttcattttattcattcattcattcatttatttgtttatttagttttgaaaagtactgactgacaaaatcatttaggtaatatagttgccatttttcatgtctattgtgtttatcattgtatgatgttaatgtagctttattcatcatatattttgtgtttaacatttcattccacaggcactccagaaagtctgaaagatctagcatccaaaaacagactaggaaaggcactgcctctgatgcagaaaggtaggcttggtgttgtggtgtgctgacatcttccattttaggaatatatttaggggtgctgtcactctcattttacatgatcagttcttaaacacaaattgtgatgtttaaaggcattcatgtaactaaacctacccctaaatggaaatgatctcattgaagaagtaagagaaggataatttcaaggcggttcttaaatcttagggtttaaaaaataattatgtatttctcttagtgatcattctgattactaataaggattaaatccatactcattcctatatacatattaggacattaatattttgtttctgatatcttttaaatgttaccaatgaatgtagtgcctggaatatgcaaattattgactgtcttatttatctaaataatgccatcttttaaaaaaatcacttttctacaaatatatattctaatattctactggtatattataaccaaggatatacattgagttaatgtaaaattataagggattactaaccttttgtttgcaatttgtccaattccacaaaggttttaagtatttttaggtacaacatattgacacttttttttttaacatagtgttaaaagacctaagaattgcaactaacatatattcattcacccattcatttatccaacaatgactgagagcatgtaaagggacacagatgtaaatgaatgagtatattcaagtatcatagctttcattatagaggcatgcacaggtacagtatgaacacaagaaaagttgtgcagtaaggatgaaattaggaaatgcttcataaacagatgtcccttgagctaaatccagatacataaaagtatgtgtgaagagtggagtattctgagaggggacaacgtgagaaaacactgagattggaaatactatcttgagtttggggaaatggtaccagttttgggatggagaacaggattcagtggatagaaaagaggcctgaaaataaaattggagaaattctgagaggttaaatgaatgacatcactatgccatgttaataccatgctaaagaatttcaacttctttattgatctgtgagccacagatgtgctttaaacatgggaggcagaggatcagttttgagttccaaaattatagatcactttgactgatttttggaaggtagatcaaaggatctaggggtagatgcaaggcatcagccaggctatctcaataggcctagtagagatagaatttgtacaattcagtgattcattcagttaacagatatataccaactatgtgctaagttcaagtaataaaatagcaagtagcaaaaaagaaaagctttccagaggatgttaacactgagttgagatctgaaaaatgagtaggtgtgagacatatcaagggatgtggtatgtaaaagggagatgaaatttatttctggacagtggtccatggagaaattgactatttagggaacttgattcacaatggaataaggatacaggggactcatgaaaagtgttgagtagtacaaagagttggactttgaggaaggaaattgatcaatcgatagatagatagcctttgatgaaacaatgtttgtattttcacattctttaatcccagctcagttaactgcagtttctttaccatcattgtaaataactataatttcttagataaattttcaatcttcaaccatcattttcagccccctctacacaatttcaattattttgacatgattaaaccttttccttgaagttgtattcttttaattctattcagtattctttcattcattttttaaaaatactagttgagtctggtcatggtggctcacacctgtaataccagcactttgggaggccaaggcgggcagatcatctgaggtcgggagtttgagactaacctgaccaacatggagaaaccccatctctactaaaaatacaaaagtagctgggcctggtggcacatgcctgtaatcccagctactcgggaggctgaggcaggagaattgcttgaacctaggaggtggaggttgcggtgagccgagattgcgccattgcactccagcctgggcaagaagagcaaaactccatctcaaaaaaaaaaaaaaattgctagttgagtgactactgtgtgtagttatatattaaggatacatcagtgaacaagtttttttggcaataagatactattttagaaaatgatagatgatgccagtgtcagctggaggtgcttaactccagattaatgatattgaggcatctgcctttgcaactctgaaatgtaatctgtggataaacacaaatcctccaatcagaatagcaaggatttgattgactttcattttcaaatatatgacacttatgaatcatattcatagtactcttgcctttcctttgcttatagtttaaagtagaaagctgtaaccttttagatgtgtttgattataattaaagcttttcattgatttttattagagtgtaaactacatgcctagtttctttgtgaattgttgaatagcaggttacaaaagaagaactggcctgggttttctaatttatgttagctctgaataagagctgttaagaagataccttgaatttacatctagctacacgtgaaccgaagacacagtataaatgctttggacactgactcctggcctttgagagttgataacttcccaaaaggagtcatactacacagttttgcactggtttctggcgaaatttgctgtttaatgatcataattttaaaggccttttattgccctcaacaaatgtaacctcatgacagatagccttttaagaatatattttgaaagagatgatgaccagttgtcattaggagacaagtagaactgatttatattttttgtgtcaagccacttaaagaaatgtatcatattttctttggaagcttcttgataagataaaagtctagcttttcatcttcatgtgaattcacccttgagaactgctgcccatcatttctgcattccattctagtgacttttcttcctgtagaaactacactctacattctaacttggggatgctttatttctttatttggactactatttagaattgcttacatatgcattttatggtgtgttattgcaaaagagcctgtgcaggcctgtaacggaccagcacagtaggaaccactttgaaaatttgaccttaaataccacatacatgtccattctttaacaagttgtttaaaaacaaaaacaacagaactacattgtttttaggctttggtagaagcaatttactgcaagtccatttgcagcaacaaaaatgtctgactaaagacgcaaatttttattgagaagtatgttttacttaagtgtaaatcaaaactctagtcttagatgaaggagagtaggcatggattgaacttagtggtaaatgtttagatacatacttgaagatggtaaacttagggtcaggcatacataagtttgaattaaacttttgctctgcaaacttttttttttttttttggagatggagtcttgctctgtcacccaggctggagtgtggtcacacgatgttggctcactgcagcctctgcctcctgggttcaagtgattctcctgcctcagcctcctgagtagctggattacaggtgcgtgctatacgcccggctaatttttgtatttttagtagagacggggtttcaccatgttggtcaggctgctcttgaactcctgaccttatgatccacccgcctcagcctcccatagtggcatgagccaccacgcgcggccgcaaacctcattttttaaaaatgaggagctgtaaatatacataatagagtaggtatttgttaaataccattgtccatatattttgattccacaaactctcaaacacagttctgttaagtcctgccaaataatttgatacttggacatatggtttgtgttaaaagattcatggtacatcctgagatgtgaaattaccacttttttctcatgatacacaaacaatcctatctcactagacagaaaagagagcaagcattggagctggacagacctgtgtggatcctgcctctaccacattttagctgtttatctttctccaggtcactctatgaccctcagtcataataaaataaaataaaataaataaaattaaataaaatagtagtaataacgcttcttagtgtgtgagaatacaaaaaggtacatatgtatatacttgtatgtataaacctatagatacatatatgcatgaatacatgcatgcctgcatatgcgcacaaacactttcagttcttggcatgaatagatgaccctatattgatgctcagtaaggaatagctgttactgttatgttatttatccatcctacactccctgtttcattctctaacaggttgttctaaatctctatcattcttcttacatccttacattcttagcacatcccatttcattgaaaagatcagggcacaacagcctggattctttcaactttacactctgtacctcagaatttcttgattaattgtcctttcctcttgcctaaaaacaaactatacttggttctatcatctctcctctgcaaaaccttgctcttctctctctaagctctgcatttttcctctacccagcttccccttcataattcagcattgctaccacattcctttcttcctctggcaaagtggctttctacgcttctcctttggtctgtgatctcatgcttgttacagagtggctgggggcaggaactcttttattattgagggacttttcatgtcaaagaaaaaaaacatatattgtgctaaacgattaacctcaaacattacaggctattttcagacactgcaagccttgtggctcaggagatggaacactatatgtggttgagctgtgaatattcacccaggaagccatttatttgctcctgaaattgctttttatacttttgccatttagtttgatgccacagaaagttcaccgaaattttttacatttcaagtcacatttgagtttttcttttagtgcttgtgaattgctttaaggaatggagcaagatttaagtgaaattgtaatatccgtgaaatttctcagtactaaggtgaaaactgtataattccatttgcgagccacgtttagaaagagtatcttgaacaaagattgaagtttattgtcatgataatgacttttaaagagtaatagataaaactctcatcactggaaaggacttgatcatttactctatcccatagaaattcattctatgtagttgagttaatgtgaaaagccaatttggaataaacagttttaatatatagaaccctatgagttactttttattttaatttggaaattgaggtaacagcccaggtttcagcgtttgaattatgacgtgataaagcattaatttatagctcaagaaagtaaaatacgcctttattaaagacctaagctgaacatctttttgttatcttcaacctgacattttcctgttttgttgttcttgaatgaataagatactcagaatcaaaatcattatagctataaaaatcattttacttaaaagaaaaattgccaatctgaatagaagttgaatgacactcctttatgtgcttttggtgataaatatgtattctttattctcacacatttttagtcactaagtgaattttacagtattgctttaaaaagggatgaggtatcattttattctttctgtcaaaataatacctgctaggtgttttaatcatgcattttatttaaaataaataccaaaatcaatgaaaaaggcaaaagcatgcattaaaaaaataagtacatctatataaacatcagttgtttatttttaattcattaattggctttataataattttaaacgccatagtaatatagttgtcaaaatatggacacatacattttcaggtattgttatatctgagagaacatgtttttatccatatttcagccatttatatttaatcagatgtataattaatggagcattctccaccttatattgttttaatttttgtctacttagattaacctcaaaaggcaggcttctttcgttgtttttggcatagtcttgcttattacagagtaaaattatgaacattgtaaaaatatagaggcctacagtatttcttcttgaaggcaagcacttgaagctttcctgtattcatcatcctaattacagtcactcattcaagcaacatacctttattgagctcttgctatctgtgcagctgtgttgtaagcacttgagatacagctctataaaacaaaacaaaacaaaacaaaacaaacagacaggagtctctgctgttggtggaacatacaagaggtttattacattagagcaacaccaattagtctttaaaaaccacatggcgttcacatttgcaataataacttgtcagtttgatttgaattccatttcaataattgcgtgatgggttctcttctttgaaattactgtcatgtacgagtaaccaggttttccttggacaaatgtgttggtatcaaagttaatgtgaacctgctgactgaagatcttttttggccctaatgttttagggttctcccaacatgtctttctagaaggggacacgcagccccaagagcaactgatcagccagtcattaggggaaaacatcctgctcgctcaaggtcgagtgagcactctagtatcagaacactgtgttctatgcaccaccttgtccctggagggtcggcgccaccttctccgcttctgacaaggtcgctattcagtgtccccctcagcattcatgtcctgcctccgggtgttggtgtggtgttgtaccttcctgagcacttgaagctttcactcattttgacaccataacttttaatcctttctttgtgacacttaaatctctctcacatcctctattacttgcatctatcttcactgtgctggtggtatactatagtttctgccaattagctctcattgaaaattaaatttggctgtgttatgtcctttcatctgtttgtggcatattcatatataatttttttaattatgtgaaatttttatgataaattacctggagttaaatgtgtgcttactttaaaaagcataagaggaaattttaaaaatcttttatatgtgttcagtaaagtgttaagagtgttttaaagttcttcagtttgaaaagtgtttaaatgccaacagatggaagtccgcttaatcctgggcagtagtaatatatcggcacacttctcaaacttttatttgtaattttaatgctagcaccagtgtatttcataacatatgtccaggattattttaaatatctttcaaatttgttcctatttagaaataaagtacaagtgagtggtaatttataaaagtctgcagctagaattcttatcagttataaataattctatagtcaatatcaatttaagagtagcagtttaggcaacagcctttcttgcctcatttatccatattgttaagatccagaggctgtaattagatgtatttggttcagtactgccaaaactgaataacttgcccaggtagaacaacttaatagaaagttaatgaaaagaagtgaattggattctgctcagtttaagaattcattatgtagaactgtgtgtggtgcacattgccctatctcatttaacccctttttgtaatattccatttacacatatcataaaaagtgtttgattctgctcccattggcccagtgagggggtttatgtctattttaatcgtaacagaaaggaggaaagatttttgtcagaccacattggaatttcattgtttcatgcccgctttgctttttgcctgcagaatgcaccgacagagaagtccaacacaatctcctccagcagacacatcgttcagcagtcgcaggggaagacagctcccacaagtgccagtgagaagcggcagtatagaacaaggtatccgataaagagagatcattgtccaaaaatcttggatttgagaacctcctctatttataccccttttattaaatgaatagtattttgattatatgtagtttgctgcatcctaaaaatttgattttcttacagttttatccccaacacctagtgacagtggttcatggcatgcactcagtttttgctgagtgagttttgctggatgattgaattttagatggtcatttaacagaagggatttagggctagaaacatcttattccaaagtgacaaaggaaaaaaataaaatttaaaaatctcattgcaatatggcattttatgtgttaaaagaatattttatcttttaaaagattttttaaaaattaaacacttaatcatactgaatcctttacaaattttttaatttaacttgattagcagtagcctatattttaagtttgatgatgaaaaaaatgacagaacacatgttttagtgtcttcagcagttcatattgcttaaagatttccttattttatgcatatattatttcattttctgagcaacaaagaaagagaaagagagagagaatgtatacggtctgattttagtagaaactaaattttctaaactacctgagctagatgatttagacactacgttaaaatagtattcttcatgtgacccaaagtgctatcacatatcttagtagatgacatgacttgttatcattattttttatcacatgtttttaatcaggaatttggtaagcaatttactaaaataatttctactttgggattgtaatataaatgtagtagaattacttttaagatatttattaaaaacctttatccctatgaaacaactgaaaggttaacactttgaatatttttttcagcagtgttattgttgctgatggaaaacttgcatttcattttatattgagggtacgggggtacatgtttttctcacttaattcaagtgatttactgaatgtatcacagatatgtcaaagatctcagaaggtaaatgcattgtttcaaagactgatgtggcatagattgccatgcagaatacttgattatggaaaacttagtgtagatttttaaaggtatcaacttattaatagagtaacactggtgtgataaactctgagtttatattttttaaaatacattctattgatactccatgctttagttttcagggttgctaaaatggtattcatttagtgaatcatgaaaatatgatgcattgtgaaactctgactttcttttttaaaatcgcagttaattcattggaattattcattgacatgtttaacatttttcctctcctctctgggaacattttaaaattattcataattaatctggcaataacccagatgaaattgttttaaaatttattttttaaagcaaaagttggtgtttatttaaattatctattcatgagctcctgttgcacaactgaaagaactacaaatgtgggtgtttagttacaaactcggtcttaccgatcatattttgctaaagattgatattctaaaagtcatgtgctcctaaaattctttgcatttccttcagttgcaaataaaacattttatgggttcaaaagcatataagggtactgcatataactctcctatagtgagattctgattacattatttctgtagaaataagaattccttccacaaaataagttgtattgtatgttggattttggttttttaaaaaagctcatgttctattgttaatataaatgttactgtttatgatattcatattcacagttgtctttcagagaaatcatcaatttgtaaggattgaattgaggtgggaagaagggaatgactacattggtggagttactttgatatttaatatgacaaatacactaataaacattttggttatttgagtttcctgaaatatatgatctttagagttatatacatacagcttttaagaaatgtgacaacaagcatgtattttatatatctatatatataaatgttctataaataaaagagacctggttggtgttttttatgatataaatatgtgctttaggacttttggtaaatgattataccgtctgccatcatctttttatggttctatttcaaaatgaacagtccacatgacagctttgtttgtcctaaaatatgtttaaaaaagtaaattttaatttgatttatgagttagataggatttagcatgttctatttaagattgatttcattgttgttcttaaggctgtagaattatgccattttattattttgaaattacttgttaaactttagttccatctcccatgaagattaatgctgaccacagtctattacaattggttaagcccctactgcacttgacttccttcccattttttaaaaatgtttaacaaagggtgattttctgtttagaaataatttgataagcagctgattggtaagaacaaatatttcaaatggtttagattactagatactgatacaccttcttgaggcacttataaaataattttattaatataccgtttctgggtacagttatctacattactgattttggaatgtatgccaggacaatttgactgtttcactggaagtattttttttcttataaatcaaatataccactctctatttataccataaaggcagtatctcttaaaggctaacatatcatttggaaacacatgtttaatcaatttttgaaaaggtgttttaaagttcattttaaaaattgagaatgctagcctatttgctacatagagccagattatgttgaagtagatttaggggaaaaacaaagaggtgatcacaatacagatttttgcggtagagtacttgaaacagtagccttataatttaagtaactctaatggtatgtgataattgaaagcaaagacttccacaaaatttttctggttatatttcaacacaatatcccagcatatcccttatgtagagtaaggctgaagataacttaattggttgtataaaaatggatttctgaagccaaccagtaacttttttgtgctcaactggatcttttaaagaaggatttagagatgattcacaaactaacagtaaatgatgtgttaattatgttttatatcttccattattatatcacctatctaaaactccaatgatattcctcttcagaaatacagaaacaggccattagtcctctgtaaatgatacaaaacaaagaggtggatataaagccttataaaatgtctaagaagtatagtctctacaaaacaactaattttactttggggtattttaatctaattaatttcagaagaaaaaaggattacttaaattagaattttctttcatgtggaaaatgttacagaatagtttccgtggtgcaaacaaagtgtaaaaatggaatttattttttgcttatcagataaaaaaataaatttcattttatcatatgagcctttatcacatgaactttcatttttgaaatgataaaaatttttgttatgaaaattaagtatgcttttaaatgcttttccaaaaaaaatcacaatggattcaagttaagatgttttaataaaattggtactgaaattttatacagctcttaaaaggaaagaaaaaataatacagaatatatttttcaaatgccaaacatactaatttcccaatgtttttgtttcattttaaatctttaaattgctgtattcattctttctttgattaattttagtaccatatttgggaactcatggtttttcattgcaatttatcatgtcacattatatgttatgcattttaattattcatgccattgtgttaattcacatttccatgtctaactataaatttgctgatttctttcttttgtttccatcattatgtgcatttaattcattgaagaacaagaaaaatataactcttccacaaaaggtaaatattaacataactttttaaccatttaatattgttacttttaaaaatataatatacaagagttatataactgtatttattgaaataatgagcaaaattaacaggtagctattttcctcaaatgattttgtagtgtatttgatattaattatttcatattctatgttcacatcaaagaagagaagattactttaaaattaatgttttttaaaaattttatttaaaattaatgtttttttaaaaatttatttatctatactgacaactagaaaacaattctcctaggaaaatgacattttctttgtttctgtttgtttgcatttccctgctctcatagataaaagatttaattctattcagggtaatacctggtaaaagtagaaaatctctggattttactttccagatagtggtaaccttagtgaatgttctggccctggctgcagtcatacatctgagaagctgctgcctaaatgttacttctgtttgcctcaatactgttaaaatacccattaattttatctttctgagagtcatgggagaagaaaaccattcagcatttttggtctttgcacttgaatttcaaataggttgcaggcttccccctacagtcatatgctgcccacaccattttctgttcagagttgctgttggcctgataattaactatttgaacatgagttttcagcttaatgtgataaggttaattatatttaataattatataattctgtataatttaataaaagtacattttctcaatatttgaaagtggactgattgaattaatttgttgcccatagtaacaacaaattaactcaaagctagttctgaaagtaacatcattcctattttaggaataaggacacaagttcagagagattatgacatttgcccaaactgcttgtcagtagtagactacaaacccagatctttttactttcgaccttttcctctacatgttggtgtatcctattttagtaagtacaaataccaaatatattatttctcacccttagcatatttagttatgcattatgtatctcggtattacaaagagaacagtttcaattacatatttgatctgtatttataaaaatgtatttaacaatatttatattcaggcactatacatatatatattattctggcatagtgtctgatatattaggcaatacatatattaattaaaaaattaaaaaattcagtgagatcaagatgttttggccatagattttgcatagatttctagccatcttgctgcatttttatgtcagatattgaaaacacaacattagattcagtagtacaagaatgaccaatgtactttacttaggtcagaagaatgtagttggatttgcaagataaattttagtgggctaaaagtattagattcatattagaaatgggccatgatctaattcctttatccaaaagaaagaaaaatgtaataattcttcatttagagccctttccatatatattactaggcaaaagctgtacctagctaaataaaacaaaacaaaatccataagtataacctaaagtctgcatgaaatatgcacatttagggcctctgtgcagaacatgtcagtttgtttttatacagtcagtgtgtcctggctgagaggtgtcatcacccctccaagcgttccttggaaacaggatgtagaaatgcctcacagaatagaccacatttttagaaataaccaaagaagcacatcccaaaatgcgtccaggaaggtataggtcagaaaaagaatgctgcgcctctccttagggatttaagataacacagtttagccactgaacgtggctctcaaaactttgaaagaatagaagcaaggtcaagaaatttcattaaaatcgtattttaagctcacgtaacccaaaagaaaggaaaagttcacagcatagaaatcctacttctgtgagctgaagtttgtctttgctgggatctatcttattagagaattcaggttattgtgagtacatcccggataaatgaagaccagtacacaagccaaggggttcattagggtttattttttattaactgtagatgaacttgtaggacaaccagtggttccagtttgtcagggactgagggttttcccaagatgcaagactttcagtgctgaaactgggacagttctaagcaaacgaggatggttggttaccctatagggaaccagtctattaattttacagcatatgtttttaaagtcacataaagagaagtgtaaaatactcaaagcattactaatggtagataggctatattgagcacttactatatgtcagtgactctactaaaagtgttacatatttatctcattatattttcacaacaacttgagacctaactattagtatctttattttcccgccgaaaagctaaaagttaggttaaaaacttggccccttatcagtcagtatttcattttgtaaatgatagaataggaaacgagacacagatccccctccagggaacttgttctcatccactttgctctgtagactcttcaacattcagacagcatttactgagtaactgctttgcatgcatcaccacgtaattatagtaacacatttacaactgcaaggaaggcttttttcacccctgttttattgaaatagagtgaaagaggttaagttgaatgccaaaggtaaaaaagctgctgtgaggcagaaccagattttgaatccacagcccatgttctgtgctccacaccacgttcctgtaacaatcaccactcagcactgggattttggagaagcccacttagtttctcctccctttccctattgacccaattttgcagcattcagttaaaccttctacatctggcctgctcctccaattgccatacagataacaaatcctttggcttgaaagttaacaaagctaacaaagataacacatcctttggcttgaaaagttaaccaagggactataaatgttcatagtactttgtttacattttaactccctcttttatgttgaaagctgaaagaccatatcattttagtcttcacaaactgctttataggcctattttaaattattcattctaaaagtaagccaatttttccctctctgctacatttcttggacagttttaaagagcccatgaatgtagtttgggggcatcgaaataatgatataagaagatcaaaactgaaccagaaattaaatgacttcaaggtgagaaaaatgttattgtcgtaataaatttatgatttatatgcctttagatactattttttaagtgcattaagtttttggctcttggaagcaattttgaatcataacaaaacacatcatattatctcttctacaaatatgaatttccttaatcataatagtgtgtaatttatacacatggagaatgaaaggcaattaaagtaagtaaattattatttataggaacaaagtaaatagcattttggtgctttttgcttttctgtttcactaataaaatatgtgataattattgtaactagatcatagagattgtaactagatcattaggattgtctctagtcaactatattttttttaagtaccaggtttctttaataagttctcaagtaagttaactgtgttttccttctttaaatgtcagcaagaacagtttgaatgctaagttatgcaaactatattttccatgaaacttatgagcattaactttactttagtggaattcaagtaaagaagcgaaaaacattaattttagcattttttgtacagttgtataaataaaaattaagcacatttcaatagcgtactgtggttgtgaaacactataagaacaaattatgtactctttttaaaataagtaaaccaatttttgtgtttttcagaatcagcattcttttaactgtcattaagtagcaaaggtctcagttttatttacatttttattagtagtagtagatgcatattagtccaggtgaatcattttctgttattgtgtgttaagatttcaaaaatacaagtttcttaatattcctgggcattgcttctcctgaacacttattatgaatcttaatgaatatttactcataaatatttagagctccattaggaaaagtaatttatccatctctttttttggcacaatctcataaatatattgtcattgtagccttctctttaaacttcaggatcccagagggttaagcagattgattagaaaaattcagaagtaatgcttttgaccctgttttcccatttggtgattcagatgtgtttatttatagtgtcataggcttttaaagcttcaaaggatttaacacatgttaaccaagacacaacttgcaagagagacctaattgaggaaaacaaatgtctaaccatggacaggctctttgatgtattttctctaaagttgtatatgttccccaaatattgtaaaacacaggaaaagactttcaaaaatcaaatttaaatttagcagaattgtgccaatcaagtctttcaggatagattctgtatccattagtattattggagtaatgagaaattatggctaaacattttagagatcacttggtataaataacatggcttcctcagtgattggttttgttatcccccaaagaaggcttaattacacaggttgctttttgtaaaaattgtatttgaagtgcatcttatgggagatagtgttccctctcaaaacctaaacatgcttttaaaaattgtttaactttgtataaccctaaaggacaagatatataacaaattcttttataagagcctgactttcttacttgccaatgactagtattttcagtgacactctgagaattggcagttttacattgagaaattatgtctggagttggacatcctgagcttcgttttagatagttcaatgggaataggtgtgctaaaacaggagatggtcttgtggttttggctgcagtgagacttaagtgattatatatacaaattgcctctttcacctatgccaatgttaaatttcacttatctaaacataggtactttgctttaaaagtccgtaaggcaatgtggtattttcacttatgtgttactcacttattgcattttctgtttctcatgctggtagatgtatgctttattggtagatgatgggtaaatgtttattttattggtagatgctggatagatgttcttttattgtttatattactgtagcataatccttaacatccaagagaaaaggatgttataagggaaaatgggaaactacttggaacatttttacacttacaagttgaaaggggtcattttattccaagaaagtgtgccagaactagggcatttctatgtagtcaaaatattttaaaatttaatctttatgtataatatatatgtgtgtgaagatgtagaagttggatatgcactacatcaaagtctctcactatgtttgcatgactccaaaaataaggatcaacatgaaaataaaacattgcagttggcccacagtatccatgggttccacaatggtggctttaaccaaccatggatcaaaaatgtttggggggaaaatgattggtagcatctgtactgaatatgtacacacttttttttcttgtcattattctataaacaatacagtataacagattcatgagatttttttaagttgtaagccatttaataatacgaaagggatagatttagaaaaatgcatataggcactatttacatgacattttccttgtattagctcttataagtaacctagagatgaaagtatatgagatgaggtgcttaggttatatacaaatactatgccattttatataagaaacttgagcatccgtgaattttggtacatgtggtgggtgggttcctggaatcaatcctgaacagatgttttttaaattgggaaaataacatgatagaaaatagtggtgtaaaatacaactggtgaatttttttcctcgtgatacctatagtcaattggaaaattttaaaatctggaaattaggtaataaagcaagagacaaagtcattgagattcctatttttgcaaatataagaaaagtattttaacaataccctattgaaatactatagaatcatagactacaactgctggaaggttctctgagcagtctcttctttttacagataaaaattctgtaatggagggatatatcaggaattgatcaaaggaacattgaggaactgatgaatggtgatggatctaggactgtaatctatgcctagtaattcccattcctaggttcttactattttgccacattgattccaggtatatgcagaatgcttatccatataaacaattcctatttctctaaagtctaaaaaactgtgggcagagactagtattgtatttttgaattttcaaataaaccatctttcttgatatattttaagatatagtttatacattaaatatttctgatatttaatgtatcagatctgatcttcctattcagtcttggtatagtctatactgattcaattagctaaacctttttcatcttttcttgttaatctcagctttttttttccactgcagtcaataactgaagcataggaggtgtgtcatttatattcttctgtctacctgacaacttccaaataagcggtcatttatcactgctcttcctgagagatgtactggaacaagaatgggactgcactatcatggagctctcattgtgttgctatacaacaaggaagcagagatgctagttttttcattcacaaaatatgatagcacatcatagttaactagacaggcttaaatatcctgtccaggtgttattgtgtgtcaactttgatacatatatgagctgaccttgttaaaaaataatttttacattaatatatttaataatataaaagttctacttatttctgtccttttacagtcatatttcatctaatgcttgaaaatattaggaggtttaacaatatatcaatataaattattttttgcctataaacacaaacgtctgaaatttcaaattcattttaatttcaaggtgcatagagagaaatgtgaaagatttaaggaattttgagatccaaacaaatttatttttatataaattaaatttatgaatattttaaatatattactgcaagtttaaattataagcgttctaaactatgtataactataatgtttacaatattttaaagcaaattacaaatatgtgataagtcaaagaggtttcctagaaaattactttatctctttgaaggaggttatattatagaaaattttaaatgatggattagggaagatttattaaggatttttgagggttttttaaagtcataggccttttaataatatgaaagggatagatctagaaaaatgcatataggacaaacaagattataaaatgattttagtttcttcatagatttattaaagatcattgataacactaaattaggaatccttagcaaagaatgtgaaaagagtagttattttaatatctttatttttaatactaatactttacatttgaaaattgtaataattacagtactttgtaaattatatttatttttcttatcttgcatactccagtcagattccttcttgttgagctttagaagacaagaaattatttcacagatatggttttcatttaactcttaaaaataagttccagttttatactttcttaattttaacattgaattgatttgtgacatacatagattaatattaaaaaagccatagtttggaaagaacaatgtatataaagttggaataaataaaatggatcttgttcaataaatacatttttgtaaactaataagtgctttttgaaagtaccatttttttaaaacataaggcacataattcagttggtaccttatagtgaaatatttcaacccttcaaccccatttttataaaattgtaatattacatctgaggaactaagatacatacattttgatctataatcacaaaatctataattaatgctgaaatatagtctatagtaaatatctttatctttcgactttattatacataagctaaattttcattaaaagactaaatgaaattgcatgataattacatttcttgtaaaaaatgaaagttattatttagctcttgattatgtggcatttatgaaatttttaaaaataaaaaccacagggcctcccagttttaaattttctataaagaaatagcaactggcattttaatgatttagttagtttacaatactattaacattcagaatgttcctaaaatgtgaatgtaatgctaggatttgtggggtaattggaaaatactttatttactattttagttttgctcttgggtttaaaattgttaaaataatataaaaattttaaatgacagtaatctttttttaaaggaagatatttgagctgtctgagttacagttaattttacttatactaagatactagagagacagtcacatttcaagaattcaattaacttttaatcattactactattctccatataaatcatataacttattggaatcgtgccttctggttcaaatttgtggtaattgtcttattttataaatttgtcttaatatttggcttgacacatctgcaatacagaaataatgtcattttattctagatatatagttgaaaaataaacatggtaaaatctttagcaaagttaaagaatttccacatttacactgaaggtttttcagcgattatgaaaaaacttttactgaagcacaataacttgtataaacagttatttcagaatatgcactaaggcacatgtcattgggaaataatgaaaagtactaaaaaaagtgtgtgatattatgtaattatttggctttttgctacgagtaaataatgataagctattagcattttggttttgttggaatccgagagcaagagtgaggatagcatagcaactacatctttgattgagagtcaggggagtctactcatcattttgaatcataatgttaatttggagatttttttttcctttcacagattaaataaggtcagttttaacttcattgggagtaaatatagtatagtaatgatttgagggaggtaaaatgaaatcatttagaaccatttttagattcatgttagttgtattaccagtctttttatgatttagttttacattttgcaaataaagatttaaatgcagctatagcataagctaagtaatcctattaatgtttagagaaatgaagtgttgtcctagcaaggttcagtccctagatctgtgtcagactgcttctggccagtagctattgggatataattatccgtgtctaagtaaccatctaccctgaaaattacgtggcactaaaagtgaagcttgcaaagctgtgggctaatcaatgtcaacatatttttaaataaagttaatatcattttatgagaatagttaagctaacaccatttaagtctgtttttattacaaattgagattgttttgagttgctttaagctttaattatagagcagaactaaatttgcagtccatttgacttactcagaactcaaagcaaatgattgagcgtgtacccagaagtactcacaccataggcaaaagacagagaacagatattttcacattttctatattgcatatgtcttttgtaaatataactcacatttttcaataactgtctcagtttctaattactcttacatagcattttactgtataatactccttttaactccttatatgttgccaagtaatgaatttctgaaccacattgctcaagctctccattgaactatcctgtaatggtaataatagtcaccatttattatctctgaagtcaacattattaaagcaggggtgtatcattgcttagtttgcataactaagggttgttagggatttgagattggttatctaatttgctgaatttaaacaaagtgaaacattttataatttactgataaaagtatgattaaaacacttagccacaaattccaaattttattatctcttgggctattggtctgcacttgaacacaataaaagttacagactgatttctttttttaaagtgtgtgttggcgttttataatcaaggatgataggccacatttagtcattgcaatggaaaaaaaattgtcagcaaatatctttatgaactccttgtaagagataaaatcagcagccaagtcaatcaaacatatcaacatttccattaacttgtaaaccattagtctcttggcagaagttcccactacatcagtgaccaataagcaattttccatacacacacacacgcatgctcacacacacacacacacagccctacaacttaaaaatctgaatacttgttgcagaagttgagttgtctgggaagttggcaaatgttgtataaagtaaacataagtctcatacaacataggtataagcttttgagtcgtttaccctacacatgactgtaccttagctgtttctttctccttcatttgtaaaaatgcaaaatttaaaggcaaggttttgaagtgatgttgctgatggtggattctaacttagaacaattcatactttatcaaaggctgcaattcttgccctcctctgctacttaggagattaataaaagcttaaaagtattctttacatattataaattaaagggctgaaagtcatgtattcattttcaaacttacgaatttcatttatgtggtccggatatagccataaggaatagtgagctaatcttttagtaagtcagttttaaggactgggaaatagtcatgagaagccacggacagaaattaaagatttataagaatgcctcaataaagtagatacttattaattaaaacaatttttaggtgactactgttagctgagggtgttaagtgggtgtgtgcatgcatgtaagcatgtgcatatagtgcgatgtgctaagtatgcatacttgttttctctatatatgtacatgcaacaaacagttgtttaaattgaaaacattcttacaattaaatttggtttcgcataatcatttatgaaggaaattgaaaatatttcatataaaatcaagaaatagagtatattttgttactaacatttacgttccccattctgtgtaatttgaatcatgttcatctttagattaacagttgctagtactgtatattctgcatttttgtttaatttattaatcatgtgttatttctaaattttatttaattgaagtcatttcaaaagcattgaaatcttaaaccattcagttcctgaaaggttcttcacatgttttaataggcttccattatgtgtttttgcagcaagcttagtagtggaggagcgaacaagacagatgaaaatgaaagtgcatcgatttaagcagacaacagggtctggttctagtcaagaacttgatcgcgagcaatattccaaggtaaaattagtagtatccaacaaatagtttcccttttaaaaatgtgtagtgtgtgtaccaggcaggattagaaagcaccgaattatataagagaagttatcatttgggccgggcatggtagctcacacctgtaatcccagcagtttgggaggccaaggcaggcacatcacctaaggtcagaagttcaagaccagccaacatggttaaaccccatctctactaaaaaatacaaaaattagccgggcgtgcgcctgtaatcccagctacttgggaggctgaggtaggagaatcccttgaacctgggaggcggaagttgcagtgagccgagatcgcaccactgcacaccagcctgggtgacagagcaagactccatctaaaaaaacaaaaaaagaaaaggtatcattaaatgatagtcctgcatcataatttctaccaaagccaaaaaaacaaaaaactctttcctcttgatattttcgtgtgatataacttcattgaaatattaacttggatttgatttttttctaaaaatatgtaaatatttgatattaaaatcacttaatgattgattagcattagtcaaattcacataaataagcaagatatatgaagccattttgttgcttgaacattatttaaatattccatttaagatattaaggtatatatttatagtcttaagtacaactttggattgatatttgactattgatatttgtgaatgataaaaattatgtgatttgagatttcttacagctctgtctttagtaagaaaagtaactgatttcaaacttctagaagctgaaatttacacaatttcaagtgctaataagcatttaatttttatttcaataatattttctaaggaaacaccaaggagtttataaactgctaatatctgataattttaaataaaatagcatagatttttgttcttcatgaagtaattttaaatatattatctggtttatttaaaagctttttttctttatagaatactacaaaagtagcagcagccattataggttgacctttgttgtaatttaatatcaacaaactctttgggaggtaataagctattagaaatcaaaagtaaataaaactacactaaattaatattattagcttgaaatatggacctagaaaaacctacttatttttaagcagtgtaagtggttcattatctttccagatattctgtgactaataaaaaaataaaataaaaagaggtggctacaaaatacgatttatcaccaagactaccatagagtcatgtgtgtttgatacagtctgtcactttacatgttaggttagatgcagaagggcttccaaatgagacagtgtggagggtcactgtgattcagtgatgctcaactccctaagagtcttaccaaaaaaatggtaagcaaaataacctgatgtcccgtagtattgcctatttcagctccatacaggtttatcttgtctgcaacttgttatttatggtattatcacctaatcagcctacttatctgtcttcatagatatcatcatcgtttttgttttcttactacaaatgcagtgagaattagaaggcagggtaatttggggttttgttttccctctacagttggatgcagttatttgaaagtttctttaaactggaaatgctccttttaagctggaaatttttatcagtttcttagctttatttcaaaagatgaggtcaaatagaacagcaaggagaggtagagccagtataggaaacaagaaagaggcgagtaaagaatcagggtaaaatactgaaagcctttctggatcatcctgagctgggattctgatcattaattagtcgatccaaaaaatcgacaaaatgaagtactcagaagtctaaaccaccactagtagtcatagtaaaccaaaggtaggtgtgcagactccaaattctctgactcataacttaaaaacttgaaaataactcaaaatcttctactccagctcacttatttaccaaatttatgacaactggggctcagaatgaaagaggtaattaattaaaatttgtgttaaaattagtagagcctctctgtatagtgaagaggcctataacaatggatttgggacttagggtatgactttgttctacttacatcattgaaatgaacacattactctagattgattcaaaggtctccatgtggctttcaatttacctaaaaattagattagcatattctatctttcctccctcctttgcataggcaccctttttcttttcctctctctctttgcatttgactattttaaaacctattactttcagatatagtactatggctcttactgaatagatactactatgttaaataaaattgtaataactaaatatgagatcaaagatatggtagctttaaaaacttgtaagaatataggataggaaattatataaaataaaacaaatgattagccttttcttatatgtcaagtagaagataaaatactctccacatctctaatatttatattatatactaacacatacaatagaatttttttgttttcagtagccatttttgttaattcaagccttttgcatatacttgagaaattatctttttcatttttattctacatcaagtattttataactattttataaagatctatttttatggctataattaagagccagtattggcacaaattttatattcattaaattttgaactttattctgttattgactcttttttagtatcttaatccatttgacattttggacgaagcaatgaacattagttgaaatttatgccaagccaaagttagttaactattctcaaatacttttaaccaaccactagtagaactggactttttttcagggcaaaacattgtcagacaactgtaattcctgagatgcttcttgaaacctagtatgtcttttagaagactaaatgaccctaacatccatcctgagtaaggaattaggactaactttgcttttgaaaaagcacaacaatgctgtttaggtatccttgaaatgtgtcaccattctattttttttttattggtggtatacagagtggcataccttaatgatgaagtgaaattcataattagaggtgaattcacatttaggtactcacaatttaaagaatgtttatgtttgtgtttatgtaacccaggaacagcaaccgagagtgatgtgatgggttttgtaggtagctgaagagtgtttattattacttacttctaaaaatagtagtgtttaattatttctctcacatcaatgacttatttgccctctgtaggatcggtagaaattccttctgaggaattatgttcctcaaaatatattttatgtatttccattaaaatattaaattgttacattcaaaatttaacagatcatgcctgatgaaattcagtgattaaaatgttaacatattagttaaaagtgaatataaaagtatttcactttcttcaaataatcaatgtgaataaaactgtgatatcatatcagaatgatagattattctttatctcaatataaaaaatgtattatgacataatttttgaaatccctttttgtccactttctggaataacaaaggtctgtatacaaaaaggttgaagaaaagatggcttaagtaaagccatcttttggcttatttccaactaaaaatatttttgttggaaaaatattttcatatacattcacatacctttatgctttagtgtacactgcttaatattgtcaaatatcaaataaggggagcatttgctctgggtatcagcacaatgctaacacccaaaacagggattatttcatattctgtcatgggcaaggtatcatcccaatacatttggagacaataattacatagcatctctcttttagcacagtgtttcaaaaaaccaataatacaggagttgtgtttgtaacgcagcaacagtgttaaattcaggttctactctttgaacataattgagtttttagcacatatactctgtaaattgaaaacagatctgattaaaatgaattgtgttagtcagaatcatgttattaaatataactgaatttgctggtaaaccatattgtcacattgctttcagtacattgtcttaaatcacattaattttagatcaaacatgaaatcatataaatattaatagctcagtttagatataataacatatgaatttcctttgaattctaatttggcatatgactttgagagataaatcacacaattatgaaaaatccttgggaaaactaattgtatatatatcctatatgttgggaattattttcatgcctgatatgaaattcttttatcaacacatacacatgagaggtaaagaaataaaaatcacatttagggaggccgaggtgggtggattgtctgaggtcaggagtttaagaccagcctgggtaacacggtgaaaccccgtctctactaaaatacaaaaaactagccaggtgtggcaccgtgcgcctgtagtcccagctacttgggaggctgaggcaggagaattgcttaaatctgggaggctaaggttggagtgagccaggatcgcgccactgcactccagcctgggcaacagagggagaatctgtctccaaaaacaagaacagaactcacatttaatgtttcagtcctaaactactctcatgtaagaaattattaaataaacatgagacctttctctagggtaatttttaagtgttattgtctaatcttctttttagtacctataaatccaggttgtagcatcagttaatttagtatgttttagcaagacagttcaaattcattaaaattcctctgacatggaacatcacaaaggatagatgactttttctacaggtttaataaacatttgatatttcatactttatttctcataaatctaaaattaaattgcttgctaagaaacaaacacccatatgttattttgttttacagaagaagttatagtatcttaccttccagtatctaagaaaactactcacattttaggtatctttcagttatttatagttatgtaacctatttattacaattataacatatataaaaataatatgtaatatataagctattcactgtgtggttcatcacaataagacagtgaagtagaaataagagtagcttaactgctttgacagctttgcatattttaatcttttatttgatgattcctaaaattttaggaaatgaatatcagagacaaatttaaaggcatctttgaataaaagatataatgtacaatgaaattttaataaggatccagtattctacttttgattctaagttagtaggttaaatctgaaactgtctaatgaagccatagtagaaagctaaagaccagtcactgcctctttgctcagtttatatcagcccttgtttttgaaaagttatatatttttaagaaatgttagagacactataatgtcttagaaagtatttaactaaattgactagttttagaaagtatcaaaaactatatacaggtggaagcagtctatacaggtcaagtatcccttacccaaaatgcttgggaccagaggtgtttcatattttggattttttcatattttggtatattttttctatatacattatatattttccagttgagcatcctaatctgaaaatccaaaatgttccactgagcatttcttttacacatcatgtcagtgctcaaaaagttttggattttggagcacttcagattttgaattttttgattaggaatgctcagcctatactttgactagagtagaaggtgaataaaatggacaagaatgaaaatgaaaacaaaaaagagaagcgtatgtactagaaaaaaaatgaataatacacttttgaggttctaaatatgtacaaataatttaatgacttttccaatcaggcatttaatgattgtgtttaatttatatttcagtcttcataagccatctcttaccactcaaaggataatgtttttatattggaaatcatatggtagtatttggattattttagatattacagctactcttatgaaggtacacctttatttggtgtgggctaagtagtcattcatctcaccatctatgttttttccattgtctaatgatggagctcacactttcttgtttttaatctttagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcaggtgagttggcaatactgtttatataaactggatctttatctgtgatataaaaatacaactagcttcctgaatattttttctataatacagtttaggtcacagtgggttaagtatttatcgactactatgtagtattgccaacagaatgtttagtattgactactatcagatacagcttataaccctagtcacaattttagagatcactctgagtcacatttgtagtagtttcctctaatatgattaaattcccttcctttagtccaacatcagaaagtgtattctttaaagggacagacagtaaatatttcaggctttgcagaacagtctttgtggcaactactcaacaatgtcattatagtgtgacagctacataaataaatcaacatgggtgtgtgtgtgtatgtgggtgtagtggatgtgttaacaaaatagacatccctagttacgttatgagttgaaaggcatttgcgtcaattttgtttaagtcaccagtagtgcttttgtattcttaaaagacaaataccctgctgaaagggaaaagaccccagacatccaagtgctatctaaactaaagcagattgattatggacaaaacatattttgtattagttctttactagttttcagaagtcaaagtttcatatagttatagtcgtgtaacctaaaaatttattacaatttaaggaattttggtgttgatgagaggtccaataaatataagtgttaaaaatatgaacaaacacttttccaatactctgaaaggctgatgttagtgcacattttgatgatgtacaatgaattgaattttgaaaattctctcttgtttgttgaagcaaattaaaagtaatcatcctgctgttatttaacaatttcatactctgataatctaacatgagcaatttcaactgataaagatattagtagaaaatcttttatctttacttttggtgttctcagcatctgactctaaaagaatataaagttctttaaaatttaaggaagaattataagagctcaagaatgtagccatattaagctaagatcaaggggtaagaagtattcttatagattcctttttattgaattcttaataagatagaatgttttttaaactgttgaattaccaaagaatgtaataaataggatgtaaccaaggactttttttttaccttattcactgaaaacaatttgaagtaatttttgtttgtattcactgtagagccaagtaccttgagccctatgctttaaagtagtactagtgaatagaatttgtattactaaccaattgcatagaataacttgtgagttcattttcattctcctaaaatttcagaagtaggattcttcaaaaatttatcttcctataaaatttggctatgtgatttcttttagaaagaataggaaaacaatgacaagagactatgattttatacaaggagaatggggaaaactacatgttagtagtgtattggaaccagtgttactttgtggagaacatggcaactcaacaaatcagcatggactataaccatatcatgacaagaagcaaaagatagaggatttttttgcttcattgcttcgtatgaattttcatatttagtgaagatggtgagaagaggggtggacctaaaaagagtataaataaacttcttagtgataaatctattttctctaagcacttttttgttttcagcttcctttcccttctttgtagtttaaaacccatataaactgagagtttattttatgtaagtggattatgtaaatttaagcactacagctaatagttaaacaagtttccccttaagctaacataaagagctacttttcttgtaatctcatactgtatgtcagtgatttgtcatatgcggtacatatttgctcttagaataattaggaagaatagagagaaaaaataagatgtgacacgtcttctcttctgacattcgtagactagttatcccttcatatgcattcttctgtctacatattctcatagacacacatgcagcagtacacacacacacacacacagagacacacaaacacatggagttattttgcttccctcgtcaatcctgtggtaaaaacctgagaggtgatagtttggaatgataaagaataaaatgacatcagcataaaagcatcaaagtcctgtgaacaagcattgcaggctcttcagatgtaaatattccctgcccttataggtaacactatgaggaataatttttcttaatatattactgtttcttctttattttttagcaactaacatctgcataatttctatagttgtttactcagctaattaattataatgatagaatatatttacatataagttgtaataataagcagcaaagttttttgttcctatcatgtgtaaggactttattatcttctttttaaaacaaacaaaacaaaaaaaaacattgtaaattcctgttatcttccccaccaccatgaccatgtagggtccagtctactccctaacctttttcccaaaaaaggtgctacctccttcccagacagatgagagagggcaggacttcaggctggatctaccattaggctctccctcccccagcttggagcacaggaggggaggtgatacctggtgacagatggatgggtggtggacagagaagaggagacaaggaagggctattccaggctcagccctgctcctccagccttgcctctgggtataggggaaacagaggcatgaccaggatcagggtcatgcccagctggccacaaccacgcgtggggtagtccaataaataccgtggatgctcagcaaggctgctacctggtgttttgaggctgctgtggttgcagacaccctcctggccttggctccctatcaagaagctggggatgggaggtggagggaggaggagcccctgccttaggagcctcacaggctgcaccaagagagcaaccagcctggagcaggagccaccaggtcccaagcatggctgacccaaatgtcatagatgcttttattgggtggcacctcctggaagagggtgtctagatcccagagcagcctgggggccctctggtttcagaggccactccctagtaggcagggccagttgacggtagacactggggacagtaggtgggtggtggtgccaagggcattaccacattgggagtgtagataggcaagtaggaggtgggcagctgcccccagggggaggccctgtgtcccccactggacagccacccaagaactgaggtgtcctgcagtagagtggagagaccaggccctaggctctgtggagagggtcgagggcccagtggctccctgctgggaagcctccccctccattcttatggggctgggaagagggcagagaggccacagaggcctctcagaggagggcaggggtggggtgggcaccacctcctccccactgctccccatgcctgaaggagctgggctgctctgtggcaccagtcccgaccagggtgccccctccccagagtcccctagcagggacttgatgctgaagccctcacggggtggcagcaggggactgggagcatctcgcagcaagtagggccgcaggtccttggtgaaggctccacatgcaccccagttctgccagcacctgcacagggctgtgttctgccaccatagcgactctgctgggatcaggcttatgtcgaccgcccagaagttgcccttggcctggagctttgcagggtccacaactatacatttagtaaaatttggcatttgatgtcagtaggcataataatcagtaagcatatactgaaaggaatgttcttctatttatttgaggattttaaaacaatatagattaaattattttatattttaagttgtgataacaaatatagaagttaatatattctggaatgtcaatcttgatattacagttatgtttgaaaagtgttatagaaaataatttcaaatgccccttatttcacaatagttcttcaattcagtaaggcaatacaggataaaattcaaaagtaatccttggatttttgtgatgcatatgaaaatcttgagttagagttatctatatatccaatacatgaagcttattatctacactgttccgaacttcaattgctttactactcttttgcctattcgatttggtatttactgaaaatgctcagttaagatctatgaagaggatttgtcaacttctttattattctgtccattttttcttatatgagattacttaattaggttcaagttcagaattattttgtctttctggcgatttaaccttttatcattatgtaataaatctctttattccttataatattattttgttttaaagtcagtttttcttacatgataacacaagctattttcagttagtgttcaatctaactattcactgttcacatctttttgtgtcaacttttctatgaccaatgtgttatactcacataaacagcaaatagctaggtttaatttttttctgaccacacaatctctatcatttaattggctagcttatcaatttgcatttattttgattcttatagacttggaattacttctatattggtgtatgcttttaatttttcttattctattttttctctttcctgatcggtttttaattgaattatttttctttcatttcccccctccattacactggaaattatgcagtttctgtgatttttactgactagtttctcaagtatataaattttgttaagtagtcaatttaaaattaataattacctctactttctcctaggaaaaaaaatgactgtcatatgcttcgctgtgctactatccctcccccatttgcatattcttgtacaatgttttaattatagattggttcattttccccttattgcatgttatttttttaaatgccttatattaaaccatatgtattctagtttctttgctaaccatttttcgtgcatcttagaccttcattctggatcattctcctctctgagaaaagtgcattagaaagccaccagtgagggtctgtgagagcttagactgagacacacgtttttccttgttgttctttaagggtcttgactcatgaggatttcagttctaactcctcactagacctgaaaggtttccaaagattcatcattcacttaccgacctgttttagttctcgtttggtttttggctaaggacatatgcctttctttcttgtgacctcaagttggtattttaacaggcatttgttgtaattttcccatcataattactaggcatttggaagtgaaaggattttttagaatcagaatatatcatctaccatactgccagaaatagttcatatttgatgtgttaccattttttaaaatttttttttaaatttgcttacttgaaaaggataatatttaaaaataattaataaataagaaaaaacatgtaggtgtgaaaagtaagaaggatcatggccctagagactttatcccaagttagagggcaaatgccaaggcagagcaagcagagttggatgttaaactggaagtaatatctaaggggcttaagaaaaataacaatcaggaacatagaaggagatggtgaagggagccaagaactggaaaactttcaggaaagaagagagtgccagcagagacaggaccatttcagtcatgaggtgtaatggaaggaggagaatgaagaactaatgtgggaggtaaaggttgatacagctcaaactgagaaagagattctgaagtctcagaggatattgaatataagggagaagaatgaagtgagcctgaagttaagggaatggttagtgattgctgaataaacagcatcttgtgatcagagttcctatgccaggacaatgtgaagactaccagcctgcccttaaagactgcttttgactcagatgtgaatctttggttctgtcagctatggctcagtacttctactaaccaatattgagagcttcattcaacaagtgtacaacttctttagaccttgattttttttcacttagtcatagatttattcatttacttattcaccagtcatttattgggtacatcttatacgcaggtgccgtacactatctagtataaaacaaaacacatgattcctagatctatgtttttagtggattttcatacaagtgtaataataatattaaatgtatattcatctgaaaaatgtgaatcatacctgccactcctaccttaccagactgtttgagaataaaatgaaatagtgtatatcagaatactttgaaaatatagcattttgctttataactcagttactgcatacatggtatgaagtattagataagttactttatacttttaagtcatccttgaatgtcttctgagagacggctaacacataatatagtgcaacggcatttaaaattcgaattttgattactaatatttaacttatccacttcacagtgcttcatggtgagttggatgaatttaacagttggatttgacacttgaagagttcagttttattcgagtgtttttcaaagttatgcccatggactgttggtgttctaatgaaccttattgtctccaagaattgcctgatagacaggagaaagttgtccaaggagcaggagaaaaactaaacggggaggagaattcctagactgcaggacttcagcaacttcaactaaagcagttctactagtatttgtttagtacaacagaagtctgtgaagtagtttatttttaaaaaggaagccaggcactgctgctttaaaaacatattgtaaaccaaaatatatggcacagtaaattctagtgctattacttccaaggagaaaattaaaatatgagatgtggttctacttctctagttattacctgtttttaaaattcagatagtaccataatttggctgaaggattatgcaatgtatagtgaaacttcagtataatacactaagaaaaaacaaattccaaagaaaaagaaaactactagaatgttctatattggtcttagttggtctgtttttctactatatattatgtttattatacacttggtatatgagataaatacttattattgttttttagcattttagctttaaatagcattatatagattgtccagggaaatatatattatttccaagctcattacttcagcttgtacagttaatagactttatactatgcttttttatactactcttgatatatgttcaatttaaagcaatatagtaaaatttttaaagtatatttttactttatcttttttattcatttagaaagtcatcatttaaagctttgtttctttactcattttaacatatgattaccttgatttcagctagactctcttaaagcatagacatgataaccaagtgcggattgattgatatttgctaactgtatacgtactacttatgcagcataatgaataaagaaagcatagaccttgatgtatcctcaagatggcatatatgctatttccttataattagtggaaatattttcaaagctttctgaatcactaatacaacaaattagttgtattatttgttactttgtaaactacaacagatatatcaaggcagcatttgtgtgtattcatctttaattttatgactttattatttgtgactcatttatatagttttatggtccatacatgatgtaagtaattgttttctcatgttttggtattcactgagtatgtatatcagcttttgtttaagtatgcatttgtttttgtatgtgttgcatttacaatagattagaaatacatgagcagatgtattcttaactggttacttgtaaaacaacatttattagaacaagtatgaaaacattatcggcttgtttagtattttaacagaataattatatgctttttacaccattatccacccagttcccaaatcaaagaactggaagccacccagatttttacctctccccagtcctcttcctaattcaatatttctcaatcctttttattatcactcccctaagggatcttttaggtgttcctttcctaattgccctccttacatgaaattttaatactagagacatactatttatatactgcaggcctttggaggaccactaaccattgtattatctaagatttttttgttccctctaccttcaccaagaatcagttatccccttctggggacagtatcactcccaatgggaatgcatgttcaaatgagtcatcaaggcctactcattttacttctcaaagagaactcatgatcacagatttaaagttacagagaacagatgtgtttactcacctcaattttataagaagactaaaaagactaaaaactccatctaacatgaaactaggatttaaccacatctgtaaataataagctatagaaagcaattttcaaattcagtgaaatctgaaccaaaatgagaggaaatgccaaaaatagttgcttacttgttcagctattgaacagaatgtgaagctctctaaaataaatgtcacagccttaaaaagtccaatgaaaaattcccttctagaatatgtaagagctaggggaagttttagccctggagcaccttgaaacagtattttatacctcatagtagcagactacatggactcagaagaggaccatctcaggtctgccattctgtggcagaagcagggtattgggggactgtatataggaatcaatgtggcaaaagctattcagtataatttacaaataaactggtatagcatgattttaacgtatgtcttcattatgaaatcctatgaacattttgataacaacataactggtctaattctacccttattcaaaaataagcaataatattacatggtcacagttccccaggcatgacagtatagtttatatcagactaacttctccacatataaaactataaaagctgaacaagaacaaataatgaacaagaacaaataatgaacaacaacagcaaaaactattggaaggcctttgagagcaacaaagcaggcagaaatttgagtagtttcaatttttgaaaggaggggaaaacacaaggtaagtggtaagttcatcctagtttcctctgaagttactttccaatttggtgacataggataatagagccgtaagcagagagcagtgttcttacttactaggctgagaaaataaatttcacaattcaggaactgacagagaaactggaaattgtgagggtggaaggcttcaaattttgctatagaattccttcatacgttgaccagtgacctgtctatgcacagggaagtttccaggaaagcaaacaaaaagcagcagctggaaggccaaagagccaagcacaaattccagcagctgccagtgctggggagatggattggacttcaagttcccatagttagaggggtatgacaaacacttttgatttcttttaaatatctcagaagggccaaactctagaaataagcattacactctgtgaataatagcaaatctttaaacccaaactctgtacaagaacaagacgaaatctttctgtcaatcaaatgagaattttacctattttggaggaaaataatatcatacagagcctccacagggtttcatccacacagttttacatctgattaaaatttatgagtcatgtttaacaacgagaaaaaggactacctggctaaacactaacaagagttatcaaatagagagagactttaaaatatctgtgattaatatgttaaagaaatcaaaggaggatggattatttaacagagacctggaatccattttaaaaaattaaattataatttaaaaattaaaaaaaagtaatagtgggtttaatgacatatgagaaacagtaaaaccaaggattaatgaactagtcagtagaaagtataggagttgatgtacagagagaagagacagaaattggaggagaatataaacaagttgaacatgatgaaaaattctaatgtatatagagtcccagaaggagaggaaatgacagaagcaacacttgaatactgaattacagaccgacaattttccaggactgataaaagacatcaaattacaaatctgaaatctttacatacccaataatatatgtaagagagaaaaaaatcagcattattgtaatcaaagtacagaaaactaaaggaaaacatttcttaaaagaatctcaggggaaaaaagagataatatctttggagaagcaaagatatgactagctgaaatttcagcacatattatgagaccccaaatttgatggaatggccaaaagaaagaactctgaaaggaaaaaacaaaaatgtccaacttacaattttatgcttagtaaatattacccagaaatatctttcaggaaataaataaatgagtgcatgcatgcatagatagatagatagatagatagatagatagatagatagatagatagatagagaacaaagagaattcatcatgaggtgaccagcactacaaaaaatactaatgggagttcatgttgaagaaaagtatctccagttggaagcactagccttgaggaagaatgaagaacattggaaagagttcataatgataaaaacaacatcttgtggtagttaaaacatatgtagacgtgaaaaatatataaaatacctgagtgaaaggtgggaggggagtaaatggaagtaagttattgtacagatcttgcattattttgaaattggttaaaatgtctaacttgaggatttaagtaagtcaaagtgcatattttaatctttagggtagtcactaatagcataatagaagaatgcacaactcagatgctaatagttgaaaaaatgtggaataataaaaatacctaattaggcaaaaggagaagtaaaacaacaaacagatgggatgactacaaataaacagaaagtggtggatggaactacatctgtatcaataattgcatcaaaagtaaatgtactcagtaaaaattaccaatatcatagaatgaaaggggacaataatacatattatagatatataaatgatattgtaaacaacttacgatagtaagtttttcaattcagatcacagtgagcaaactatggccagcaggctaaatctggcccactgcctattattgtgaataaaggtttactggaacacatctatgcccatttcctaatatatcgtctatggctgttttcccgccacaacaattgagtggttgcaacagagtcgagtagttgcaacagagtcagtatgaaatatttactatctggccctttacaaaataaattttcctaaccctgacttacatgaaatatacaaattttctgaaaagtacaacttactaaaaatgacataagaataaactaaaaagctgaagagttatatatttagtttcttaaatgattctgtaattgttttcaaccttttcaccaagaaatatcctgacccaggtagatcctgataattacaaatatttaaagaataaatactcttatcttccacaattttttcctaaggaacattttgaaactcggtgatggcagcctttccttgatgcatttggtaaggacattacaagatagaaaaaataggacaaaatctctcattaaaatagagagaccccaaacaaaattttagcaaattgaatccagatagagagagggatgataaatgatggatgaattcatagatcattatttacagtttatgtgattatgcatataggaaatatataaaatatttctcttcatgacaaacttagcttaaaaacaattacagtccatttacatatattcaatccactaaaagaacctagaagtctatataaatatatatatataataactattagaattaatgaattttgcagagtcactgggtataaggttaacgtatgaaaaggaattttatttttatgtactagcaacaaacaaaccttaggaaatgaaatttacaaaatgccatcaatgtaatatagtcagaaatataaaatacctagaaataaatctaagacctaggaataaactaacaaaatgtgcataagccctcaacactgaagactacttatagcttcacataaaactcaacacatgtatgtgtgtgggaatgagatttaataaaaattacagagatcattacttcttaaggtccagcttacttgaagagattgaatataaatagtgatctaacttgagttcattttttagttctgattcttattatcaaaataggtccaccagacacctttaggaggtatttaatgccaccttgattattaatcaccagtccctgtgttatgaccactgaaaattataggatggatgcctggagatggcttcttaatattgatcaacaatattgatctactgtttgtggttagtaacttgtgtattgatccagatgtaagtgtagggctcatataatttttgttatttaacttttaaaatttttgtaaacatcattgtgaacttatatgcattattattctttatactacttgttccttcttaaggcttacaatagaattatggtagacttctaggttcttttagtggattgaatgtatgtaaattgattgtaattgtttttaagctaagtttgtcatgaagagtgggaactatcctgacatagcccctcgtgtcttctgaaaacattcttgctttctgaaagaaggtgttttaggacttctgttttttatcctcttccaaaacgttgtgtcagcctccttacattgtaataatgggccaaagtctggcaaatgaaggtacagatttgattgtcttacattacccatcacttctgtatctataagtaacagtctatgtttgggaaagtaagcttctgatgctttaatgttattttattatttttaaaaattcttgtttaaattggtttcttgtttgtctgttaccataatttaattgattttatccacattacttgtttgtattttaccatctatacaatcagtacatattctacaattgatggcatgtcatcgtttaattagcatttttctttcttaggagagagactccatacccccattccagaattacttggtctgataggcagaacaatgtgcccccgacaaagggttcctatatcataatcctcagaaaaatggggaattggggtgtcagatggaattaaggttgctattgtctgaatttaaagtagggagcttgtacaaggttatccagtgggcccagtgtagtaacaggagtgcttataagtgaaaaaaggagggagcagagtcagtcaaagacagagatatgacaatagaagcagaggtcacagtgattccacatgtatgcaaccagccattgttccctttgatgacagaggaaggggccatcagttaaggaatttgggcagcctacataaactagaaaaggcaaagaaacatattctcccctaaagcctccagatgaaacatagcccagctgacaccttgattttagggcttctgacctccagaactgaaagataataaatttgtgttgttttaagccaccaaaaaaaaatacataaaataatgatgtgtcttaatactgatggcatctttgatttggctgaatgcgtatagacactttatcaccttttccatttaatgcttaattatttcataccaaatcatatgtgtaatttataatgtggaccaaagtgttattaccaccagatctcattttccatacctatcagtatgaggtccccaaaattcatttctttttatggttgataatatttcattgtatggatttaacacattttgtttctctattcatcagttgatgggcatttgttttgtttccatccactttttgacttttgcgaataattttgatatgaatagttcatatatgtttgtgtggatatatattttcgattctcttgagtatatacttaggaatggaattgctggatcatatggtagctctagtttacctgtatttaaagtgccatcatattttctaaagcagctgcatcactttacatccccatcagcaatgttgacggctccagtttctcctaattctagtcaacctttgttattgtctattttttattatagccatcctagtacatttaaagtagaatatcattgtggttttcataaacctgctgttaagccaaaattatcaaactactttgctatcttcaagaattcactttgattctactgagttagcaattttttgaaaagggaattttcttaaaatggtagcatttttaaagtattagaagttcagtttctttcttctctgggattctttaattctctatgctagaattaggtaagtactcacctgtacagatcaatcagaacagaagttctattaaatgtaaaataccattctactataaagacacatgcacaagtatgtttattacagcaatattcacaatagcaaagacttggaaccaacccaaatgccaatcagtgatagactggataaagaacatgtggcacatatacaccatggaatactatgcagccataaaagggtgaattcatgtcctttgcagggacatggatgaagctggaaatcatcattctcagcaaactaacacaggaacagaaaatcaaacaccacatgttctcactcataagtgggagttgaacaatgacaacacagggaggggaatatcacacaccaaggcctgtcagggggtagggggctatgggagggatagcattaggagaaatacctaatgtagatgatgggtttgatgggtgcagcaaaccaccatggcacgtatatacctatgtaacaaaccttcatgttctgcacatgtatctcagaacctaaagtgtaataaaaaaagaactccccccaaaaaatcttatgtaccccataaatatatatagctactatgtacccatgaaatcaaaaattaaaacttatttttaaaacaaaagtataaaaacaaaataccttgggatctaatatttgctacttggacaactatccctatggtatacacaaagtaagaatgtttttgtcaccaattaaaaatatttttttttagcaaacagaactagcaggttcagtgttaccacacagctatagggttaaaattaacgtagtaatctaagcctatattttaaagggtttttcttctttcagtatgcacaatatatttcttgagtgatgtgagtttttagtagcattcaaaaaaaaatacttgcaaaaattctaccaaactagattttctgtcatctgccacccagctttcaatgtattcctgacactgaaatctgctggccagccgtctgacagatttcacccataggtagattccctattgttactgccactagttgggaaagtattattagtcataagcaatgcagaatcagagtcagtcttgccaagaactggaaccagaaagaaacaaaacaaaacaaaacaaaacaaaaacatgcatagaaaaccagagtcagaaaaaaagaaaacagaaagaagactgtgctgttgcctcttgaggttaaatctagaagccaggaaaaggcatccttgggcttatagagcccatgaaatgccctgcttggacaacacagctaattggcttaagtagggagttcatttaagtgtctttggtgggacttccagtactatcagaacataattctccaaattaaaacactaatcaccagaaaaatagcaaatgttggagctttaattaattagtgagaaaaccgacagtataacaagctgtttccaaagatgatccaagaaacccttgtaattttgtacatgtacatatagttattggggaaaatggaatactaaaattagattactaagttagattcaaaactggataatgtattctaagtcaatgaaactatgacttaccagttatccactctagagccagatagtaatcatatgccctttattagtttttttttttcaaattaacatctaactttacaaagaatataaaatgtttggactacaattataagagtaaatactaagtcaaaattttacacttctgtagagagtcaaatgacccttaggtgctcttgttagccaatgcacaagcatgttagggaatgctcaagaaaagtggccagaaaaccaatttggttggttggttgggtttgtcttacttccaagattggatattttgttcttactctgagcagttgggtagatgggtgcctataatgtgatatggaagattggagagggagcaggttttttgagggttgaacactttatgtttgagagccttattagatatatccaagcagatacgtcagttgacagctggatatataaatctggagtccagggctgagtacaaggtgcaggaaaacaattgggatctgcagcatatagatactacataatgcttggaaccaggtgagacatctgtggagttcagttcatgtagaagaatataggccaaagggctgggcattgaggagctcctacatttagtgataaaagaggatcaaggtcctgccagtgaggcacaagtttggaaaatccattagaataaagtatttcaagacaagggaatcaaattctttgacaaatgcatgacatattgagaggtcaaaaggataaagactggtaagtgacaggatttgctgtgtggagttattagcgactgataaaagacagttttagtgaaatgttagggacaaagcctgattcaaattacttcagaaaaaaataggagaggatatataaataactacttgagatttttcagcaaaaagtctacaagaagggggggatcaaaaggaaagggattttgtttgacttttaaagatgggttatagcacagtatatttctatactgatcactttttttcacttcctactcataaatctattcattcagcaatgggaagggggctgtagcagttttagtggtgcataaagtgcatgctgttatgaaatatcagaatcccaatataaccagtacaaaatgtaaaacaaaggaccaggagacaacagtcatgaagctagagagactgagtagctttataaagcagaaaaccttaagatgtgtcttaaaagattcagatatgtataagcgataggaataatttttcaagaaacagaagcagaacaaatgaaaggtaagaaatggggcagtagaaagcatatttgtgctgtaatcttcagattgattagattaatctgactgattagattctatgaactgcctcctcagttagaagaaatgaaaataccttaaatgtttttcattgaatattataatattatagactgtttaggaagctacacaggtcctcataaaagaatgcttttaagcatctggacatatattttttgagaaaaaaaaactcatattttattcagccaatcatttttcatataacttaaccccctcccaatgataacacttgttatacatatttttctattttttccagaacttttatttgtcaaaattgtagaatatttcactgctaaaattggatacccgtgaaataaacttttgaatcttcccagttcatcttaaattttaataataaaatatgatagtagacatttccctatactcttaaacttctttataaactaaagaacattgcccagaatttcacaatggtgtttttttgtgactgatattagagatggaaatttcaagctgtaatagaattccatctttatggaaataatgggaagaaaaaagggtacatgttaattaattcatactttcctttaaaggttagaaaatcatcagaagagaagttttcaataaccattgtggagagtgggctaaaataattgatgagagatgagaaaccactgctttctctgttgtaggcattcgattgagcatggacattgtaactatgaaattgaccaaatcctgacatttctgtagattctccagcagaattctgcaagtaaaatagtaaagaaaagcagatagagtagccttaaggatgggtggcgtattagataatgcattcaaatatgttggtgaagacacagaagaaattgaccataatacttatcaggaaagaaagtctcctggagttgggaatataaatcccacaggaaacagtttgggattgatcatacataataatactctcatttgtgtctcaaaaaatgtacataaaatgcatagcaaaattatcagatttgcaaatgacttaaaattttgagttaatgaaaaactgactggaataagttgaaagaataagaatcatttattattatcagaattttgatgtggacaagttcaagtaatgcagctaagtattaaaaattacaaattgtcctcatcaagtagaggtctcaattttcaattcacaatccatgaaggatcctaaggaccagtcttacctcttttccgtagcttataaactctccttgctgatcttgctctcccacctttatgaactcacctcataccaatttctctctcattatatatatgacaacaaacttgttacataatcccaacactttctgttttataatttataatcatattaggattttttctgactcacatattaaatgtcctcactgttaaagatgctatatcagctagtgtgtattttgtagttcaaaacaagaagtagaaaatgaagaagatcaaaatggtaataagggtcatataattagtttttgcaaatattttgaggaaacataaaattaagagggtcattttaggtgtatcaaaccaggtttttattagacagaaatgtactggtctagatggataataaagctgcatatgcattgtaatttaaaaggttgtaagaatcctaacatcattctcagtaaactatcgcaaggacaaaaaaccaaacaccacatgttctcactcatagatgggaattgaacaatgagaacacatggacacaggaaggggaacatcacactctggggactgttgtggggtggggggaggggggagggatagcattaggagatatacctaatgctaaatgatgagttaatgggtgcagcacaccagcatggcacatgtatacatatgtaactaacctgcacattgtgcacatgtaccctaaaacttaaagtataaaaaaaaaaaaaaagaatcctaacatccatgctccctgcttgcttgccctacctctcctcaactctcagacgtagtttactttggctagtagaaaggagtttttcccagctaactttctatgctgcataaaataattaacaataatatattctttggggagagaaggaatctattcaggtaaactggtacaagctggtaacatagacaagttttgataggaaagaaaaaaataaaaagaaatcagcctacatcatgcgagtgtgaggcactgaaagaaggaaatgagatgaagaagtttgtgtggaggaagtggagcatgaggggacaaggaaggaggagggaaaacttaatccaaaagcattttgttgttgttgttttagttttagtttttgctttctttgcagtcttagactcattaagcaagatgtgttagttagaatcccaaagggaaattagaacaaatactgttttcatttcttaagccttgttatgtggcacatttaaagagtgtacgtttttaaaaatatttttctctctggaatatatatgaacttttcttaataattgaaatattttagtttttctctggtaacatagtaactatactgtttacaaaattggtcagtaacattcatctccccatgcatggcatttgttgcacttatttttacaatctttaaaaagattctaaattattccatgttgaaatggcattgttttaagccatgtctagtaataaatactttgcaggtggtggtgtgatactaaagtatttgtaggtatagatccactactcaactgcattttctccctaaaaatgtgtctggattatttcaaaataaattagatttagaatttcagtgatgctgacctgtaatttatggatgcatatatgtttttactttgtaaatatagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacaggtgagtgatgtgaattcaacctaaacaactcaattcttttatggagagaaaaacttgatcttcatgctatggcttgtgatggaattgtggcatatttggttcttctttgaaaagaaaatttatttttctgtctctgaaaatctgctaaatttatgggtttattttttctgtacagctctcttcacaaggtatcacttttaaatctgtaaagtggacagattttttaattaaaaaaattaaggtcatatttgcaaatatgcaaggaaatgcaaagaagtattaaacatccaaatttatttacatgcaacgaaagcaacagggttctctttttcaaaatgttccataattcaattacttatttttggctatatctatactttttatagaaaagaaggtcagttgtgcaacgtgacatatactcttcaaggtactgtataaatataataattgaactgtacttgctatagtttcaatgtaagtaaaaacccagcagtgatttttactttagaaaaatgggtcagtggttttatgcaaggagtaatgttttaatacaaatatgtgtttcagatattttctgctgcttataaatttaaaagcttaatgtcctaaaggtatatatttaaaaagcaaatacaaaagggagagtggctatttttgtattgtaaaatataacaaaacactgcttaaaattatataaaattggccagacagattagattattcattactatgctcaatactatgtaaaatcaaaggtaagtgaaatattgaagcaatttaaatagccagcaactgttttttctcttaaaaccaacattggttccattttctgttccttaatagcaagagccttatcacaaaatttacttataccaaaaagctttcacaaaatcctttttatatctcactcagcattctggaaagtacctattttaaattattcattctactggatatattggcaaataaattagaagtaggaaatttgagtcatgtcttaaaattacaggattagaatgaacttagaatagctagcatccctgtgatagatctgcatctttgcccttccaatcagatgagctgttctatttgttatgaaggagaattatttgtcttctttagagtcaagttcctttacagtaagtataagaggcatttttcatttgtgttgtttcttttgtttaaattttttatggtggtgcttcctggtttttggtgttttgtttgtttgttttttaaattacactttaagctctgggatacatgcgcagaaagtgcaggtttgttacataggtatacacgtgccgtgatggtttgctgcacccatcaacccacacctacattagatatttctcctaggcctcctaggagatatttctgctatccctcccctaggcccccacctgctgacaggccccggtgtgtgatgttcccttccctgtgtccatgtgttctcattgtttaactcccacctataagtgagaacatttagtgtttggttttctgttcttgtgttagtttgctgagaatggtggtttccagcttcatccatgtccctgcaaagggcttcatccttttttatggctgcatagtattccattgtgtatgtgtgccacattttctttacctagtctcattgatgggcatttgggttggttccaagtctttgctattgtgaacggtgttggaataaacatacatgtgcatgtgtctttatagtagaatgatttataatcctttggatatatacccagtaatgggattgctgggtcaaatggtatttctggttctagatgcttgaggaatcgccacactgtcttccacaatggttgaactaatttacattcccaccaacagtgtaaaagtgttcccatttctccacatcctctcaagcatctgttgtttcctgactttataatgattgccattctaaatggtgtgagatggtatctcattgtggttttgatttgcatttctctaatgaccagtgatgatgagcttttttttcatacgtttgttggccacattaaatgtcttctcttgagaagtgtttgttcatattctttgcccattttatgatggggttgttcttctcttgtaaatttgtttaagttctttctagattctggttattagccctttgtcagatggatagattttattggtattgaagtaattctttacagcatgaggtggtggagaaggttttgaccaccagacttcaaaatacttaaatgaaatggaaacgttatttgatgtccttgaaggaaaccagtgtttcctatgtgagagattgtaagtttacaagttggttttacttcttccctcaactttccagtctgtctttttctctctcttctccctctttaccctcttttcccctctagctagttagtaccctatcattcattacttgagcatagttttcttataaaacacagcagtaattttgcataaaaactatacttgtggctcatctttgtattaataagtaatgggttcaaattatggtcatcaaaacacttagcctctttgcttttttcatttatgttttatctcagttatggtcagatgttgacttcaaataacatcttccttcccagaagatgtattgttaataacttcatggaatatcctcttttcagagactggattccagtgtacaggtggaaaaaggaaatgggattatgaagccaagataccaaaatatgtagttctgttccaaagtgactcaacgaatgaactttgacttctctctacaactcagttttcttatataatgatgggttgaatgggatgtcctcctgtgaactttctatgtgtaaaattttatgcttctctttctacataataattttacctttcatttgatagcctatccttagatttcaatcttcttgatctttctaaagcaagtgacaaatgttgataaccctcaattatcactcctctttgttttagtgcatagcctgatatttctctttcttaggacttcccctagtgatttttcccattcatttaattatctttcatctctcctacagagatttaacaaaattcagaattattctaagaaatgttagcttttattgcttcagattctgcattgaccatgagatctgtatttctggattcctcttcccctatgaaatattacttaattttaatctcccataagaaagcccctcttagatttctctcttaaaataacttcggattctcttaattttcagcccttactttcaatatagatagaaagggtatgacgtagtaaagaatggtaaattttaagaaaatgtccccaagccagaaatattttggaattgaatgaacctccaggtaaactgcaggttgggttttaaaatgtaaagtttttaatctctgttgattttagtggcccagcctgtgtaatgtaaggaattgtctcccctcactcaatactaactgtataatattccatataatatcctatatcttctcctcacttgaaaatgaaggcattattgggaaggttctacaaatctgtgcaaagtcatttctaaatacacttttgaaattatactaatcagtatcataagaatgataagtattcatgtttctaagtggataaaagtaatatgtctacatttctagagctttttccatgctctcttaagttatgtttgtgtgagtgtatacaatttcactccttcattggtcacaagaaacttatgaaatgttattattcccatttttttcttttttatttcattttatttattttttaaattatactttaagttttagggtacatgtgcacaatgtgcaggtttgttacatatgtatacatgtgccatgttggtgtgctgcacccattaactcgtcatttagcattaggtatatctcctaatgctatccctcccccctccccccaccccacaacaggccctggtgtgtgatgttccccttcctttgtccacgtgttctcattgttcaattcccacctatgagtgagaacatgcagtgtttggttttttgtccttgtgatagtttgctgagaatgatggtttccagcttcatccatgtccatacaaaggataagaactcatcgttttttatggctgcatagtattccatggtgtatatgtgccacatttccttaatccaatctatcattgttggacatttaggttggttccaagtctttgctattgtgaatagtgccgcaataaacatacgtgtgtatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattttaactggtgtaagatggtatctgactgtggttttgatttgcatttctctgatggccagtgatggtgagcattttttcatgtgtcttaagaaaacctaggcaatgccattcaggacataggcatgggcaaggacttcatgtctaaaacaccaaaagcaatggcaacaaaagccaaaattgacaaatgggatctaattaaactgaagagcttctgcacagcaaaagaaaccaccatcagagtgaacaggcaacctacagaatgggagaaaatttttgccacctactcatctgacaaagggctaatatccagcatctacaatgaacttaaacaaatttacaagaaaaaaacaaccccatcaaaaagtgggcgaaggatatgaacagacacttctcaaaataagacatttatgcagccaaaacacacaagacatactattcccattttaaagttgaagacactgagacttagagggattgggtaatttgcccaaggtctcataactgattgggcctgaatttaaacccaggctacctggtgccaaacccatgcttttaaccaacttgtgaagagagagagagagagagagagagagagagagagagagaaagtgagtgcaagcacatttgagattttgaaataagttcaagcatttattgaacatctatgtggttagtacatgctaggcatcatgccaaggcactgggataagagctagggatgaagggatgaatggcatactgttcctgctctcaaggatatcacagtatcatagagcaaatcacatataaatatttcagctcagaaaagacaattatattaaatacaagtgtcagagtggtagaacggaagcacaggaaaggacgagaatcattccaagaggctttcttgaagaggtaaagcctgagcataaaaacacaaataaatcaggataagtacacaaggaaggactttgcacaactgagggaagagtacttttttttcattttctgaattatttatatctttttttaaaattatactttaagttttagggcacatgtgcacaacgtgcaggtttgttacatatgtatacatgtgccatgttggtgtgctgcacccattaactcgtcatttagcattaggtatatctcctaatgctatccctcccctatccccccaccccacaacagtccccagtgtgtgatgttccccttcctttgtccatgtgttctcattgttcaattcccagctgtgagtgagaacatgcagtgtttggtttttttgtccttgcaatagtttgctgagaatgatgctttccagcttcatccatgtccctacaaaggacatgaactcatcattttttatggctgcatagtattccatggtgtatatgtgccacattttcttcatccagtctatcattgttggacatttgggttggttccaagtctttgctattgtgaatagtgccgcaataaacgtacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgatcaccattctaactggtttgagatggtatctgattgtggttttgatttgcatttctctgatggccagtgatgatgagcattttttcatgtggtttttggctgcataaatgtcttcttttgagaagtgtctgttcatatccttcgcccacttgttgatggggttgtttgtttttttcttgtaaatttgtttgagttcattgtagattctggatattagccctttgtcagatgagtaggttgcaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttatataaggtataaggaagggatccagtttcagctttctacatatggctagccagttttcccagcaccatttattaaatagggaatcctttccccatttcttgtttttgtcaggtttgtcaaagatcagatagttgtagatatgcggcattatgcgagggctctgttctgttccattggtctatatctctgttttggtaccagtaccatgctattttcgtttttgtagccttgtagtatagtttgaagtcaggtagcatgatgcctccagctttgttcttttggcttagggttgacttggcaatgcgggctcttttttggttccatatgaactttaaagtagttttttccaattctgtgaagaaagtcgttggtagcttgatggggatggcattgaatgtataaattaccttgggcagtatggccattttcacgatattgattcttcctatccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaattcttgtggtttttgcacattgattttgtatcctgagactttgctgaagttgtttacagcttaaggagattttgggctgagacgacggggttttctaggtatacaatcatgtcatctgcaaacagggacaatttgacttcctcttttcctaactgaatgccctttattcccttctcctgcctgattgccctggccattgattaaatgttgaaaatggtgcttagtttcctgggatatgagaaagaaatctgtgtggaatctaaaactatatgaaatacttctctaattccagtggttacctcatctcaggacagatctcaaatcaaataagctccgtacaactgagactatgatttctaatagaacttttaaattttatgaagaagacatctataaatgtaaaatatcagctttataaactagaaattactcaatttactttaacttgtactattgggtaactgtatctgcagtactatcccaggcacagtgggtgtttcaaaaatagaagtatcatttacactggaaggaaatcattcacacctgaaatacacatgaaccaagcaacaaagtgaaaaaacataaagtaaaatgcccgaaataataaaatctagttctatttatgtatgttatcaaaggtagtggggagacaaattggtcaaggatctaagtccctaggatgagggcacatacagaattggtagatgatttgttctaaccatttagtaaaattatttattatatcattaacagctgagaatactttgttagcataatatcttttctccaaatactgacaagatgttgatgtttatattctaattatggaaaatattgcaggactctttcacaattttcaaacagttgtcaattatgatgtgctatgaatgtgttaaaaatcacttgtatgcttctttagtaataggtattctgtacctttccaatatttttccactatcaaagtttatttctcccctgtgcagatcctttccttcaagaccctgtttaagaccctctaactctatatgttgtccccaattatttgaacagtttgtttttctgaattcctaaatagagctctctgacttcactgtcaacttgctgcccactccactctccattttgtcattcatttcagctccttctctctgaccatctcattcatctctatcttaattcccctccacaattagatttagcacgcagttcttgtcatgggtgggaaaggctagaacaggatgtactctgggtgggagcccaaggggatagggctaaaaggtctacaatgggttagagtgaggctgccttcaccatccctaaaatctgttcacatgcatggtgctggggctggcaagatggataaatggaggtaactcttatgaacttttcttcagggagcttagcattaggaaggaaagagatcaaatgtagcagtccttttttctttgattctaccaacatttattagcacttttcttgtaccagactctgtaattgagggagtagtaagagtaagatgggtgtgtgtgtgtgtgtgtgtgtgtgtgtgtgggcatgcatgtttcagaacaaaggaatctgatcatttttccaggtgaagagtggatataacacctctagatggagagactgaaagatgatacgaataattttaattgtgcagagttccagagaacagaggcgataattcaagaacacaagtttattcttggagacagagaaggttgatttttttccttgagtatgacagaaaagaggaaatggctgaaatacaaaggaatattgcaatggggatattgaaagctgaaggagcttgagtcagaggctgcttgatcttctcagtgcaaatgaggtattaacaaatggagagagtgaggatatagggtgagcaatgttgtaagaaattaattggtatgaataaaatcctgctgagcagcacttatccagctaagtttggataatgcaagtcatgtggaaagtaactttaaaaaaacatttatcagggatcaaggcctcccttgcaggtatctggttcacattagctattcttttgtctttcaagattgtcatcccctgcctttgtgcatctccagtgtccttgccaaggtgtctgaaatgaccataagattctttgagaatatattgccacattctttaagacttagagaaaatatctggttaagtctagattcttaagcccatttaatgattcacctgtcttgggctgctatttactgtttagtttgactctttttagcatgcatattattattattattattggagaaaattgaagctctgctctttcattcttatctattaatattgtgtcttctcaaggaaataagaaaatcttactcctttcttttctttcttcttcttcttcttttttttttttttttttttttttgtgtgtgtggtcttgaactcctggcctcaaatgatcttcctgcctcagcctcccaaagtcctgggattactggcatgagtcaccacacctggctcattctttttcttaatatggctctaaatggctttttattttttttgctttggcaatttatttctaggaaattaaataattctttcattataatcaagggaatgaaagacttcaggaggtccatagtggagttcaaaaccatatggagttcactattctacaagattatacaggcaataatataagtattctaaggtgttttaggtagatttatagatgttagatttcaaaatgggttaataagtgtttatgaatttccaaggtgtatcactaacttctcaagatgaaatcatatatagaaactatcaaaattttccttgttctactgtcaagaaatgaataatatacactgatataactgtaactcacatctaaagggatagtgcttgaataagctaatttacaatgagttcaaggtattattttaaaattcttatggtccttagacaataattatgccaacaaatgtgaaaaatattaaatctccttctgttaattttttccagttttattacccaaaagtcacacaggtaatgcaagtcatgaaataaatcaaatgagcaccttcctggagagcctactttatttaccttgggaaaatggatgacatttgccctaggacttatttttctccttctaaccaatacagtttaccaaaatgttctctggtaattttaagtctggtatggctttgtgaagactctctgccttttctcttagaaaaataatgttatagctgcagggaaggaaggctaaggtggtgtctttgaacattctaagaaatgttttcttggctctgttgattattaacaatataagccaaaaattcttacaaagtatgtaggcccttccaagtttcagaaactgaaagctacagtggatcaaaatattgctgaaatctaaattccttatttgtgccttattgcctcatttacttgattcatttaatggcacaagaaaaacattctgaagaatgtaatatttcatgttctttgtttcctgaacacaaaatcatggtaccagaaatgattctcaagttggcgaaaccatcaaatgaatgtaagcatgggttcttttatttactgttgctgtctgccttaggaattcactactgttaatagagattcaattcagctaaagtaactcatcttctaaagagatgccctaataaggattagtattttcaaacatactccagctggtctatgtttgttcttttccttgctctgaaatataaattttacgtttggctaagatatagatatacttttaggttggcttggcagaaaaaattattgatttcagtggaattaatttttataattaatttgtatttcagggtttggaggagggaaggaaactaaatttattaagtgccttcaaagcacaacacttagcactaaaataattacacatgttgatatttttaactatactaagatgattgttaagcatgagatcagtttcaaaataggtgtcacaaaacatttcaggcagctaaagatgtaacaagaaatgtgtctgattatttttaagatgaccaattttaatacatccttatttaattcagagtgttttttcatagagatttttgttgattgattttcacattttaaatacagaaaggcaaaaagaagatatataaaactcctgtggtatcaccactaattgcaaagtcagtgtgaaaatgatagtttattattggataatttttctatgcatttgtattattaatattgataaaaccattagcaataatagttgtgatttagtgagcaattattacatgccaaccagtgttttaattttttacatgtgttaattccttcaattcacaaaaaacagccatgaaatactcttattatttgcattttacaggttccatgacttgtctgaggtatcacaactcttaaaacttgaagtagagcttatgttctcaaccactttactataattccgttccaactgtatgttcacacagagagatacctttttgatagagattttttaaacaagcatagatttataatatttaattttgttttataatcttgccttttttcactttaaaaaatgtgtatttaagaccacttagtacaccatcacgggatgcttgtactagggtggaactggaaggagcttagaattatgtcttagaataaacagtcttttgtatctgagcatttgggcaatagggagaagaggaatattagagataaggttacgtgatgttaccatttactaagagggtggttgttgggaaaggaccacatttgccaattctggcagtgttgagcttgggaccatcataggaaatgtgttttaggcaatttgaggatcaacaacatagaactggcaattgaaatcaatgaagttacttaggaaagaagtataaaatacaagtaaagaggatctagaagaggctcctgcagaaaacaaaaagttaaaggtcctttttgaccctccattttcgcaactataatatggaaccataaatggtacctacctcagaagactgttgtggagattaaataaatgttttaaacaatttagcaaagtacctgacaagggatcagtaataataattagcagttttaataattctggggaaccaaatacaagggtaagtagataaagaaaaggtatcagtgacatcgttcatgaatagcagtcagagttagattaatccagctaatatttttatctgttcattacatgtagttaatagaatacaagaatagaatcttaagatctaacgcttgagttcttctaagtcagtatttctcaaagttcctcaagtcaagtccacctttgaggatctggtgaaatctgttagtcctagcctcagtaaattgcacttgttcacatacgccactgtgtaaacaaacatgaaagatgtttatgaactcccagaagtatgttcatcccaaattaggcataatctgccagacagaaatccaagttttctttttgccagttccctcccttctgctctgttactcagccttcactctattaggttagaggtcaccaaagtctggcttagagtctggtttttagggcccatgagagaataaatatttttatgttttttaaatggtttaaaaaaataaaaatgagaataatattttgtgatatgtgaaaattctgagaaatcaaatttttatgtcaataaacatagttttattgaaatacagccatcttcattcatttacatgttgtctatggctacttgtgtgctacaaagtcagagaccgcttaatccacaaagttataaatatttactgtctagtcctttaaggagaacattccttaaggtctgctgtaggccaacaacttagtgcctgcaatgcagaagaaggtattagtgaacaataatcatttctatcattgttctctgcttctcagagtcaggagttaatttaccctacttccatgactttatttttttccatatacctgtcatgtttacatttataccatacgtctattgatatctcttgttagacacagtgattctcagaacgaagacttatgcccccatagataagactctttatatcttcaactttgccctaaaattgatacctggcttagctgtttacataaagtagtaaaagcacgtcactcaaccctaattttcccagttgggggctcaaggaccaagtctgtgatttcagtgattgtatcccagtatgtagcacaaagcctgtaccacatacagaaaagttttctggaatgaaagaaacttttggaagagttttctgtattccctttctttctgaggccactcagtccccctcactgcagtctgaattctgtctattcgatttccccaaactgttcttagtagatcacagaaagtttatagatatgaacttattttaataatttaacttatggtgtaggccacagatattgtgcacatgtgaaaccaatgtgatgtatgtaacagaaaaatagtaaaaaatgtccacttttatttgacatgagcaaatgattcttatttatgttccatctcttaaatgtgtaacttcatttctttctatgcatcagacctatcttcctggggttcacagaacacaacttaaagcttctttctttgtacctctctacaggtgctctacccagaaaattcttaatctgtcagtttgtctgtcaaaatctttctcttcattcaagccctacccaaatatcaacttcctaccaggaccgaaagtaatttttttaagtcctataagacttttagggagttctcatgtggtgctgtttacatctgtagaattcatgtcacaaaatgaactccgaagtaaatcaagggtaatgaccacgcaacaggttttttctggtctttcacaacagtgcatttaatgcagaagaatcttgataaacgtctgttagataggtgaatgtgatgtttgcttagtcaaaacataatgctcaaatggtaattaattgatcaaatcatggtataatatttcatttaacattgtgacaagcaagctcttcttagtgggtaaatttttcttctatgtttggtttgttattcttaggaaataaaaacatgttttttaagttgtaacaagtacagttgactcttaaacaatgcagtttgagcttcgcaggcccgcttatacacaaatttttttgtcaaacaaatgcaaatccaaaataaagtattcatgggaaatattatagaaacctgcatatgcggagggatagctttgattttggtatacatggtggtcatcctggagtcaatccccaacgtttactgtcggacgactgtagaagtgatttgtctattactttgcaacctcccttttcctttctttctcttctttgcttatatatcacttcaaaagcacctgaacattgctctcgatagatttaaccagttaattctaccttattgcttttaaatattaactcttttataagcaagaataaataattatcattttaagattttgattttttaatagattcagagggtacatttgcaggtttgttacatggataaattgcctaatggtgaggtttgggcttctagtgtacccatcacccaaatagtaaacactgtacccgataggtactttttttcagcactcactccctttactgccctctcccctttgtggaacctccagaattggtgctgatttaactactttaccattacagtaaatgtcaaataaagtaatattttattagaaaattattgaaagataaaaatgtacatttatgagaaataataatgattgataaagatattaatttacaacatccttttatatcatttataaaaggtttattaaccttatgaaaatacttaagtatttaagcaaaaatgcccagattttttgggaatctttcttttgttgggcatagggccagaggaggcttgtgaacaaaggatctactgtaactgcttttcaagtaagctagtgaattcttacttgggaaacaaacctctgatattgaagcagtacattgtgatactcattacaaaatcatttatactgtaaagattattttcttacaaccgaaaaatgtggtacacccaatgattagtcatagttttagtgaagcttaacagactttatgttctaggtctacaaggaggtaaaaaacattctgtgttccagattcaaagtcagtgccataggatgtttttgtaaatggaaataccatacttatttttctcttaatttgaaactatgaagattctgacaagtaatcaaatagtaaataattatactacatttaggaaagtttcaactgaaagagattaaaacttatttgtaataactaaagttacatttataaataggcatatagttgcattgaaacactgctatatctagtgatgtaatgatgtaaaagtatattagttgggaaatataaaaattaacatatatattaatatttttatcactctgaatttgaaattgtaagaatgaatatttgacctgtctacctgcattatggaaactgaaaatggatgtaaatactctaatgaggaaggattctttaaaggaaaggatattgattagaaacttaccggaaagggttgattagaaacccacaggaaaaataaagccaaaacaaagttaatcatctttaggtaacttaacctgctgctgaaaatactagttcctgtttatagtttctaccttgggaagtacactcaacctattattcaattgtttttaaaaaggaaaaataaaacagaagaatcattttaagaaaatattacataaaatttatagagatttataactagtgtaggattctgtgatcttcggctaatcaaagaagaaaacatactaattgtcataggttttggagacttattgagaagattgttgtgaatagcaaggaaaatagtaggaaaaatttacctttgaagtaaaaatttactctcacttcagttctttggctttctataatgcttaataattctgtcttctcatggatcattctttattctctttcaaatcacagtttgaaaagtatatttttgtgggaaaaatatttaataaatcacagaattttaaaaatctaatttttgtacacagaaaaaaggaaggaaaaaagactaaattcagatattttgatgttgcagtaaatgtgttgaccatgataataaagcatattttttccagagctgcttgaatttgctctcagtgcaattgcaagtattgactttaatttctgagaggtttgtagcttcaatgatgagtcccttggtgcctaaatcaaagtggctctgtaataagtgagttctgttgtctcctttctgctgatggcactggaggcaacagcatgtcttctagaggcctctgtctgtgcttttcttttcatattcagcatgtcctagattcactggcccagatagcacaatacagcaggcagctttttactctgtaaatggcttagtgacattatttaaagtaatgccagttgtctattcttttgttctgcttttatattttcatagttgttacccattgcataccctttggctgaagcgtttgaaaatatcctatgccctttagaatttggcactgagcactctttatggtacataagaagtaaaagcatttatcttgccctggagttatttacaagctcatttactaagtagtatatcaacaggcaaagagagattctttctttatagaactttagcttttacaaagccctttcatgctcaccagctcagagtgcaaaattattgaaagcttttaaaataaaaggctgatcagattgggaaagattaggaatgcattaactaaggaaagcgtctggaagaaagtgacttttaaagtagaatataaatatctgctttttattcctcaaagtttccataaattttaatatattcttaataattcactttcttctcatctaaaaaataattgtgagaattaaatacaattttaaaggagcataaacatttcatatttatatacatggtatatgaaatgtaattttttagagaatttgtttttagtaacatatcatattgcatttatcttatttattcttagttgtatcctactcacctccccaagatgtaaaaaaaaaaaatgccattagctctgttttaagctttacctttgttcccaccattaaatttttaggtcagcactgcctgaaaccagcaatcatttccactgaacttaaatggctactgtttttattttcactcatcactgacagtcatgtttaggtgatgtcaaacatttatttcattcattccacagatattgatcaagtgcctaataattactaataagaatggctaagagttgttcagcccatattatgtaaactggtcctttgtaaggcttataatgtgtattgtcacatttaaccctgtcagcaaccctatgacattgatacaagagactgtgacacaggaccctgacaattggctggattcttcaaggaaaacacagaagctgagagaagttaagtcacttaaccattgtcacacagctagtaagtggcaaagaaataattagaattttagtctgtgcctatagcctcagtccttaaccactacaccacatgccttcagtatgtttaaaatgctattatatactagttaaatgtataattgcctgtaaatatccagaatcttcagtgtcgatggtgagcattttgtcatttataaccagaaaaatatttaatttggacttcatttttttacaaggagaaaattataacatgtatatctatataattttataccctaagactaagctgaagcacaccactatttttcatcttcagtgatatgcctcactttattagtcccatttacttatgaggaaattgaaacacagagaggtatgtaacatgcctgagttcacatagtaagggcagagctggaattggaatccagcagttgggctacagagtctgtgctctaaatggggcatgtcattgaagttggccgaggaggtggcactgtcagtgaaccttctgactctgcaaacgttttactgtacaaccatgccagcttcttggtagactatcttaaactgttcagaatgtttctgtatacttacaagaaaactggattcatttgttctgcttatttagctaattcactcatccacagggataagcctaattgtagatattaatgaagactgggtttatcaggtacatacaatgagtcatactggcacaattctagcactctaaaacaggtaccattattatcatcattttatttagataaggaaactaaaactcagaaagattaatttgcccaggatcacatagctaataactgataggcacagtatttgtgtggtagaatttattcttagccatcatactattatatcatcctcaagtaatttgatatattagctaacgtaattctagtttttataaaaatttaccctaaaagtataaaggctcacatttagtaaaattctatttattgttaatttaataatttgaggcagatgctcatggcaggcagtcaactctcctctgtgcagtggttcaggtgcccaggttctttacatgttatgcatttttgtcatttgaatccatatcgcaaaagtataaaagggaaatggagaacatatatctgactactaaaagccttgttctagaagcatcacacatcattcctattaatgctctattaatgacagttaatcacatggccaagcctagatgctggggatgggacccgagaaataaaatccctgacttagcaaccacttactatgaattctgtaactggaaaggggagaaaccactaactgactgtcacacacacaacttgaaaaggctttcattataaataattaagtcatttgagagtttacattcttttttcttttttttttttttttttttttttgagatggagtgtcaatcttgttgcccaggctggagtgcaatggcgagatctcggctcactgcaacttccgtctcccgggttcaagtgattctcctgcctcctgagtagctgggattacaggcacccactaccacgctcagctagtttttttatttttagtagagacggggtttcaccatgttggtcaggctggtctcgaactcctgacctcgggtgatccaccagcctcagcctcccaaagtgctgggattacaggcatgagccaccacgtccggctgagtttaaattctgttctaaagtaaagtctgaaaatactggtgctttcttatgttactgtaaaatttgtgcactgacaatgtaatttgagagcccctttatccgagtttcaaagcctgtcagaatccaaaactgaccccacaatttctattcattcgtcagttttaaaatttcctggcctcttttgactcttagagtccaggttcccctgttcaatacaacatagactgcataaagcttagccatttccttgctttataaaacaaaacagaacaaaaaacgtttgttcatgtccaggctttatgagtttaatagactttgatgaagaaactgttagtcatggggggattggagggaaggtgattgggaagtggtcacgtcacaaagcacacattattttgctctttttctctctcttctctctcacctctgatactcagttactacttctggcttgtttatgtctacaaataacaggcatgtacatttatatatcatttactcttccaggttgttttatcaacactatttaatctttaaaacaagccaatggaataggttctgctaacatttttcctgtatacagtaaggaaattaaggtatagagattaagtaactgggggttggcagagctagtattaaaacccaggctttggccgggcacggtggctcacacctgtaatcccagcaatttgggaggccgaggaaggtgaatcacctgaggtcaggagttagagaccatcctggccaacatggtaaaaccccgtctctactgcaaatacaaaaattagccgggcgtggtggcacgtgcctgcaatcccagctactagggagactgaggcaggaggatcacttgaacctgggaggcagaggttgcagtgtgctgacatcatgccactccactccagcctgggcaacagagtgagactccgtctcaataaataaataaacaaacaaacaaataaataaaacccaggctttgcgcctacatattctgtcttcttagctactccatggggacagttttctcactatggaaaattctagctcttaagctagaactctattttattaaatttacttctaacactaagcccaattttttttaatttttgtatgtacataaaaggtatatatatttatgggatatatgagataccaatttttaacctactcatgtatttgctgtagttaaaataattgtaatgattacagagcacatctttaacaaaaagaagtaaaatgtgtaatatctaaaatttggaattgcatacattttgtttcttagatgctctgtatgctatgcccagtgttactttttaagtgagagagttgctgttgattaactataggagacttgatttatttctaatttttcctagtactgttttgctatgtagaatataaagattctgatgggtatattcagttttattcaccttgtatttgtaaacccatagaacatctacccacatctaagtgtagttggcaaacctctttagtgctttagaccttttggggttctgttaacataagtctaggccaagaagtaagtctaaacatcacctgaggtctgccctgttgctactttatacataaaacccaactgccaatgttagattttacttttttaattcttttttttgtgctcagtggcatgtttaaatattaaacgcgaggaatgttcatagacctatatagccaaattggtgtggggagaactgttatgtgttgtaatagtgcaccgaaaatgctatcaaccaataaggtagacaatatcttagaaaggagagtgaatacatgcattttgtatacttaactaaagttttattttctgtttttaaacaacagttgtgtcacttaataatttttgacaaaatgaaaatacgggttaaagggacatacaactatcttctagtcaatccatagttgattttatattgtctctaaacttttatattgtctctaaacttcatctttcactacttacataaaaatccctgtaagtattacaatttatcatacccttaaaaaatagtttatttagaggatttacttgtattacaactaaatcttaacttctcaaaacaagaaaatatatgtatttacatactgttgttagagcaaaaataacctggaaaataatagcattacaatatatttggggttgtaaagatttttaaattattaaaattattgttccttgattgttccttttttccttatatccaaaaggcgaattgtgttattattcctcttttgtatgcataaagatgggtgaaaacacctttagaacaagcagctgattttttacactgaaaaattgtgcagcagttatgttatcaggttagagactgccagttcgagatgttggatatttccacctcctattctgcatgatattttaataaacatacatgtctcccatctagtttcccagtggtttattgcttggttaaatgaatcgttgagctccctatgaagtcttctgacatgtctaattcgatacctgtcatttataaccatctttccttcctcccccaacaataacaaaaatatcataatgagcataataatcagatttgctgataaaatacacttttgacgtttctgtgattacacataacgactcccactgttctcagaagattctgttgttgcgttctagatacttatttggcttagacatctcaaaaagtacaaagaatattgtatatcatcattgacgtaattcttccacataatctggaaggtgattccagtctactatattaagctttcctgtgataccccaaacacaggttaacattatatatccagtcagttgacacaacaatctctaaattatgtccactttatgctgacaactgaccttaacggtatctttagaacataattatttcctatctttggaacgtatgaactaaaaactactttaactccaaatcactaagcttcaagaagacttgaaattctatggcttgctttttggaatttggaaatgtactgccaaggtaagtttaaaaaaaaaaaaaatgatgttctgtgtttcttaaactcttccactgaaaggcctctaatggcaaagggaagtagtgcatatctccagaaagacagggcatagcctcaaacagcagctaaaagaggaatattcttttaagtcttcaattttatctaaaaaataatgagatgtgtccaggcacggtggcttacacctgtaatacctgcactttgggagtccgaggcaggtggatcacctgaggtcaggagttcaagaccagtctggctaacatgatgaaaccccatctctactaaaaatacaaaaaattagctgggtgtggtggcaggtacctgtaatcccagctactcaggaggctgaggcaggagaatcgcttgaaccccagaggcagaggttgcagtgagccaagattacgccactatactccagcctgggtgacaagagcaaaactccgtctcaaaaaataataataataaaaaataaaataaaataaaatgagactttagccttctgcttatcatatactaatgtttactataaaaaattttccaaaatattttagtataaaagagcattcttctctaaattctacctttatctttgagcttcaaatatcctctgaaacactgcttaattcctcctatgaatataattcaaaattttaaagccagacatacatatctgtgggtgaacagcaaagattttttattgcagctataggatctgtgactacaggataaagcacagctaaataccacagatatcaaacttctttttacctggcaccaaaatttgtctaagctattcagtaatttgtattgagttcagtttagcctgtgggccagagaataaagattattttccatggagcctctagagaaaatatttcccattaaccttgcaggtttggggtggctttgatgtttaatcctcaactaggttcagttggagggtgagtgggaccagcactttgggctgaaatgttctcatagcagcccaagggcatcctgcaatccaccatctctttactcagatgaaggatcagttctgctgctgagtggtgcacatacatgaactgcaccagcctctcatcctgggataggaatattttatgggtagaatattctaaggtgtaacaaatagacttaggggattgttctgtatttatgtttacttgtattagaatatgtaccgtactgagagtcaacagacctggatttcaggtgcctctctgccagaggctagctatatgactttggcaattttcttttcaccttttcagccagttttctttgcagcaggttcatggcattggattctacagggtctctaatacttccaagctcttcagtctatggttctgtaacttgtttttcacaacagtgactttaatcaaatccttctttacttgatttttacatacatatgatattcaacatttagcacttctgtaagcttggaaccaaacttgctcataaccgtatctcagtcataattccactctgaaattttctgaaatttgcattattggtaattgacaatgctaaaagtatcacctaactttttaattttctctaaagataaacatatattaggtctggttcttcatagagattgagacatcaaaaaatagcagtttctgagtgatgctcaacgtctttacatttcacttttatgcaactataactttcacacattatacattgatttcaaacacagctggtgcccgttaggaaacaattcattttaaacagtatcaccaccttgtctgtacagcacagtagagtcccaaaacaattactggatttatatatgaaattattttttcccttttgctgctcatagaagtaagtaaagaacagaaagaaaaaaaaaaggtgctgatagattagaagcataggtactgtaaaatataatccaacaaaatataattaaagactatggccaggagtcaaggtagataatgaaagtgatagagaaatctttacaattctgtttttaagatcattatttctgaaacatttcaatgagtatttttctctttttttaagtgagtacttttctcttttttttagtgagtatttttctaatacaaagtaaagttctcatttgtatgagaactggaacaaatattttgaagtggctgctgagattccagaattactggttagcaaagactgctttgataaattcaacagaatttgtgtttgcaaaatattacactttccagagattacgtggggacagagaaagaagacatttgtttaaaaattgttctctgagatatgaacaaagaaggggaggcagttaagtttgtcaaggaaaagcatgggttttgaaatacttatattctattgaaaggaagattttaagataaaaagatgagagaattaatcaatagagccttgtctattgattgaaggcaggagggatcacatccagcaagaggaaagacaccttttgcattgttacaggagagaaagagggaaagaatagatgtgggaagtttagtggtacagtgatctgacacatcaggctccagctaactacctaggtgctacctaagtccataggtaggtcttcagataatacactgactgccctcagagggcataacagagccttagccataaatatcagatcagatgagacatcttaaacctcaaagaggccacctaagggtcattctttaatctcctatttattgtgttctctaggcttcatctttacttttaacttacatcattagaaagcaatgttctgtgttgagcaagtaaatgcaaacctaccaccaaaggccaacagagctgagaggccaaagaaagaggctaacaaatacagtttatcagaaagaattattaactagggacttacaaacagaagtgatgtctcaggtggctgcaagatggtggatccttgcaccaatctccagaaagaattctttatatagcaagcttttaatgtgctggtcacatcttcagactttcttaccaaatgaccactggggagattagataaacatcttcatgattatctatgctgcaggcattgtttaaagatgttactgagaacacctttacatgtgggagtcaaacattggttattagggtggcttcacttcaagatagaatcgctcttgccatgcaacaggctgtttccctaaaagcaatttgctttttttttttctttaatccagagactgacctttccaaatatcacaaagccagttaggcacgtcttcaatgacctgccttaatattgaccatttcacactataatataaatagcaaagctcattaaattaacatatagcacccatagagtcatcaaaacgtccctagtacaagaaaattaattgactactatattttgatgtgcatttcttttaactaaatgtgtaaaatagcaagggttcctttccagttgaaaatctcccttcaagggtcatgtgagagaaataacacaacacataaatcacaaagtgcatcccaagtttgagtttcaaaatacgttattatgttttaaagtgatttcttcccatgagcagatatctaaagaattattgtccaaaatcatgacaacaacccaccatataaaatacttgttttacccaactctctgacagcatcgtgtactcttttaactacagagaccttaacatggagacttaaaatgcaatagttttcatagatttctaacacaagttgtataaaatttatcagataagtttatttgccttaattggagtgattgggctaaaacagaaaaatttacaagtcagagttttgttcaccctccaaattcaaattgtatagccatctcaaactgccaagcagagactagtttctgcttactcactgagtgactcctgcatttcatcccttcctcaccataccttgaaaagcaagaagtagcatctagcttttgtagtattttgatttgtatcaaataatagactataaacaccctctgaataatcatagttaatgctaattacaagtttctattttcataaaattaatctatttatcacataccttctgaccagagcactgtgtctttctgtacaatagtctttctgttagcatctgctttcaaacatatatggaaatgttattacttggaatctgtatttgtgagaaaatgccaaagggtctacagtacactgttattcaatggataaatctatcatttccattcctcccaggaaactgagcaatttccactttacttaaaaagaaacttaaataacttaccaaaagtcgtatcagtgctagcatttggatttaaatctagatttgcaaagagtcttaataaaagggaaatacatatctacatgtatatgtgtgtatatgcatactatatttatatatttaatatattctatactatatatgtatactatattttttttactatatatataaaactgtggctacagtccagctatctaaaaaagataggaaaaaagacggcgttttattttttgtgcgtagttctttaatacttaataaatatttgactaaatgcattctaattacaaacaactctattttccataggtgagaacataataatgggtatagtggatatgtttcctagccttagaaatcctctgtttaagtggtaggtttttttttttttaaaagttatttggaaaccttcatattattctcaggatttggatcatgagatcatgagatcttcttataaataaaagagaaatttagggaggttccttttgtaaagtgataactttttgagtaatcttctgtaggaacgggtctttctttcttttttttttttttttttttttttttttttgagacagattctcactctgttgcccaggctggagtacagtggcacgactcagctcactgcaaccaccgtctccggttcaagcaatactcctgcctcagcctcccaagtagctgggattacaggcacatgccgccacgccctgcttttttttgtatttttagtagagacggggtttcaccatgttggccaggctggtctcgaactcctgacttcaagtgatccacccgcctcggcctcccaaagtgctgggattacaggtgtgagccactgcaccggctgctattactttcttattgctgcttaataaattaacaaaaatcacaaattttatatcttattccaggggtcagaagtctaaaatgggtcaaagtattttcaagtatttcaagtattttcaaagtatttcaacaacacagtcaaggctgtgttatgagcttggcacaaaagtaagtgtgttttttgcaattatcacccttaattaattaagagtaattataaataccgcgattgcttttgcaccaaattattacttctggaggctctaagagagaacttattttcttgccttcctagcctctagtggctgcccacattccttggcttcttttatcatcaaagccagcaatgctaatgaagtctttctcacatcacttctgcctccctcttcctcttataaagactcttgtgattatactgccttcactcagataatccaggataactttaactgtttggcaagcttaattccatctgccagcacaattccccattgccatgtaacatagcataacatgttcataggttgtaaacattaggacatgaacatctttggaggaccattactgtattgtattgtattgtattgtattgtattgtattgtattgtattgtattgtaattttttcgcccaaattaatggttttatttccatctttaatgctagcagaggattccaaagcacactgatatccatggatatagtttaaatgtaacaaagagttgtactatatacactgagaaagggaaagggatttttttttcataccaatctttccctaggtcacagtttctgaatagtagaaactaaacatattgttttcttaccaatttaatttaggatgaagtagtacaagtctgctaatcaaccacttaagttttctttaaggataaagcataaagaaattttaaaatgagtattaccatatttattactggactggctccatggttcccttgctccaagtcgggacatcatggtatggaggagattattttacttaccagagacagatttaggttttacagggtcggaattttgtggaaagccctcttgaagaaaatgaagaaataaaattatgaatacaaaattagacactaaaatgtatacttatgtgtaatgaggggggaagacaacaaaatacaaatttaaaaaaaagcaaactgcatctcacttaatcccaactaattttatccccagttgtttaatatacccatatagtagataaaacaactgcatgataaaatgcttcattcagcacttctatatcttttgactaaattaaaaataaataggtagaactcttgtcaaaattttgtcttcaaagtttgatttctaaccatctcttcatctttattcatttatttatgtcattttccctatagttcagttgttcaattccatgtgttctgggagttgtagcacagagaatatagaatttgggaccagaagaccttggatcaagtccctcctcatttgttcattcaaaatatatttattaaaaatctggtacatgccaggcactatgctgggcttagagaatacagtaataagcaggacagacatggtccttaccctcatggatcttataatgtaacaagaaaacagaaacaggatggtcatctcaaatgcattaaatgttatgaagaggtatagggccctgtgagtgtcctacacggggacttaacctagactggtggcaatgaagtctgctacttcaggacctgagggattagaaagggtgtgcaaggcagaagggagtagtgcaagggaaagaagaggacctcatacaaaaggaatattatagataatgacctatgatggaaaaggtgaaagtaattttaaggaagtaaaaaaaggtcaaaaaagtagagtatagggagaaagggaaaaagtggcgcaaaaacattcttaagagcaagttagggccagctccagtaaggctttgtgaccatgtttgcaattttggtttcatctaaagtgcagtagaatgccattgaagggttttgagcaaagatagtgcataatttgattcgcagatttaaagattttcctgtttggagaatggggctggggcaagaggaaatggcaagagtggatttaagaaaatgagttaggatgaagagaaatatttggagttgaaatatataaagacaagttaattagcttctaaaaagaattctgatatgcatgccttttcattgacaatgactcttttttaaaaaatattatttattaagcactactggaaacatacaaaaaagattgaaagcatacctcattgactgcttttgtgctgagattcatttggcttgtttctttaaccaggggtttgcattttatttcaaattgtataatgaaaacagtttccctaaatacaggcatttcaggcatcaaccaactggttaaagggataattcgggtattaaaaagctccttctcaaatcacaccaagatttctttaactgattttaaagattatttgatttagtacttggtggtagtgtgggggaggaaaggcaacctcatcccacacagcttcccgttcctgtgggcttaaacactccaagactgctgatcccagaggcaccatgccttcctcaccagattccatggaacatgaggtgtcttgagatgagtcacctggcaccaactcctccactctgggcctttccttttgccttttcaagcctggcaataggccaagccctctcttttacttctattaaaataactctattctggctttcctgtttttctgccctaatattgccagtgacatcacttgttttctctgtggtttttgcatatctttatccagctttttacactgttttgtaaaagcttactgccccttctgacacattataacgaggaaatgtatcactgggatacatttctctgttgatcaagatctaattacacctttaaaaatagtcaagatggatagccatataaaaattattccatagagcatgagtatctgaaggaggctgtactctatgtgcagtccccgcatgctacctgtgaaatgtgaatcgtttatagtctgtggcaaataaaagttatgtcattctaatctttataaaatactaatcaattgactaattcatgaaaaattctcttatctttctcaaatattggctaaaccacatagtcctccagccttacaaagtagagtaagcttctctttggcaactgtgttggtcaggctcccctaaaaacagaccctgaaacaaagatttgagtgcaagtagtttatttgagagttgatccccgggaagcacgagtattgattgtggggaaatgagacagggaaaggaagtcaaaatacggtgtttaattatcagatttctgctgtaggcaattggggttctatgggagactatgagaagtgtttcctctgagcgtgaggaaattgtaggatttatccaacatctctcatttgtccttggctatgggactgcttgcagagtcactgacttcttcaggcctgctttccttatgctcacagctgactacacaattggaaggaaccctcagcagagggttggaggtgcttccagtaagacagcatccttgcatacaggaacagtgaatgtctacggggcatagccaggataccaatagcatctgctcccgtagttttctacccagagtctccacctaattgtgtggtttggtctttgcacagaggtgcccagccagtgaggggctctaaggcacaaaagtgctctttgcccaaccacaagttctatgaggttatttcatttctgatttgttcaaatttgcagtatgtgcttgaggaagccattcttttacgttctttctctgtgccttctcttccctgctggggtcctctggcaggattttaacactgtttatattccacctttattcagggcacccaaccatggcattccacatggatatggcagccttctataaacccagataaatactccaagttctgagaggcagatacattgtttaccaaggtaccagtaggctaaacttttgaattacatagacttcatcccttgccatttcaattttaataccagtcctgtcaaaattccaaaatatcacttgcagttttgaggcaggtttagtttaacttgtattgctctaccacttatatgtctattgactatataatttagcatccaaactggaatatctttgtaagtaaaagagggccaccattagtaatatgctagaacaggcataaaccaggattatcctggttaaccatgaaaaatgatcactcttgctgacttttactccttcatgctgttgacacagccctggagggaaaaagaggaaaaacagaacactctagactctaatgtttttaattccttagtgccattatggaggtgaggaggagccacacagaaatatgctcttacggtaaaatcctgttgtttccatattccttccatgaacatgatgttataaaaagagcttaaagagcttacacacgtttgaagaagacgggccttagaatttggttgtgttttggagggttttgttttcacttgtggtggtagctgtgacacttactacttcttaactctctgaacctctcatgcatgtaaaacatagcaataccaataccagagaattatgataagggttaatggaaatgtgtgtaaagctctaagcataaggcatggtatgtaaaaagtgctcaacagaagttagaaccttttttttctaagtttttctatttccagtgttctagtgtttttctcgtggcagtagggtgggacgtgaaacgacacagggaaagcagctgaaacctatcagtgtttaataagtatatattgaaagtgataattttgacagcttaagtgtattaaatgtgtattacaagtgccaagtgagtacaacacaagagatcgatatagaaccttccccttaattgtgtaaaaaccttttaaacaaacttatcctggaaatcacgtattagccctgagctttacttctctgagatttcttacctaattggagaagctatattatattcaataaagtaggcaacatattttcatttcatttgatttaaatgtctttgttacatagtttgtttaaaatgttgtgactgtggcagttttcaaattgtggccctttagcagttttcaaatttatgacacatggcaaatttgcttagtgatgttacacttcatggtcttacaataagctataggaaagaagcactcttgacagaagcaatttaattatattctgtatatgcatgagaaggagagagtgtcggagggtgagggaggaggagagagaatgggagagagacagagaagacagttcacaggcagctcagacagatattccagccagccaccgcacaagttatttaaaccaggtcaaagcttctttggcattcagttttccccagagaacaatttaatgctgatacttaattttttcaagatagacaaggtaagtctatgttccttatatgtatttactaagttataaggggagtttgtttatttataacttttcataaaacctagccaaaagccaaatttctatatttgtctgaagctttcagtgttgtttaacagttttcaaaggtagtgttatacttcagattgcaaataattaaatgaaaatgaaaaaacataaaaattatgcagtggacgaaataattaaaaaatgatgttgcaacagtagatttatttatagcattgtaatatccaaatatgattaactttaaagctagacttacaggattttaaagctggatttgaagttgagcagtccttaaactcattactaccaaaacataaatcttaacggtatcataaagttatatttttctttaaaacaactttattcttatttaaaatttgtcagctatactgtatacaatatagcccttctaggtacaattcagtgcaaatatatgagcatttcttttggaaattcagaagtatatttactttgcattttgaaattatcagtcacattttctatttaggcttcctaaattttgccttttattttgttattttcaggcaaggaccagggaaatgtcagcttttagatccaaaggaaacatatgtgttaataatttgatgaaatttcaaaaatagatttattttgtgctttcagaaaaagtgtgggtagaagtataacctcataatttatttctagaatcattttcttattcactgatactctgatgtcacaaacagcctggctgaaattgaaagtgtacagttgtcaccactagagtttgaaaaggacagtcttacatacatatatatattcaaaaacagtgctgttctccaaagactaaacatataatctgtgcagtactatccatatttatcagtaacttcctttcttacttctttctaaaagaactgtcaatcaaaatatgatggagaatacttttgcaaatgaagggtttcatagattatccaagaagagtcatctacatgttgcttgtgttttatttatatatttttttatattctgagtaatacttgtattaaattaattcctaatttcaattttatttaataattaccttcagaagcagggcttatccgtggaataaaggtataaatgtacttaggatggctttaatacatttgtaatttatatttttgcctcccataattccaatttagtttcattcatttgtcttaaaaggaatcttaacatctatttggttttatgccatcattatgcttaaccaactgcataaaatgtcctcttatttcttatctgtgcttgttataatatttataggcagcaagaaattatttttctacctaagtaaaaaagtttcttttttcccccttatgttataaacttggtgtaagaccaacagtacagaatcagtgttgtctgatttttttttttttttttttttttttttgagacagagtctcgctctgtcacccaggctggagtgcagtggcgcaatctcggctcactgtaagctccgcctcacaggttcacgccattctcctgcctcagcctcccgagtagctgggactaccacgcccagataattttttttttttctatttttagtagagaagggatttcaccgtgttagccaggatggtctcgatctcctgaccttgtgatccacccgcctcggcctccactttgggcttctttgaagatacatacacagttaatgttataagttttagttactaaaattcagtcaccagctcactcaatgaagatgcggtaagcacgagtcttcacaaagcactctggcaggagtgtgttgaggggagagatttagaagcatataaattcagatgacaagttagataaaagggaaagattttatttaaagtttattgcattaatctgttttcatagagtagttcatggtcaattatttatttacagggaaaataatataggagttcagagagcagtatcactacagcttagggtggtcacacttggttgttgggaagatgttttgaggcaatcttaaaggattggtaggggaaacacaggaagggacatcccaagtaaatgggataaggaaaagcttggaggcagaacatgtcagctcatacagaggaaacaggatgtaaccagcttggttggagcagagggttgctgtcagggagtaggaagaggtaaatatggcaaaggtggtgtgaatctagtatgggagcacagtaaatgttatggtagactaggagagaaccagtaaaatttgaacaagagatcaatatgccatctctatgaaaattaagctgttatggttgtaccaagccaattgaaatgataagaatctcaatatgggaagaccaattgaaataagaagggaggaacaggtagaggagataaggcagttaagattaacagtcatgttttgatagtgagaggatagtgagtgatagagagcagtgcctttaccagaaatgggaagttcataggaggccggttgggtctgtatatctcagtcagattctacccagtgaagcagaatctgtaggacatgtatattaaaagatgtgttacaagaaactgccttatatgactgtgagaagtggctaggcaagtctctagggcaggtcatgagagaagggtacactagagctctcaggcaccggctaaagctgcagtctgcaggtagattttcttctgtcagggaagcctggactctgctcttaagggctttccactgattgaattaggcacactcaaattatctgaaataatctcccttacttaaagtcaagtgattgtagactgtattcacagctacaaaataccttcacagcaacacccaaatttgcatttgattgaaacccccaattaactggcaacagtagcctggccaagttgacacatcagaaaaccccaaagtattgtaaacactaagatgctggtaggattgctaggcgaaagcagccagaagtctattggaaattatgatttgcaactcatgaaagctatggagattagagataccaccctgggagttatccacctgaagagttaagaagatcttcagagagttaaggagatcctcagagaaggctgtagaacttctgcatcaaagattaattcttggaagaaaccatttttaaggggcagaagaaagaagagttaaagggaaaaagattaaagagctaagaaaagaactaaaatagcacatagtcatagttgttcctctgtttgctacactttctccctggttttccaagatttccagtggggcagggaacacagcattggttcccctgttttccacctgtatttggggtccttgctaccaaagtttcagagaaaatttgacctgagaagaggctagtggttttattgtgaactttgaaagtacaatttaagtaagattgttaaaagggtttccaaatctcaggtatttcaagacacagtagataataatgaattagaggtacaactgttatgattacttagtgaaaagaccattcgggacctttgcccccacagtcatgaatgccctttgcctttctcatctgtctagcaagttatatttaactttcaaattatagttcaagtatctcctcctcagcaggaagttctttaacttaccccaggagagatgctaacttgatcccctgtctcatctctcacttaggaatattttttacttctgattctactgaaatagaattgcttatgtggtttccttcctcccccaccaggttgtaagtgtcttttaatttttaatctacagtgcttataacaataccatttaagtgctgcatatatatttggggagtgaaggtatgaatatttgtacatgtatggatagcatttagaaagcagacataaatatttataagcagcttgtgaaaaaagaaatttggggagtactggggcttaaagagtacaaataaagagaataaagtagagaagaaaagggaggaaaggaactatatgataggaatgctgcagaggaagaggagggataccttctcccagtacagaaaaggaggagaggtttgatgtagagaagaatgtagttgggaggaagtatgggagaaatttgtcttcccatgaaagttaaagacaaacggatatgagaaaatctgccttctcctaaaaatatgagattttttatatgaaaaacttgaaattttaaaattatatttgtcaactctgatcaaaagcatttaaagcatttataacaatgaaagctattccttttctctcatatctctgtgtgtctgtgtctgtatgtgtatgtatgtgtgtatgtgtgctgtgtgtgcacatgtgtggtctggagggtctattatgggtggttcttatgcaaatttatttaattgatatttcacctatgtgtgacatccccccagccatatgctatcataggattaattacaagcgctagtaagtcaaaatatgtctttgaaaaaaattcgtggattattactctggtaaaataacagtactctcctggagaaacatgatttctgcagatgctaagatgtgtaagcaaactgtcatcctgtttttctttctagtagagcactactttaaagtgctctacttaaaagagacaactttaattaagacttgaaactttgtccatatttgaattttacagttttatgtttatttgcatatgtagttgaagtgtgaagtataccctgaaaagttgactaacttctctcccaaggacaccagaaaggtagaaggaatcaggaatcagttgaaggccagagttaggaagacagaaatgtagtttgttaggtcacgtcctgaagtgctggccagcattcaagaggaagttaagaggcaatgggcaggacccaaccagtccctgtgtagatagacgagccccttagccatagttcacctggtgccttttaaggggcaaagcttttggtaacttggagctagaagccctgaatgtgagttctaattctgccatttactggcgatgatctcagcaaaataatttaacctctctcatccttggtttcctcatccaaaaaactgaaaatatttatcaaatagtggaattctttatgaatataattattctactctgggttgcagtctaaccaggaaacagtctagatcatcttgggctcacagcaagtcagaatgtggagtattagaataaaggcagcaatcttaaaggctgtttcaaaacaagaatctaaaatacctgggccaaggattctaggcctgtggttctagaagcctgtttgaaatttctggatcagaatcagacctcataatctgtgttggacaggccataaacatgtgttggtgagaatcatgaattttcatgtcaatattatattgtgtgtggtttcttgaaaggaaaataaaaggtaaaagtatctcattcaacaattgagattgaagatatatatttccatggcatttaacctttacaaaattacccatcatttctcatcaaaattgttaatgtactcctgagataattatttttgccatgctttctagggttccatctttttaatgttttaaagatttttttatgtgtttaacttagcaaatggtaggtgaaacattaaaatctacaaaaatgctcttttttcctgagattgatttagaacttgactgcttattttctttccaaaaaatgtgaacttattgtacagagaaatacagccaaaatcaatttaccaagaatttagagtaaacagggacatacagtacttttctcccttttgtacctttgtaggggcaatttgaaggagcatacttaagaattaggtttgcaaacaaaatctccctgtttctaagaacatcggaaagaactaaaagtggtttctctggactgtgtctaatcttcagcgattggtttgctattcattgttgggaaactatatatggctgccgccaggttgcatgacctgttacataacaatttattgaagcagggagatgctaaagtcactggaggttggacttggcctgttaagagtgtgaacaaatggagtgtaacaatgtgtgtgatttctgaaacaaacaatcctgggaataaaggacacagtccactgctttcataataagacaattcttttttaaacaaaattaaaattaaagttttatctacagtaaaggtcaaagacttagaagtggaaaaattaaggctctaattttcattgtgttggtaaggagctaagtaaccacaggctaagggtttaaccttactgcaccttggattctttgatcagactttggattccgtcatttatttttaaggtttcaatgctaagtttctgatctgttctattctaaaatggatcaatttaacccaccgataatttgaatttcagggttttcagctcagtgcttatttttagtactgctttagtattgcataagccagtatttaatattcttataaatatactcctgctctaatgaaaaagtatcaggtttgtttttaccttgtgaattacagtgttttccttctcaggaagagttatcaattccacattcatggccatgttcattcattcccacttattgaagtgtggctgaaccagaatcaaacatttttgtgtgtgattaacactgaacacacctcctactcctcaaattatcaggattgtcattgtttatagtcaatttaggacaatgccttgagagtaataagcaaactggaaagaagagaggcagaaagtaattgattctgctaaggatgtcaaattaaattagagtcagtaatacgttatcattcttatctcacattttgttaacattttcattcattaaagcttagacatctgcttaggcacatttttttttctcccacagaatcattaaatactgtacttgaagtaatttagtcaattccttaagatacagtaatgcagttctgaagattggtaaaccttaatccaccagattttttcttcaccagtatactttttattgtattgcatatttcaagttcatgttcatctaatttttaaaagatgagtagtgagatgaaaactaaagacctaattttattatttattttttatttttatttttttgagttgaagtctcactctgtcaccaggctggagtgcagtggcgggatcttggctcactgcaacctctgcctcccaggttcaagtgattcttctgcctcagcctcccaagtagctgtgactacaagtacgcaccaccacacccagctaatttttgtatttttagtagacatggggtttcagcgtgttggccaggatggtctcgatctcttgacctcgtgatccgcccgcctcggcctcccatagtgctgggattacaggcgtgagccactgcgcctggccctaaagacctaatgtttttaatacttcattgtaccaattctcaccaccaaaccatttctttttatgtcctaagagttttcttttggtcttcagatacgcaactatgttttgttatttagtacctattctaaccacagtcagtggaaaagcaaccagtcagcagtttcccaaaacccttagggcacacaggctctaattaagtttttatgcataagttatattcttcccagtcatggaatgattcttcattggtgtcacacaacctgccctcaaattactaccaaggcctgtgtggccaggcctcaaattagcacaatttacattatttgcctattttctctcttgtcatatccatactttgagctagagtagatctcagtgccagtctgaaatgaagtggtcagagtattttgcgttaaaacagcagtcagcaacctttttggcacaaaaccagggaccagttttgtggaagacaatttttccatggaccagggggtaaagggggaggatgatttcaggatgattaaagtgcattacttttattatgccctttatttctattattattacattgcaatatataatgaaataattatacaactcaccataatgtagaatcagtgggagccctgagcttgttttcctacaactaaacagtcccatctgggggtgatgggagagagtgacagatcaggtattagattctcaaaaagaatgcacaacctagatgcctcagatgcacagttcacaatagggttcattctcttatgagaatctaacgctgcctctgagctgtcaggaggcggagctcaggcagtaatgcaaacaatggggagcagctgtaaatacagatgaagcttcgcccactactcacctcctgctgtgcagcctgcttcccaacaggccacagactggtaccagtccatgaccctgaggttggggacccctgctttaaaaggactagccagtcagaatcacattgtgctgatggccaccctcactctcatgagctctttgcctcatcaagtttagcgtttctgattttctcttggcctctctaattaattgatttttatctctcttcttacattttacagaatttctcctgtatttactaataactcgttctatacctactaaataatcttgatactttttttctcctctaaaagcataaattacctttctgatcactcagtaaatatataactttttttttaagttttcattacatttcctctagaataggtatgtcagctggatgttagaaattacactgatgaactaacttgtaccagccacatgtagttagttatcataaatccaaataagcctccaattatgatataactaaacagagtgaaacatttctagatgataatattttgggagagtgcagctaccttgagtagttattgcttttcacagttgaatttgctttttctatgatgacagaatctcctagagttgtatgcaggtacttctggagggagtggggcaaggtttgggtacacaagggacccaaacctggattggatttggattgctttgtaactaagatatggcctgtaggggatctctgcagtttttgctggcttgctccttgggagcttactggtgaaaatgtttgtaatctttgcctactgaattatctgccaataaaattccaaatttcccttttaataaaatggaaatggaatatttttaagttagcagtggtaaatatctctgaccacattcttgcctcttggttttataaatgcaagagaaaagagatggtttctggtacatctgaatttactttttcatgaaaattctgaagttagaaaaaagactatatgatttccaataagttttggagggactgaccctagcaccccaattttcttttaatctcttcttaaatcaaatctttgtaaataatgctttcacattctattaaaaatgtatagagaaatattcacccaattatgtgaggatcgtaaaccagtcattacaatatgtgctagcatacccttgttttagtctgtgaagtgtaagttttgctaccctaaacctctgactaccctgctgtcatcctgcctcacttccatgaggaatattttgtctgggtctatagattttcccagtccccggtgtgttaatgtgagaattgagtctccagtaagagctgttactcttccacatctgctcctttccttgtaggcccccaagtcttctgaactaaggagagaaaaaaactctataaaaaagaagaagggctgggctccgtggctcattcctgtaatcccagcactgggggaggccgaggcaggcagatatcgggagctcaagaccagcctgggcaacatgatgaaaccctgtctctacaaaatcatacaaaaattagctgggcgtagtgttgcatgcctgtagtcccagctccttgggagactaaggtggaaggatgactagagcccaggaggcagaggttgcagtgagccaaaatcacatcattgcactccagcctgggtgacagagagagactctgtctcaaaaaaaaaaaaaaagagaatcagattttgctactcatataagatttccctgggtttttaatcacagaaatttatcacaggtttttcagagtctgaccaaaactccaaacaaaattatgcaacagacttgttctaatgatagttccttcaaatggatcaaaataaaggattcattgtttacgaagcatgggacagttttacgcttgagagattctaggcttactggaggccctgagcaataaatggaagtacacattcatatatgccatttaaaagttataaaccaaactaacaaaatgccaaataaaaggtcttttagtctccttccttgacaaaaatatctttttaatgaccaaggaggtcacatttcaatttagaattctcaggctctccagagttctgtgcttgggcttggcttaccccacctcctgctgaaacctgtcacccaccttcttctgttcccaaaccttggctccgtcctgtaccttgagtgtccttgcgcacgtgttcaagctgtgtccactgccacttggaatttagggtgtgcacactgctgatactatccatcctcaggagagtaaaccctagaaagacatctgggctagctctgggattggatgcagggccattgaggcaggaaattctaggattccatggatctgaaggttagttcagaagggaacatgggctctgagtgggcatggactctgggtgggcacatcctcttggccccctcttggtctatgggacagggaaggctatatgctatgtgaagaggtaagataagaagagggcagagcaagacccttgaaagcaagaacagagtagggccccaagcagaggtttgaaggccaaactgatactatcttttcatagtgtcttgaacataatatattcttataaactgcctgtattgattaactaactcactgattccatctttgtgaatttttattttatatatacagacatatattcatcttgttcttaggaaatcatggccaatcctgatatgatcaatgtatacaactaaaagatgtaaaggaatcaaaattcctctttacacaaactttgcctttaggagatcatcaaacttattttattctttccttgtaacatttaactacttcatatgaacgatattaatgttgacttctcagtaatggtcgtgtaagttgttctaagtgtttacctcacccatccttacaaaagtatacttacacatgctgtctgcctctccattgtgaattgggaaaatcataagcactcaagaataaataaatacctgctctgctgttgtttcaaggtacattgagtcccccaacaggaaactgcccaattatcccttatcaccctaccatttagagtacctgatgctgtgattttgattttcagtgtgggggcttctttagtgataactaattacatatgccacatctctcctagatcaattgtacttctgtttcaggttttctcaagaattgctgcctatctctttaagttgccctgctgggtctcccaacaggaatttcacaatactgcatagcttctattctaaatcaaaccaccccaattttgatgaaaatccatctaatttattttgtggaatgtggtaagaagtacagagaatctattccattttacagaatatagaaaacactttttcttaattttctttgtgacctaaaaccctctcttctatctataacttgtgcagtacagtcatttccacacaataattaagaacttcatacatgtgtgtttgtttcagaatattaaactattagaaaaggacacctcagggcaggtgtagtggcttatgcctgtaatcccagcactttgggaggccaaggcgggtggatcacctgaggtcaggagttcacgaccagcctggccaacatggcaaaattctgtctctactaaaataataataataatagtaattagccaggcgtggtggcaggtgcctataatcccagctattcaggaggctgaggcagaagaatcgcttaaacctgggggatggaggttgcagtgagccgagatcatgccacttcactccagcctgggcgacagagtgagacgccgtctcaaaagacaagaaaagaaaaagaaaaggacacctctgtttattgtaccctgtggggtgccatgagggtatttaataaacggtgtttattgctagaatcttcccctctaacccaatattctctgagactttgtggggaagaaaaatttccattaactctcttattagaagaggagccttattcttccagacatgaaactgtagaggactaaaatgttctatctgaagctacagaactgagagtattctttattattcctaaaactaattttattatttcaaaaatccacactgggtttgatttagaatattatcttctgtggtacacgatagggtgctgtaacaaggcacacacagatagtgtttaatcaagactcttacataatagtcccagtggtcatcccagtctgggctgttatggcgactcctttatgtcagaggactaggcttcgccagcttcatcaaattctcctatcctagacccaaagtagctgctctagctcccaccatcatgtccccatgccttcaagagcagaggagggaagggaaatgtggtcagtccttaacttagaagataggaagtttaccagtaaaacaaatggtgagaatgaatagatattgggggcacatgtaattatctgtgacatgttgcagcttaattttacggcattctaaatagcatttggaattaaatgtgaggcccggaaagaacatgtgctttgaatggagcaaggagaattggcattattctacttgaagatgtaatctgtgcagaatactttgagatcttattctgtaacaatagataactttaaataggttccaggcactttcctgagtgctttacatgaattatctcgtttaatactcaaccctatgagctaggtattttgattcccccatttcatagatgaggaaactaaggtgtaaaaggctcagtaggctgcctgcaggcacagaactagtaagtggtagagctggtacttgaatccaggcattctgagtccagagttgcccctcaaaccacttctggtccaggctccacttggaatattagtctgcctgttgagattggataggaggaaagattccccaaaaccttgagtttaaataaaagtttttaaaaatatatattcacaatagcaaagacttggaaccaacccaaatgcccatcaatgatagactggattaagaaaatatggcacatatacaccatggaatacttgcagccatataaaaggatgagttcatgtcctttgtagggacatggatgaagctggaaaccatcattctaagcaaactatcgcaaggatagaaaaccaaacaccgcatgttctcactcataggtgggaattgaacaatgggaacacttggacacagggtggggaacgtcacacaccggggtttgtcgtggggtggaaggatgggggagggatagcattaggaggaatacctaatgtaaatgatgagttaatgggtgcagcacaccaacatggcacatgtatacatatgtaacaaacctgcatgttgtgtacatgtaccctagaacttaaagtataatatatatgtatatgaaacaatgcaataaagcatttgcttctttctaggcttcaacctgaagtattactttattattatagtcagggtggtagacagtaaggagatattctaggtttatgcttagtaaatgaaatccagcttcatctgaggtattaacttagaccaaagaagagtaaagaaaacgaatgtgaagtaaatgtgctatttttactactactgagcaaataaaatctgagcctttatcttcctgttgtcaagagttgttaataaatgatttcagtatactcgtgtaatacttcagattacttttttttaaaattgagatagggtctctctgtgttgcccagactggtcttgaactcccagactcaagcaatcctcccacgtcggccttccaaagtgctgggattacaggcataagccaccatgcctggccttcggaccacttcttatttaaggcaacctgaaaaacaagtccattccagtatttggggcttaatctcatcctcagacaatttaggtgattatttatccccacatgcttaaagtatctcaatcatcacaattattaaataacatgataaaataataaaatccactccctaaatgtgtttatttactagggctgctgtaacaaaatgccatagactggatggcttaaagagcagatatttattttcttaacattcgagaggtcaaaagctcatgatcgatgtgtcagcaggtttggtttcttctgaggctctctccttggcttgctgttggccaccattttgttgcgtcttcctagggtggtccctcttgtgccggtggcccctggtgtctctgtgaggcctgatctccagctcttataagaacaccagtcaaattggattagggtcaactttaatgatctcgttctaacttaatcactgctttaaaaggccttttctacaactacagtcacattctgaggtacagtggttagggcttcaacatgtgttttagagggacataatttagctcctaacactagaaatactttggaaacattgaagctgtgaaatcaaacaatttacacgagtgagaagttcagcatttggatgtttcccgctctcttatctggctttagccaaaataagaggtagtacagatggtatgtttcagtgtatacaaatctctttacttaaatatttttgggcagccttattaagtttaatatgaagattatttaaaacatacgaaaagccatgttgaacttgctattgtttatactttcaatagctcagcgaatggaaaaaacaaagttatgttagctaacattttgctgaaaatgtaagtgtaactgagtgatttaagtagatctgacaggcaaggctttatagtcaatcatagcaataccaggtttttaatgaaagaatagctattagccatggaagagctgaaaataaaaataaaggtcaatgttcgaacagatgaatccttttctgaagtagtatctgtaaataacttaaagtacattgtaacaaaataaaacattttatatcttttgggttagggaaatgcaataaaagtggataagtacatcactaggaaagatttgaaatattctcttgaaggaaaatatcatcaaaagaatgattccatctatctcacaaaaatactcagaatgatactgtttttagtttcttgaccactgtattctttcattagaaatatctttggaaaatgggaaaatggaaggaaaatagtggagtttatgactgataggattaacctggagaataagtgagagaaaatgaggaaaacaatgaaagccaaagaaccttgtgccattttctaaaaataatcctccaacctatgaaatttttacaagttgtacttatctggcttaggataaaatatattcaaaaaccttggcacaacacaaaaggaacatttgtgtttatttgcttaaatactaaagaaaatgatggcactattagggaagactaataaaaaattccaactatatggttaccacacattggaagcatctgacatcaacaaaggagagctgctgcatattttcttttaaataataattgttggagatagatgacaatattactatattatattgcatgtaatacaaactacacacaattgtatatgggtaaaattgtataaggaagaccaggaccttgagattattaaggatagcattaataacactacaacatcagttcaaatgatatgtcactgtgcaccctgagggccttagataaaagaccctccagtgtttacttctctggcttcacacctcactatcttcaatcaccattaaattaactctggtgattcaggaaatgtagttaactcgagggaccatactctttctcttcaggacctttacctatgctgctctcctggcttgaaatacaactatacaattcccttccaccctgcctccatccgtcctctacctctacacagagttaaaatttcctgtgaaaatctcttaaatagcaatctacagtctctcaataagtccaatactgtctgcttttacacagtttgactacattggtgctgttttgtttaaatccagataaagccattggcttgcttttaggcagcctttttttagaaatcttcataaacacaagaattatcttgaggaactgaaacaaagaagaagatttgcatttctcagctcatgatctctccagtttacatgctcattaagtggcattgcaagctgcgactcacactcactgcttgaattattctctccccttctcttcttctcttcatatcattgaatttacataacataaatacataaagttaaatacatataaaataaacccactgcacagcacttataccacatcacaatgagacttttacttgtctatgtctccttctagactatgaaatggttgatgggtttctttccttttcacacttacatatacagtattggggcacaaagcactaaggaaatagtttgttgaatgactaaaggacaaaatgaacaagtataatatactaaccacaacaattttttttaaactgaattttcaagttctcactgcggttccacaaaaagaaagaaaaaaacaactgaattttggccaggcacagtggctcatgcctgtaatcccagcactttgggaagctgagatgggaggatcacttgaggccaggggttgaagaccagcctgggcaacatagcaagaccccatctctaaaaaaaaaaaaaaaaaaaaaaactaaaacaattagtcaggtgtggtggcatgtgcctgtagtcctggctgttcagaaggctgagaggagaggatcgcttgagcccaggagtttaaggtaacagtaagctgtgatcacaccactgcactccagcctagtgatggcataatcatagcttactgtgatcttgttactgagacctagcaagaccctgtctcttaaaaaaaaaattaatttttacaaaataactgaatttgtcacctcaaaaataaaaaaaatatattatttcagaataaccaaaaaggttatacttacttgatactttgtttttgtgagttaacaaaccattattgcatttattttggacctaaattgcttaatcaggtgatactcttttattgatttttccaattaattgatggagttggatagtgtatccagttccatcagagactgctttggcctcagagactgctttgattggaagatgatttatctgatgttatctatctttatacatctctccagccgataatgttaagtctaacaatgtgtttttccctgttcatctaattattccaatctacatagaaacaagctctactaccacacatcttaaagaaaaggacaacctcccctaatactgtgtgactttccaaatactacctctcaatcacaacaaacctttacaaaatagtcataggagctgtctctatttactcacctctcattccctcttctgactggccactcctttcaggcacctaatcttactgcttcactgaatctactcctctcagtcagttatctccatgaagccaagcactgtggtcacgtctatatttttttcttactaaacctcttaagtagtaatcaacattatttttttagttcttgacacacttacttcttctgatttctgtaccattgcacttactgcttttcccccaccttaaaaggtcctcctattcagcctccttgacagtcctgattttcttctgtacctctaactgtgggaatattccaagctccattctctttactctttatgtgtatttcctccccaagttcttatatttaccagcatagattttaattgtatctgcatgtcaatatattctatctctctatctttctagccttgacctgtttctcatggtcctaacttaaaaatacatgtttactgtattccctattctatcttattactgttgtatctgaaacacctagaacaatgcctgtatcataggttcttggtgattaatgagtatttatagaatgaattaataagtcagtggatgtttctaaatataacacatatctctaaataagcaaagagagaaagagttcacctgtaaatatgacatcttttggaatactctttgagagaaagtttgcccttccggaacacgggtgaaatattgcccccagacattttggattttagtaatttttcatgtgactagagaatattaaaatgcactacttttctaatcttttttattcttaatagaatacttcagatggtgttcacaaatcaaaggtttcatgtcataatttgtagtagactttatgtctttataaggttaatgattcttcaatggatacaaataattaataacgatggcattcctaaaagcataaaagcattttctaatattgtatatattttaatggactatattgacattaaacatattacatagatgtaacacatatttgttataattacagtatatgtacatagatgcagataattatacatttgtgcttgtatagaatatatgtgctttttaacaaacttttacaaactaacttgtaaagccatatgtgaatgtatacataaaaatacctgtgtagataaccattgttctatttgcaaaataaataagaccagactttacattttcctaaaatgttgtataatggaatgattgcaagactaagatttagaaagacaggtttctaattcagcttttgctgctaactaatgtgatgttaagcaagtcattatatccactagaatgtaacctccattggggcagggattttgtctgttgtgctcattgctgtattaccagcatctggaaaagactggacccagagtaagggccgaacgaatttgttgcatgaattctgtttctccagatttacagtttccacatctataaaacaatgtttcttctaatcctcacattccaaattaatattgggacccttatgaatttaaacaaggcaaatttaaaactagaactgtttattgagcttctgcctggacctttatattgcttaatcaattgaagctcttttcatgaatatttatttatatgaataagacaacagttagatgtcagttcatctgccatcttcattcagcaggactaaaacaaaaactttaatattaaaaatattcaaattcacaaaatcaagtaaatataaaagaaaattcaataactagcccctcaaatgatatttttcaagcatttgtgtcctttacaccgtggaagctattaaagtttaaaactgctgtaagaattttgagacaccctgtagatatacctttctttaagaaaacttgatatcccaactaaaatatacaaatgaataaagattattcacttttaaagtttttcttttcagttttcattttcatttgtcaccaaatatgtaatgaacaacaatcatgtgaaacctgtgttagataatgcaagataagtcagttattgacagtctgcacttcaccgtcatctggactgccagcaacacacagagcctgagatcactggtgacagagcctctgggttggagtcaacatcgacattacaaagactggagaggaagcctggggacctgtgcactacttgcaagactgcagccctccccttcccctctgccacagccaccattactcacagccttccgtcagcaggactgatccccgcagtgtactgcttccctctttcctcatagcttgtgtcgtcacttccccctgccctgcttaatcagaccctggctccttttcaaacaaaataattcccgctctacctcatcactctctacccctctcatcctgcctaattttttccctatcagcgatattgtatcttcgtttcactgtctttcttttttttttttttttttttgagatggagtcttgatcagttgcccaggctggagtgcaatggcccaatctctgctcactgcaagctccgccttccagcttcacgccattctcctgcctgagcctcccgagtagctgggactacaggcgcccgccaccacacctggctaatttttttgtatttttagtagagacagggtttcaccatgttagccaggatggtctcgatctcctgacctcgtgatccacccgcctcggcctcccaaggtgctgggattacaggtgtgagccactgcgctcggcctattcactgtctttcttgtatacacacgcaaactagaatctacgctcctttaaagcaggaaatttctcatccatccatatatctccagcacctcgagcagtgtatgacacataatagatgctccataaatatttgtaggatagatgaatgaacaaaaaacagaatgaactaacactctaacctgaacccgccatattgttgatcctcttaactgtttctcctccagttttcagcagcacctcaccgtttagatttaatgttcctgcaatttctctagccatgatcctcgtgattttcaataactggtgttctatgcagattttattatctcatgctgtcttggataaacacttgtaattcatcttggctcaatactttggtaatatacccctggggcttacccctgtcctttaagtgagatctggccagtatgtggccatgagtggccactgctctaccatagtgacttcacaaatgaattacctctagaaaggaatcaacatataaatgaataaataccaaaactaaactaaacagcatttacaatggccatagatgaagtccctgccttcggtaagtgtgcacgttccacaatgacaagtcaagtggacaagacagagtccaaaaaggggataggaagagaattcttgagccataggtaggtaagtgggaacatccatgtgactcttggtaggagtataaatcactacaatgtttctaaaggggaatttagaaatagctatttaaattaaacagattcctaccctttcagtagcatttcaacttctagtaattcattctgtagaagctctcctataacaactggaaatatccaatagcccatcaataaagagatggtttaatgatgaaccacatagtcataaagtggaatagtgcaatctttaaaaagaataaatatatacctgtttgtgttacattatattaaatggaatgtgaaaattgcacattagtatatgtggtgtgatttcactatcaacagtttatacccctgttctagatacgaggaataacagtgaacaatactcacaatgaccctgctcacatagaaattaaattctaattggaaaacagaccacaaacagataaaggtttaatggcagatgaagcagtgctgtgaagaaaaataaagcacagcaaagggatactatacaaagcctccctgaggagacagcctgtcttgaagcagaaatctgaataaggagcaaggcaagaaagtcagaagagacaaacagaagtaaaaaaggcccagaagcagcatgcttgcaggcttgaggaaatgcagggaagacagtgtgactggagagcattgatcatatggaatgaggggcagaagatgagatgtgaggtgtccaaggaccagatgatatggcatttcctgggccacgataacaattttggattttcattttactttggtgattaatcattataagatcttgagcaggggaatgatatattcagatttacatttttaaagactcaccatggctgttatgtcaagaatattctgaggaggaaaggaatagaagcagtgacactagctgtacgggtatggcactgctcttttgagtgatgatagtgtctggacatagggttggagctgtggagaggaagaagaatgaccagacttgtgatgcattttgaaggcaaagccaagaggattcgctgatggattgggtgtggggtgtgttagaggaatcaaagatgattacaaggatttaggccttatcacccaagtgaattgtagtaccatttactgtgggaggaggatttagtagtgggaggtggtagtgtggtggaggtggggaagagttctgtcttggatatgttaatgttgaagtgcctatcagatctgtaaatggagctactaggcaattggattaatgacttcagcatttatgggaaaggttaagaccttgatgtatatttgggaggcacaagggcataggtggctttgttagctatgttaaagctatgttagagatcacctaggaagtaagtgtagaagaaagcaaaaggtctgaggcctgaggtctagggattgtctatttctaaaaatctcaaagaggaaaaatccagcagaagagactgggaagtaacaaccaatgtcaaagaaggaaaaacggagaatgtggatcacagtagccaagtgaagaagcttgtataggtataaagaaaaaatagttcccaaattactaaccattgtcttccttgagtggtgaaattatagggggcattcaatgttggcaatttctgtaacatttaaatattttgtaatatacatatattgtctttgtaagcaaaaatagcaataaaaaggttaagaacaataaaaaataaaaatgttaatgaacatactaaatgtgtaggaaggatcagcattaagttcatatagcataacctattatatctttgattagacaatttacaaaaggaatccagtgaccaaaaatgagagggaaaaaatgcagtgtttcaaatggcttatctaagagtgtatttaggtacctgctttgtaaaggttttatgtggattgaaaagttaatgtgtttatatagtagttatgtatgtaattatgtatatagagcatttttcatatattattaatgggtattatatgatactatacagaaactaaagcgaaaaccagaaatttatataggacgtatagatggaataaagtctaacagttttcctaacctattgatactgcttatacatgtaagcaagtaaatattttagaatttatttccatgctatgaatagaatgctggttagtgcatttcaaagtggctcaagaaaattcctctgagcttatcaagaactgaaatgcaaatgtatgtaattcccagtacaaatggaggtgtacaccccaaactgccagtcagaactcatgcagctgagtcaaaaggccatgaggtagctgtgtagtctttgaattaagataaaacctgttacacctaactccataatctatatggagtagaaataagtataaatattatatagtgtatgttaaagtgctgcaaaaatcatcaattaaaatactagtttctcttcatgaggattgctgatacgtgacagtaaaactgtggtatttttcaaactgggttccaaatgcaccttctccttaaaagaacacgacctgtcctttgggactattcatacacatttagtgaattccgtattaggagaaacctattagattgttcaccattatctttccacagaacagttgggtgccaaattcagattttcattgaagttgtcaccatcaataatacaatgatttcattttggctgattgagatttaggcagtcactgaaactgtggccatggcatagcatccagtggtactccccttagccaagcatactttggcaaggagcctgaatcaagcaaagtactcccttaggttactatttttctgattaaatttgtaattatgtgtaaaattaactattgtatttgcaggatcaattgatattcaggagtaaactgtctaaataaaacttagagtttcttttactctctcctgtcagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaagtaagtgctgtcagcacgtctgcatggctgtggaaccaggaattgtgtactaatcagtaagataacaaagccactgagtgttactgtgcagcttctctatttaatcagaagttcaaccatccattttaaaccaccctgatggcttataagtaagtacacatggacacacctctacacctggtcattcatacctttcaaagggtgaagaaattctgagtccacatgaacaaattgatttcttgcatctaggaaagcccagactagttccttactggatgtttagtgtacaaatgccacaggtaatggactctttcatatgggaaactcatagtctgtccctgtcaccaaagtccaagttaaaatttataagtaaggaactgatttcccattttcttaattttctccaagctattttggaccctaagcttttctaagtctaacactgtcatatatgtaagttacattttcttgtttttaaaacattgctgactcatttttaccttaggaaataatccagggtctatcagcttcattatttttctgactaaaatgttttagttaattctgaaaaaatagaatacgatttttaaaaatttactcttttcgattctttttcttttttttttttttttaccatttcatatggatcctgcacaaaacctgcttcttcctatgcttgagaatatttctggtaaaattgaatttttattgaggtagtggatcttacaaataagtaattaatgtgttgttttggattacatggagattcaccacatataaattttccataattatttgttcattaccattcacattactcatataccaatttgatatttctaatttcttgtctttactggaatttttctatattgtttagaaaatttaacagaattatgccaagttactgtttgtgatattccttcccattcctgaaactagttggtctctgtttagttggtcaaatgattggcttgttatgcatgtttccagtaaggaatataagaacaaaaatcagcaggtatgaaagttacagagataaacttactgacaaaatacccatatttgatgaagtagcataaagtaatatacaaatgagacttgaacacatcattttctgatataaaaaagtaacaaataaaatttgcctccatcataaaccatttaatctcttggatttattttcatggtctctggatgggattataatctgtgtcccatttaatttccttggttaaaagaaataatagatgtgaaagcacaatggaaagagtaagtctctatagaaatatgctcattcaaaaaatgcttattgaatgcctatcacataatgagcatagttgtcattacccagtgataactacatcagtcaacaagaagagaacaggcactgcccttgtgcagcttacatcctggggctatcaggaagttgtattataggaagaaatacagattttttaaccaattaatttccattggaaccaaataaaagtctcaaataattcatctttgaatcaattaaatgtttataaataagaacttgaactatgttataacatttattcaagaaattattggccactttaaaaatttagcatgaatgttacctaatgttcatgagcaagtatctgtgtgaagtttatgatataaaaattcgcatcttatgtttttttgtcagcaacacatttatataaggatttggaacttggtatattaaaaactataactgagccctcttgaatagagcattaggtgttaaattgagagtttacacctttcctcagtcaatgttaagcctcatatgcttggctcaaaggcaatgcaaagaatcaattaaaaaaacagattgtctaagtaatatttatgtttcatgatcataattagtcaagtggaaactagtgaaaagaattctagaagatttcatgggttttttcctttggtttttatccttttgctgatagtttaatatttcctggagtgcgactgggagctgacagtcaattcagtgattttcttgatggattgggaccagcccagcttgttggccgccaaacccttgccacccctgcaatgggtaagaatcattttttttttctacaagaaaattgatgttttgtgtttgacaaagtcatttaaaatatttaaaattgtgtaatagcaatacaagtgagaagcaacattttagctacagagttactgtttgcaaacaactattctaatttcaagtgcatttttctaatttgagatgttatgaaaaaagaagtaaaattagctataaatatttgaattaccagaaaccctgatataatagatgtaaatgtaggacatgggtggcatttcacagcatggaaaaaaaaaaaaaaagactgttcagtaaagtatagtaacataactatttacctgtgtgaaaaaattaatggaattccctcacgcctacacaacttaccaaaaaagttagtattttagactcaactataaaaaagaaaagggaaggtggagaaaaacactaaaaagtactggagaacacttaagttaatctgtctgtaatcttgcagtgggaaagaacttcagcaaaatgcatgaaaatagatcagcttgaagacacaacatagtggaatttcacaatactgaggcttgatagaaaatcatgcaagcttcctaagaggaaaaataattttacaaaaaaactatcaaaaatcagattcttgccgggcgctgtggctcacgcctgtaatcccagcactttgggaggccgagacaggcggatcacgaggtcaggagaccgagaccatcctggctaacacggtgaaacccccgtctctactaaaaatacaaaaaaaattagccgggcatagtggtgggcacctgtagtcccagctactcgggaggctgaggcaggagaatggcgtgaacccgggaagtggagcttgcagtgagcccagatcagggcactgcactccagcctgggcgacagagcgagactccgtctccaagaaaaaaaaaaaaatcagattctcattgagctcttcgtattttcattggattcttcaatatactggaagccagaagactgttagcattaccttcagaattcggaggaacaagagatttccaacctagaatacaaaagccagccaaactatcaagtaattttgaggctacagtaggtacatactcggccccaagcaaggcctcaaatcattttcctcatttctaacatttctcagaaagctacttgaagatttactttgaccaaacgaactaaacgacttttcaaaattatgaactaaaaaaaaaaaaaaaaaagatggaaccaaaaaacaaatgcttcctcacaaggtaaatatgattgggatacccaggatgatagcaaaggaagaactaaagatagctgcagctaggtttcaaagcagcgttcaaattgggtcatgtcagacttcatgagataaaatctatagaatacctaatgggtttgatttttatggaagagataaacaaccaggagaaactaagatttgaactagtgaggtcttcataaaaatgtaagcaaatgcttttttaaaagatactaattaagtgtagggaaaaagaaggtctgtctaagaaataagaagtagttataatattctagttcacaaagttatgcataaggttacatagtcaaaataatataaatattaatattgggagaatgggatgacagaaattgtcaagtatgtagtaggggtaggaaggcagtgaaagagatcaaaattgaagtcaataataatatctaaaactgcaaaaaggaaaatataagtatagtgcttagaaataaggaggcaaattccagaaagtaaatcagataaaaatattgaaaattttggaagcaataatttttggaagacaagaagttgagagacaggtagaagttagttatgcataaacataacaggttttatagaacaattggggatatgtgtgtgatttaaaaagaaatctttaagaaacattaaaaggacaaaaagagaacaaaagacttctaggaactgaggtctaaaacagaattataaaactaatgaatgtctagaacaacaaagttgatcaactgaccagacaaataaagagaatccatgcctgagaaaatggaaatgattcaactaagtaaaaataacttagaaattttcagagataaagtatcatataatccacagagaaaaacaccaagagattattaaacaaaaaggaagtatatatttttaagaaagaaagttagagaatgggaaatatagtgacttaaaatttaaaactctggatgagctaaatagtatactgaacaaagcttaagatataattagctacaagaactatagaataccaccaataacatggcttatataaatttaaaaaaatcttttgtaagagaggagaattcaggatgtaggaagaataaaccaaaaagctcaaacttactctaataggagcctaaaaagagaatagagagacagtttttggagaaaaataatgatgcctgaactgttttaagaaaaacataaaacctgagagattgaaagagcacactgagtggtgaactgaacaatctgtacaaaacaaacaaacaaggaaaagcttcttcatgcaatttcaggacatcatctcaagtcatgaagaagaaaaagaagattacctaaaataaaaaacatgatggagaatttcatcagaaaactcaaatctttaagagcccagtagaaattatagaattgaaaaataaactaaacttaagaattcaatggatgagttaccagcagtttagacagagttgaggagagaattggttaatggttaattggaggacagagccataagaaagtatccagaattaattggacacataaaataatggaaaatatgaataagaagttataagaccgagcagaaaagtgaggtctaatatatgtctaattagtcccagaatagggaaaggagtataggccagaagccattgaaaatataatggttgagtgagaattattcacatgtttctagcataaaagaaaaaacaaatatttaaggtaatgatatcccaattacactgatttgatcataacaaagtatatgaatgtattaaattatcacacatacctcaaaaatatgtacatatattatgtacatattatgtatcaataaataaaaagtaaaatggaaaatagacaataaaatgtaacaataaaaattatatatataattgaaaaattttcagaactgaaaataaatatagtcatactttccagagaccctcatgaaccccaagaaaagcaaattcagcaatgctaaaaataatattatcacaaccaaatgggatttttttttcatgaacacatggttggtttaatatttgaaaactaatataattgatcacattgctgtaataaaaaagaaaaaatgaccatcttaagtatccaaaaaaatgtttgataaaattcagttttaatttatgatagaaaattatcagactgaaaatagagtggagtttacttatctgttaacgtttctacaaaacacacgtgtgtatgtgtgtgtgtatttgtgtatttgcacatcagattgtccaaattgtttaaatcttttaatataagtagcaaagacattcagaaatatgcattctgatacactactattagaagcataatttggtgcagtcaccaattggaataatatggcagcatctagtaaaaataaaaatgtagatgtgctgtgacccagcaatacaacttctaatttacatatcctcaagaaactctttgcagcatttttttgtagcagcaccaaataggaaaaccaagacccctaattggagagtagataaataaatatgacattcatgtaatggaatattatagagaaattaaagggaatgtcctagatctcaacacatcaacttggatggatatctaagaaaatattactaagtgaagaaggaaaattgctgaatgataccacttatacaaatgcttaggctggacacggtggctcacacctgtaatcccagcactttgggaggccaaggcaggcagatcaccggaggtcaggagtttgagaccagcctgaccaacatggcaaaaccctgtctccactaaaaatacaaaatatagccaggcatggtggcacatgcctgtagtcccagctactcaggagactgaggcaggagaatcgcttcagcccaggagatggaggttacagtgagccaagatcacaccactgcactccaacctggacgacagagcaagcctctgtctcaaataaataaataaataaataaagcttaaaatttggaaatttatttaagatggacagttgttaaaaaatataacctaccacaaagaatttaagagtaaatagaaagctgaaaaaacctgagtagaactataactaccagtatttaacattctacttaccaaaaaatggggagaatacacccagatattttcacagatgagttctaataaatatgaactcaagagacatgaaaattatgaaacaaatattttcatgaaataaaaaggaagggactcattctagttgctaatctaattttgtatcaaactatacatgggctacatagtgctccttaataatcaaagaaatgcaaattaaaatatcgttttaaccagattggcaaaaattaagcatttttttgatactgatattagacatattgctaataccaatgttagagtgtgggaagcaggaagagctatatttctggtgatagtgcaaactggaacaacctttctggaggagttggcagtatgcatggaatttttggatgtccatactattagatatgaaaatttaaaatcttggaatttgatgttcaaaaaataactgatacaagaatgcgtacaagaattcttataaaactgttcattataaccctatttacatacactgcactataaaatagtttatgtaaataacctttatttccatcaataggagtctgatttaataggtaatgacatgtccatgcagtagtccatacagtcaataaaatgatggtgtatgatcatgattgctgatagatagataaatagatagatagacagacaggcagagagattgatagaagtataagaatgctaggatattcaccaaatattaatggtggctttctctggataatgaaaatacatatggttacaattttttattatatactggatgaaataagagtaagaaatcttattaagtacaagaattatagaaatactttagtgttgttatagtcatttattaactaatttgcaaatctcataagaggtattaataccagaaaaaataagagaatggtttccaaatttgatttggaaactgagaaagaaaagtggattgtggagtgaggggtctaaatattagtttcttatcaaaatcatgaagataaaaatctgtagtctgttacgggctctcctttttgttttaactgcacataactgcaaagaagctgaaacacatcttgctcctttccatttgcaggtgatatacaaataggaatggaggacaaaaagggccaattagaagtggaagtcattagagcacgaagcctcacacaaaagcctggttccaaatctacacctggtaaggagaagtattcctgaatttggtgaagggactatttaataggcaaacaaataaaaacatttgctgcatttgaatttcatatgctctgttttgcatcatctgattgattaaaaaagcagtgtttctgtgttctttgatgttattaaaacggatttgggttttccttgcacagttattctttcagaaggtgttaggaagtatgttataatattttttttaaagtttagttatggtcgtttcttagcttgtgtcaattattttctttttgcacacttagaaaggcaaaagaaaaaaagaatatagttctaatcataaaaaggtaacaatgagctttaagatataaacctgcattgtaacccaagtaagtcaaagtcttcaaataactttgtatacattgagtcaaaatgaggaaaatggcagtaatggtaacatatagatttaaggaacagaatttatggagcaatggaaattttaagtaatttaaacagtcaatgggaaactttcagtaagcatctctaattctctaatagggaattctctaattaaaaaaatagttgaatttaaggaataatttcttatatgttaatatacctttgtttagctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtcagtaatagtttgtttggctttttacattgaaatgtctgttttacccatacatcgaagagatggtcaaacacaaagagaataaaatttggtaaagataaatgtaggataatattcttgagtagacaaaattcaaatggttagtttataatataaataatatataatatcaaaaatatttggtgggtctaatagagaacaattttattttatctctctctcttcttgtcttttctctctctatcctctccttctagctttgccctgttcccagccctcctcactcctcactagatagatagatgataaatagatagatagagatatgtcctcactagatagatagatgatagatagatacagatatagcaaacaaaacaatgttaataatagttggttgagcattgctatataccaaacatggggtacaaagaggaagagggagaggaaaagagaagtgtgcagacaccagcaaatattgagccctggtggagtaccagatgcatttctaggtgcttatatacattatttaaattttgtaactaacatgtgcaataagtatcattatccccattttaaagattatgtctgagattcaagaggtaaagtaatttcacaaaattactcagtaaattttaaagacatgattcaccaccaactctgcttgtgtaaaacaggtgaatgagttcagttgagaacctttacagacgactgaagtattagaaaatagaacctgggagtatgtgaaatggaaggcttgtctgacactagtagccaatagaagttgacctagattgtggtaatttttaatgatctaattgaaatattaatcatctaaatcaaaattggcaggcaagtcctcaaaaggtaccagctcacaattattttttgacctaccccttcactaaaaagaccataatacgaaagaaatcaaatgaatactctcattctttgtacatactttctggtacatacattccatggtatactgagttggattgctcatcttgccctcctaaattgcacaaattttaatttttagatttttatggtcctgtacatcgctaattagatagtagttacacaagaaaggtgttgcattcatataaaaatactcttatgtatttatttctttaacatggcttatgtagctaatactcctcattgactaggaacacacaatccttcattccatcagactaaaattattgtgaagtgtctatgagcaccttaaggttagtgtatcttcttatctgtgccttctccttggtgatagttgtattcattattcttttcctctgcttcactgactggcccacttttacagcatagttgctttgagcccttcgaatgtgaagcagagagaagtccaggtaatgttgcatttctctatctctgcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtagcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaatgctcatgtgtataaaccatactttgacttcccaaaaatggtgactaggaatggatttgagcctaagacactttgagctatgcccaggcttctcagccatacctcagtgtagacacatccatctgccctggaaagagcatggtatgagctgttcaatattccactggaaattccagttgaaatattctgcactaaactattgtttttattgaattttagtttacatttctttgagattgatgcaagcacaaagcttgattttttaatgcaaagtatcttactttttggggggaaaataaacaaaatgaactttcaatttgcattttcatttagtttctcttggccttgaatttcccttgtgacattctgtacatgtgctacaaactgcagtctctgcaggtgcattgatatgttctccctccttttatgagtcactccacttttgtgattacacaaatagagcagcatgacttggaactgttcagagctgcatgcacattttgtaaaaaaaaaaaattttaaaaagaaaagaaacaaaaggttatttaataatgtatgttagttccacataggccagcttgtatgttgcatgtacttgtacagtttgcttgttaattactataccgaaataaccaagaaatctaagccatccacttttgttatagacattttgcaggttttagccagactcagtctctgggtctgtggtgaaatgtctatagatggactttattttttaccctccggaaaacgtgatgtagtacggaccaaattccttctaataaatattttggtgtagattcctactgtggggctgtaacacatgtagacactgtgtacacactaggttttaattcatagacatactgcctgcaccaagtgaattatttattattatttacacatgccagaattatctgcccatcattccacagggcacagattgaccactgctcaccatgctgagtaggaggaactgaagcattggtgcacttctactagattccgttctgtcttagtggccaacaatcaactgattataattgggtagtatctttctattttgaccacttgtcttaacactcccctgtgcttttaaatgaaattccaattcatgtatgtaaacatgtttaataaaatttacttttcatgtcagtcagtagccatatgtgttctatgtcttgccagatttccattgtgggttctatggtgcaaaatgggagccaggccatgggaaggggaggctggggtttgttgtctgctgcgggcatttgacttgacttgtcactgcactatattatgtcttaatcgatggcccaaagggtactttgcatcacatacaagttttcacttcgtcagcctgtctaagtgagcacatgactatacttctgaaaagtggcattattaaaaataataaatctcagtaagaatcaaatggaaggttgttttctgctgctgtttgaatgtgctaataaaagagacaactctattg

SEQ ID NO: 2379 - DNA, 33121 bp, Homo sapiens
cgaaaatatttttccttttaatgtaaatattacaggttcattgcaaggaaaaaattaacttaaaaacacagaaaagaaagtaaaaaacaaaaaattgatgaaccactaaaacagaaataaccatcattaattttttggagaccatcctttcatctctctcaaaagttcacataattacataatattacatttacagttttataccataaaggcagcatttacatttttctgtttttacagtctccccttcccttatctctacttctccttttctcactcccctcaaggtaatcaatattaacagcctggtgtatattcttccatacctgtctccatgtgcatctaaccacacacacacacataaacacaaaataaatgggtgtgattattttaacaaaaatgatatattgtatatatacatttgttataaagcaattatttatcaatacattgtggaaatacattgaaatcagctagcatagatataagtcgtttttaaaattactctcacactgttccataatatgggtatgtcacaatttatctaaccagttccctattaatgggcattcactttgtttgcagttggggctttgcccccctctacaaacagtacttcaacaaacatgtttatttacattcttatgcattgatgctgcttttatttctaacggacagattccaaaagtgagactgctgggtctaagagtatatatgttttaaatttttaaacatatattgttggactgctggtggaagtatgttacacaacctttaagtaatagtacatggtttcccaaaccccaatagctagcaaaagatctcttaatttttgccagatccatgaaggggaagtttcatctcactgagcatttcaatttgcatttccctgagtgctttttaggttcaaaatattttcacaggataatgatcacctacagttgctctcctatgaagaaccatccagtccagagggattaaagacttaagtgtaaaaaataaaatcataaaaatcttaaaaacacatttaggatactacgtataacctagggattaaggagatctcttttaagtaaaatgagtaaaataaaaaatctaaaaaggaaatgatacaaatattttcctataaaaatgttgtgcattactataaagtataaagacaaatgctagattaagaaaaacatctgctacataatgacaaaggattaatatcaaaaatatataaaaagcacctccaggtttataagaaaagacagataaatgaatagaaaaataggcaaatacatatataggcaattaactaaagataatttgttaaatgagtaaagtatgaaatctggatgaacactttcatttgttcattattttcctctagtgagagtttccttataacttctaagatttaatattattaaatgatttcccacataattgcttatagtttctctgtatactttctgataaattcctaatgaagattttcctatattcataaaatatagtttataagattcatcttgtggagttgacatctaggtgaatgacttattgttctttatattaactgagtttctctttgatgtattctttgatgtacagtaaggctcgaactactcctgaaggcttttccacattcattacatttatagggtttttctccagtatgcatcctcaagtgtacagtaaagtctgagttagttctgaaggcttttccacattcttcacatttatagggcctctccccagtatgaattctctgatgtagggttagctgtgatagagtaatacaaccctttccacattccttacaggtgtagggtttttctccagtgtgtgttctccaatgcactgtaaggtaagaacccctcctgaaggcttttccacagacatcacacttatagggcttctctccactatggattttctgatgttctgtgacatgtaccatctggctaaatgctttcccacagtcattacatttaaatggtttctctccagtatgtgttctttgatgtgtattaaagcctgagttacttgtgaaaacctttccacattcattgcatttatagggcttctctccagtatgccttcgttggtgcacggtaagctgtgatgtattagtgaaggctttctcacattcattacatttatatggtttttctccagtatgggtcctctgatgtacaataaggtatgatttagtcctaaaggactttccacagtcataacatttatagggtttcactccagtatgaattttctgatgctccttgagatttaccattttggtgaatgccctctcgcagtcagtacatttatatggtttctctccagtgtgaattctctgatgtacagttaagtgtgattttattctgaaagactccccacattcattgcacagataaggtttctcttcagtatgaatacgctgatgtataattagagaagaagaacgcatgaaggcctttccacattcagtacatttataaggtttctctcctgtatgcattctgtggtgtacagtaaggcatgaataattaatgaatgctttcccacattcattacatttatagggtttttctcctgtgtgaattcgctgatgttctgtgaaatttgcgatgcggttgaatgctttcccacattcattacattcatagggtttttccccagtgtgagttcttatatgtacgataaggcttgaattacttctataggcttttccacattcgttacatctaaaaggtttctctccagtatgaatcctctgatgcacattaaaaattgtggtattcttaaaagacttcccacactcgttgcactgatatggtttctcttcagtgtgggtcttctgatgtacactaagatatgacttgttcctaaaggctttcccacaatcatcacatttgtagggtttctcaccattgtgagtttcctgatgtcttgcaagttttgatttatcactaaaagctttcccgcattcactacatttatagggtttctctccagtttgaattctctggtgctgattaagacgggcacactggctaaaagatttcccacacacattacactgataaggtttctctttagtgtgaattctctgatgtaccataagtgatgaagaagcaatgaaggcctttccacattcattacatttatagggtttttctccagtgtggatttttttgtgctgactgagatatgaaggctggctgaatgttttcccacattcattacattcataaggtttttctttagtatgagttctttgatgttgaatgagcaatgatctataatgaaaggccttttcgcatgtactacatttgtagggtttttccttattattggattttttccccaaagttagttctgaagtctgccttatggctttgctgcctttcatctccttgcaaattatcttccccaaatgggtatctgtaatcaaatttaaattctctgtgaaattttcctcttgtgtttggcatctgctgtgaagctcttctgtggcaatgcctggttctggaataagaatagattcaaatctaaagcctctttgactagtgggagtcttcttgagtggaattattctttgactcaaatgattctcctgattattttgtaatctcaatatcctatcattccatttccataacccttccattctggaatcccacagaccattctctgtaagtttctctagtatggcctcctgtgataaatcttcagaaatagcctttgttcgtgtagccttcttggttgcaggtttgggctccatgtctggggcaaaaaagagaaaaatcaagtaattcctttcctaagctggggcaatctcactaaacagaataataaaagcaataaatacatggataatgaatatatggttttaattgctttcacactgacttgttttttagtgagaagaaggtagggttaagggaggctggtttagcaaaaactaaagtagcaaattcaatgaaactttcccgttaaaaaagtccattcagctgggcacagtggctcatgcctataatctcagcactttgggaggccaaggtgagagaattgcttgagcttaggagttcgagaccagtctgggcaatatagcaaaaccctgtctctacaaaaaaaaaaaaaaaaaaaaaaaaaaaaaaaaaattagccaggcatggtggtgtgcacctgtagtcccagttatttgtgaggctgaggtgggaggactgcttgattctaggaggtggaggttgcagtgagccaagattgtgccactgcattctaccctgggtgacagagcacgactgtctcaaaaaaaaaaaaaaagcccattcatagtttagagccaactattttagatggtattcttcaacttttgacaatctcaaaaactgtcatacttccttgctttctatttactccacaaaccagactttagtccccaatcacactttctatttgttttgttttgttttggagacagatacttgctgtgccacccaggctagagtgcagtggcatgatctcggctcactgcaacctccacctcctgggttcaagcaattctcttgtctcagccttccgagtagccgggactacagtcatgtgccaccacgcccggctcatttttgtatttttagtagagacggggtttcgccatgttggccaggctggtcttgaacttctgacctcaggtgatccacccacctcagcctcccaaagtgctgggattacaggcctgagccaccatgccatgcctggcctctatttgttctcatttttgattgactagctttgttgtgagggctttctcaaattcactggcagagtagtttattcaagtctttgtacataccttttaataaaacttttatggaaaaaaaactttgattttcaaaaagaactgaacaacaaactagtcaaaagttaatatttatacttactgatatttcaaatagtggtaattattgtttaattaagggtagattttgcaacttttttatggccctaagaacatttctgacagtttgtcaaaaattcattaaaaaaattacactgtgggatactggtcttacaatgtgtttgtgtatgcaatttaatattttatttttaagacactttaatgccttttaaaacttgtaattcattttcaggtaattatgcctcaatatttaaatataagttcaataaaaactcttgtccatgatagaatggttttatgatttttttttttttttaatttttgaggcagtgtctcgctctgttgctcaggctggagtacagtggcacaatctcagctcactgcaacctccacctcctgggttcaagtgattcttgtgcttcagcttccgaagtagttgggattacaggcatgcgccaccacatccagctaatttttcttatttttagtagagaaagcattttgctatgttggccaggctggtctccatctcctggcctcaagtgatccaccctcctcggccttccaaagtgctggggtttcaggcgtgagccactgtgcccagccaattttatgattttaaaacccacttttaagcagtatgatttgtctatgttattttacttttataaaatttaaattaatattttgtcatgctgttgctatttatcattcttttacttttaaatagttttaattagtttgagcatattttttgctgtcataggatattatattgccagtatctgataaaaaaaaaagtttgctctcagaaaaaaagctataaggctgggtgtggtggctcatgcctataatcccagcactttgggaggatgagacaggaagactgcttgagcccaggagtttaagaccagcttgggcaacacagtgagaccccatctctataaaaaattaaaaatgagctgggcatagtggcacacacttgtagtactaaatacttggaaggctgaagctggaggatcccctgagcccaggaagttgaggctgcagtgagctatgattgcatcactgcactacagcctgggtgacaaagtgaaaccctgtctcaaataaataaataaataaatgaaggccgggcacagtggctcacgcctgtaatcctagcagtctgggaggccaaggtgggcggattacctgacatcagcagttctagaccagcctggccaacatggtgaaaccccgtctcaactaaacacaaaaattagctgggtgtggtggcacacgcttataatcccagctactcgggaggctgaggcagaagaattgcttgaacccaggaggcggaggttgcagtgagccgagatcacgccactgcactcagcctgggagacaagagagactccatctcaaataaataaataaataaaaaagaagaagaaaagctatataaaacatatctatagcaccaatttggaattcagaaactaatattaaatttaaaaggtcaaaagaatatgaagttggaaagcagaaaaatttgctgcaaaatgcactaaaattataaaagcttagagtacataaaggttgttgttatattagtaattagaaattttcttcaataaatttatttgtagaaacttaatttatatgcactaaattctcatctttcttgagtgaaagtaaaatgttactcccagacaacaagcataaaaaacagaataaaaacttttatatttgagaggtctgcactttggggatgtcagaggaagtcatttggaccaactttattgctgagaacaatttgaaatgttggacaaaagaacagtctgtttgaaagcatctgaaagctagaaagacttaacaaattacaaggagaagaatgaaacccagaaaaacaatcctggtatttggtgccattttccccttcaaatgcctgttaattctctaagaaatgactgagaggctgaataagtaagcagaactcttaataaagtcatagggcaagaaagacagagacggatttaggtccattaaggaggacaattctggaacaactagggtttggctggaaccttaaggtgataagccctacaaatagaacgactaagaaatagatcggctggctgaaggactaaaacccacctcatttaaatttctcattgaattaaagtgaatgaagattgttatagtccctagcctagcagtctggcaaaagcaaacattaatcctctgtgggaaagattacataatctagaacctcctaatattactatagattttcatagtcaatgcctgatacccagtaaaaaataacaggcataaaaggagaccacgctgggcatagtggctcacatcttgtaatcccagcactttgaaaggccaacaagggcagatcacctgaggccaggagttcgagaccagactgggcaacatggcaaaaccccatctctactaaaaaatacaaaaaaattggccaggcatggtggtgcatgcctgtagtcccagctactcaggaggctgaagcaggagaatcacttgaacttgggaggtggaggttgcagtgaactgagattgcgccactgcactccagcctgggtaaaagagcgagactctgtctgcctcccccgaccccaaaaaaaagggagacaaaaatcaaaagtcacatgggaaaaaaatcaagagagaaaacaaatatacagaaacagatctaaaatgaatccaaataattgaggcctcagacataaactttaaaataactaggataactatattcaagaacataagattaacaatctcacaaagatttgtaaagtataaaataaccaaatgaaaattctagaactgaaaaataaatatagtaacttaactcaaactatgggctaagagcacaatagagacagcacatgagagagttagggaaatggaagataggtcagtacaaagtatccatactgaaacacaaaatgatgaaaaacttgcaaacgttagaaaagcagaagagacatccaggatagggtgaaaaggtctatcacagatgtaaccagagtcctagaaggttacaaagagaagtgagagagaatggacagaagctaagtcaaagaaataatgtcttagaattttccacaagagataaaaaaaaaaaatcaagtcacaagtcttagaagccaaatgaatcttcagcatgagaaatatgaagaaaactatattaaagtacacagtagtaaaaccgttgaaaactaaactcttaaaagcagccaaaaaaagagagacagggaagggcacagtggctcacacctgtaatcccagcactttgggaagccaagatgggcagatcccctgaggtcagagttcgagaccagcctggccaatgtggcgagaccccatctctactaaaaatacaaaaattagctgagcgtggtggcaggtgcctgtagtcgcagctactcaggaggctgaggcaggagaattacctgaaaccaggaggcagaggttgcagtgagccgagatcacgtcactgcactccagcctgggcgacagagcgagactccatctcaaaaaaaaaaaaaaaaaaaaaaaaatctgtctctctctctttttttttttaaacagtgtcttgctctgtcacccaggctggagtgcagtggattggattacaagtctgtgccacaacgcccggctaatttttgtatttttagtagagatggggttttgccatgtttcccatgctggtcttgaacgcctgaccccaaatgatccacccacctcagcctcccaacacctggccaaagacagatagatgtcctttaatgagcaacaattagatcagaggttacaaattataaccaatttggcccatcatctgtttctgtatagccagcaagataagaatgatttttatatttatttttatttatttatttacttacttacttacttattttgagaccgagtctcactctgttacccaggctggagtgcagtgggcaatctcagctcattgcaacctccgcctcctgggttcaagtgattcttgtgcctctgccttccgagtagctgggattacaggccagtgccaccatgcctagctaaaatttgtatttttagtagagacggggtttcaccatgttgcccaggctggtctcaaactcctggcctccagtgcctgccttggcctaccaaagtgctgggattacaagcatgagtcaccacgcctggccaatttttacatttaaaatggttgaaaaatatattaaaagaatgtgagacattaaaaatgtatgaaattcaaatttcagagtccataagtgaagttttagtggagcacaaccacattacttggttaatatgttgcctatggattccttggtgctacaatggcagagtggagtagtcacagcagagagtccttatgatccaacaaagccaaaaatattgctgccctgccttttatagaaaagtttagacagatggttcacttctccacagattgtacataagacagaaaacaataaatgatacctttgaaatgttgaaagaatataactgccaatctaaaatttcaaacttaccaaaaatatcctcccaaaatgaaggccaaatgaagatatttttagaaaaaaaaaagagaagaggctgtgcgtggtggctattgcttgtaatcccagcgctttgggaggccgaggtgggtggatcacctgagatcaagagatccagaccaacctagccaacatggtgaaaccccatctctactgaaaatacaaaaattagctgggcatggtggtgcatgcctgtaatcccagctactgaagaggctgagcgagtagaatcgcttgaacctgggaggcagagtttgcagtgagccgagatcacgccattgcactccagcctgggcgacgagagtgaaactcagtctcaaaaaaataaaaaattaacaatatactaccttaaaaataaagacaaaaagtacaagaatacacagaaagtgaaagttagcagatgaaaaaagatatactatacaaataacaaccaaaagaaagatgctgtagtaatattagtatcagacaaaacagattttaaggcaaaaacttttaagaaatgagatacttcataacgacaaaagccaatttaccatacagataacaattataactttgtatttacataataacacagcttcaaatacagaaagaaaaaaattaaatgaactaaataggaagcaaatgtatagtctcactagcagactttaaaaaatctttctcaattgatagaataagctgtaagtatacagattttaacataattaacaaacttaatctcctgacacatctagaaattgtactcaatactcaatacctacctataggctgtacattttttcaagagcacaaaatgtttacaaaattctgcaaagactgacataattcagagcatcctgtctgaccatagtagaattaaagtcaacaagattgctagaaaattcccaaatggcacaaaattaagaaaaacatttaaaaataacccaaggataaaagatatcacaatagaaattataaaatattttccactcaaaaattatgaagatgctacataaaaaagtgtgatatagttctgatagccctaaacaattagaaaagaagaacagctgaaaatcaacgatctaagtacctaattcaagaggttagaaaagatccacaaattaagctctaagaatggaataaaataataaagaacagaaagtaataaaactcaaacatacaagaaaaaggactaaaaacagtaatgtttttaaaagccaagtaatgtcaggcatggtgactcacacctgaaatcccagcaatttgggaggacgaggtgggaggatagcttgagcccaggagttcgagaacagcttggtcaacatagtgagaccccttcctctacaaaaaataaaaatcttaggtgtggtggtgtgtgcctctactcccagctatgtaggaggatgaggcaggaggatcacttgagcccaggagtttgagactgcagtgagctatgatcacaccactgcattccagcctgggtgatagaatgagaccctgtctcaaagaaaaaaaagagtcaagtaagattgataaactctagcaagactgagtaagacaaaataaagaaaacacaaaaaaccagtatcaggaataagaagtggcacatcacttcagatccatacaaacatttaaatgataaaccgatagtatgccaataaattttaaaattagattaaacggaacaatccctaaacataatttgctaaactgaaacaaaaagaaaaaggaaatatgaacagtcctaagtactaaaggcatagaggctataattaaacacttttcccaataaaagcttcaggccaagatggcttccctggtgaattccactaccataaaaaataactttccctctctcacaattttttcttccctcaccataagctaatgatcttgcctcacattttagaaactatggcagctatcataatagtggcctcaatcttcctgccctcaactgacatgcaggtgcacccatcttctccacctttctcagtattacaacacaggaggtgacctctgtacctattcaaggtaaatccccctttcctttctagattttatctcctttaaccctgtcaaacactttagtccttcgtctttgtcttgcaacatcaatgtctctctctccattaaggcaatcctatcagcactcaaacatgtcatagcagctcccatttcaaaaataaaacaagtattttttcttgactccattctttcctttagccactgctccatttctctttccctcttcgtaggggaaaaaaaatccctctctaaaaagttatctaaaactatctctaatgtctacttttcactcactcttttaagtataaataatatctgatatataaaaatacgtaattcatgtgtggattgttcatggcatcataataaaatgaatgcttaaatgaaccagaatctatttctttccatctccactaccatcaccctaatcaaagttactatcatctcctggatagactattgtaacaaccttttaacttactgcctgctttatgcctcaagttcaatctctataaacagggttattttctaaaaaccctgcagtagaatctctccatgctttggaactcacttagatcatctacaaagccctgcacaggcaggctgctacatctctaatcttattctgtaccagtttcccctcactttagtcacagcagcttccttttgatttccagaacacatggcattctctgctgtatcagatcctttgcattgttgttcccttagcctggaatacttctcttttcctcttccccttactgttttcttcttctgacccttcaggtctcggcttaaatgtcacctcttcagaagctcccctgaccaccctgtttgaagcaggtgtcctcatcccaccccagttactctttcttatcctccaatttatctcatagctgggaggtatggcaaccaccattttagtttgtttttatttgtttgccaaattatctatttctcaaaatttaatcttcatgaaggcagggacctggtccattttattagctgctatagcccttgtacctaagccagttcacagtatatagatgtataatattgattaaatacatcaatactatattttgattctcaactgcttccttgtttgtattagcaattagttaaaaacctggaggagaggtggtgggttcctccaaagtttctgtagccttgcaggtgaagaaaactaaataatgagtaaataagtttgccttaagagaaatcagtggggacccttatggaagcattttcaggtaaatgagggaagaaatgtcagataatgaaacaaatgagaaacatgaagttaactggagaagacagacctgaaagggatattttatgcaagtttgaatgaagaagaaataaaataataattacgaaaagcacgtccccaggaaagcagaataggatgagatgtttcccaaaagtggaggacagagagagagggagagagaagatgggggtgagagggacaggcagtgagatgggggatctcttcctctgagacagcgttgaacaaatatatcttcaaaattatttcagatgttctggtgaacatccccctatagtctgttacttcaaataaatcccatcttcttggttctgtttaactcaccaggatagggaattcttgaaatttctctcaccgtcacccatggtcctttcccattctccaaatgagatatcatgtctggtttggaaactgcaagccctgtccagagaaaaataaataggatttgattggagccatgagcaagaactcctgccaaattcagtctcagttcttaatcttctgggcagaatgaccattacaggaagttctagagctgcactgtctgatacagttgccaattgtcacatatggctatttaaatttgaatttaaataaaatcaagtaaaatctaaaattcagttcttcagatggactagccaaatttcaagtgctcaaaagccacaagtgactagtacctgccatattgtacagtgatgttttagacaattacaaagacatctcaaaggaactcaatgctatgattctggtttggtgggataatagattgtggaaataaactgagtttagaaagaaattgaatacatttgtttctttcttctagaggtactgataacttccatttaaggcagtgactagaaaaaactttggtccaaaatctgtggggttgtcaacaatctccaagattccagtgaaatgtgtgtttcttactctacaatgggcagatcatgtagttaagagtgaggaatagcataacccaacaatgtgcccctaaaatcaagtacttcagttaagtactttagaggccctttatctttggcaaacctggtcaaatgggcagatcaatcaacacagaagagaagttatccttacccagggagaccagattcctgtaattctctagcatcacatccttgtgcaggttcctctgtgtagggtccatcaacctccactcctccaatgtgaagtctatagccacatccttaaatgtcaccgattcctaaaacaattacattgtgatcacttagaaactatacaattagacttgttaggcagaattatacataaaaaactggggaagagccccagaaaccagaatcaccaaatgatcatgtaggtcaaccagttcatcctttataggatgtataaatctctccagtgacaagaacttgaaaccataatatgctgcctatatcatcttcagagtttcatctgatagcagaatttcttttcagaccaagtctggcttcctataaattataaatattggctccactatattatctggagtcaaacagcacggtttcctccttccctagaaagtatttaaaatacttgataacagccagcagtttccatccaaatcatctttcttccttaaaaccctggcttatctaaaatatcaattttctttcagttctaatctatagactatgacttactaaaagatacattttatcatttgtattgtggatatagaatattataagctttctctttgaaaaagaaaaataaaaaaaatcgaggaactttgggtaagttctttggtctggatatgtatatgtattaaaaaatggaagaacaggccataaacattttcaatgttacctatcggagaaaagagggagtagagcggactggaatgacagctagactcctttgaatatttgttttgtagacttgacttttgaaccatgtaaatatattataaatgaaataaaaaattaaaaaaaaaatccctgaaaattaagagtaacatgaaaccagctggtagcatactcactcattagagaggaactattttgagtgactttgaaacagtaatttttctgtatacattgcacaagatataccctgagaaaaataactgcaaaataaaaacaaaaccacaatgttttcagtaaataatcatattaattacagtgacagacatgttattgtttaactgctgtgcgtgtagtgcttgataaagcaaattagcatactgacatcattgataactaatatatttggcatgggagaaagaagatagaaatgtaatattgatgagatgaggttaaaaactccatagttctgagtttgaataggaagtatcactagagattcatgaagcattttaagagaaaaaaaaaaaaaaacacatttcctagcttcagccactgaaaaggcccagaaaccataaccaataaggtggcactatgcaagccagactgtgggctctaaatattacttccccctaaaaggaaccagggcctagaataccctgacatattaaaaagcaaggaagctatgaaagactactagggtcatatctaagacacaggagacaacttgaagaggcttccactggccaatgatatgacaatttgagcatcaataaggataataactgcaatggatttcaaaagcatctaatacagttacattcatgatacattattttaaaaatctcatctattatctttggagaatacctggaaactggtaagtaaagagaaagaatcaaacttttgtcctttcttacctatgcaaagtacatatagtttgtattgtaatcaaacataattaaatagttgctgagggaaggtttctctttatggaagtattttagctaatgaatgaagaaggaacaaaagaattagaacatcacaatttgcaactactaatgaattaaagaatcatcagcagctgctaacataaaagaaaggcctcagttagctagtatatgtcttctagtggtatataccagcaatatgcaatgacattgctgaaaatattttaaaaatcaaaaatctcagggccgggcgccgtggctcatgcctgtaatcccagcactttaggaggccaaggcgggcggatcacgaggtcaggagatcgagaccattctggctaacacggtgaaaccccatctcaactaaaaatacaaaaaattagccgggtgtggtggcgggtgcctgtagtcccagctactagggaggctgaggcaggagaatggcatgaacctgggaggcggagcttgcagtgagccgagattgcgccactgcactccagcctggtacacgaagagagactccgtctcaaaaaaaaaaaaaatcaaaatctcagccgggtgcagtgttgaataggagtggtgagagagggcatccctgtcttgtgccagttttcaaagggaatgtttccagtttttgctggttcaacatgtgcaaatcaataaatgtaatccagcatataaacagaaccaacatagtgttggaagttctggccagggcaattaggcaggagaaggaaataaaaatcactagcattcttatacaccaataacagacaaacagagaaccaaatcatgagtgaactcacattcacaattgtttcaaagagaataaaatacctaggaatccaacttacaagggatgtgaaggacctcttcaaggagaactacaaaccactgctcaatgaaataaaagagatacaaatggaagaacattccatgctcatgggtaggaagaaccaatatcgtgaaaatggccatactgcccaaggtaatttatagattcaacgccacccccatcaagctaccaatgactttcttcacagaattggaaaaaactactttaaagttcatatggagccaaaaaagagcccacatcgctaagtcaatcctaagccaaaagaacaaagctggaggcatcgcgctacctgacttcaaactatactacaaggctacagtaaccaaaacagcatggtactggtaccaaaacagagatatagatcaatggaacagaacagagccctcagaaataatgccacatatctacaaccatctgatctttgacaaacctgacaaaaacaagaaatggggaaaggattccatatttaaaaaatggtgctcggaaaactggctggccatatgtagaaagctgaaactggatcccttccttacaccttatacaaaaattaattcaagatggattaaagacttacatgttaggcttaaaaccatgaaaaccctagaagaaaacctaggcaataccattcaggacataggcatgggcaaggacttcatgtctaaaacaccaaaagcaatggcaacaaaagccaaaattgacaaatgggatctaattcaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaccccatcaaaaggtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttaggatggcgatcattaaaaagtcaggaaacaacaggtgctggagaggatgtggagaaataggaacacttttacactgttggtgggaccggaaactagttcaaccattgtggaagtcagtgtggcgattcctcagggatctagaactagaaataccatttgacccagccatcccatgactgggtatatacccaaaggattataaatcatgctgctgtaaagacacatgcacacgtatgtttactgcggcactactcacaatagcagacttggaaccaacccaaatgtccaacaacgatagactggattaagaaaatgtggcacatatacaccatggaatactatgcagccataaaaaatgaagagttcatgtcctttgtagggacatggatgaaactggaaaccatcattctcagcaaactatcgcaaggacaaaaaaccaaacactgaatgttctcactcataggtgggaattgaacaatgagaacacatggacacaggaaggggaacatcacactccgggggactgttgtggggttgggggagggatagcattaggagatatgcctaatgctaaatgacgacttaatgggtgcagcacaccaacatggcacatgtatacatatgtaacaaacctgcacatcgtgcacatgtaccctaaaacttaaagtataacaataataaaataaaataaaaagagggggaacaggtttaagggatgtaaactactctccccacttctgtgagtataatgcttattatgtatcagagactgctctaagggcttataatgtactgaatgaatcatcacaataaggaaggtgctatttacaaataaggaaagtgaggcacagagatgttagatgtcttgcccaaagtcaaagaagcagaagaatctagattcaaatccaagcagtctatattgagaattccagcttgtaaccttgtaatcattctgatccatgatctagtaaactaagagccctgattagctgactactcaggcaaagaagtcaacttagatcatatttggctaaggtctgttctggatcagaagaaagatttcctctggggtgtttttctaccatttagatatgtatgcttgtcatacatgtcttatgtatatatatatccctttgtagttttgaacctttaggtttttgaagcttgttttagataattctgctaataataagacatggcgaatgtaggacatgttgagttcataaactttattgttaatcacttgacatgtgtctgtaaccaatgtactgggttttgttttctttcttcaccaagaactcagccccaggaaaaaatctgagaaggccctcatctctcatctatagcttaccttgaggctctgtacaagcaagaaatgactaaggcagagttgcaacctgcctgcctaagagggaaatgtatgcccaacacatacaaaggcccctttggcagtcgctgaagacttactggtttaaggcaaaaagaaatctgtctaatcattaactatcaccatgttaaccaagcagatattttagtggctatacatgataaagaatacagactttacagattggtccaggaaagtttctaaacaaagcaacagcaccagcaacaactgcaacaacaaaccccagagaggggagaatctgatttccagagttgccacattatattatttaaaataactagctggttttcaacaaaaaattataagacacacaaagaaacacgaaagcatggacccatacacagtaaaaaataaagcatcaatggaaattacctccgaggaagtcaagacattgtacttattaaacaaagacattaaggcagctattataaatatgttcaaagacctaaagaaaaccatgtataaagatttaaaagaaattgtgagaatgatatttcactaaatagaaattttagagttgaaaagtataataactgaaataaatgtaccagtgagacataacaaatttaaacatatactcacctaacaaaagagtcccataagacaagaagtaaaaatttataaaattgaaggggcaaagagataattcaacggtagtagctggacaaagtgaaaacagtgctcagagggaaatttatagctataaaatgcctacaatttaaaaagaagaaatcagtaacctaaatttataccttaaggaactagagaaggaagagtgaactaaattttttaggaagctgaaggaagaaaataataaatattagaatggaaataaaatagagaacagaaaaacagcagaggaaataaaaaagggcaaaaattggttatttggaaagataaaaaaatggcaaacccttagctagagtgactaagaaaaaaaagagagaagacacaaattactaaaatcagaatgaaaaagaagacattcctactgaccttaaagaaataagaggattataaaggaacactatgaaccatggtatgcgaacttagatgaaatggacaaattcgtagaaaggcattaactaccaaaactgactcagtgtacagaaaatctggatagatctataacaagtacacttcccacaaagaaaagcctaggttcaaatggtttcatgtgaattataccaaacatttcaagaagaattaataccaatccttcactaactcttccaaaaaatggaagggaaaaattccaaacccactttatgagaccaatattaccaaaactagacaaagacctcagaagaacaccacagaccagcatccttatgaatatggacacaaaattctcaacaaaatactaacaaagtggattcagcaacaactaaaatgccacatatactacagccaaatgggaattatcttaggaatacaaggtttatgtaatatcaaaaaaatcaatcaatagaacaaagaacaacaactgcacatcatcttaatagattcaaatatgtatttgacaaaattcaacaaactaaaaatagaagcaaacatcatcaacctgataaagactctctatgaaaacctacatctagcctcatacttaatggtaaacagctgaatgcattcttcctgagatcacaaagacaacaatgtcccttctcacttttctttttctttctttctctctctctctctttttttttggatacaggatcttgctcatcgcccaggctggagtacagtggtgcaattttggctcattgcaacctccacctccccagttcaagggatcctcccgtctcagcatcccaagtagccgggattacaggtgtgtgccaccatgcctggctaatttttgtattttttagtagagacagggtttcaccatgttggccaggctagtctcgaactcctggcctcaagtgatccacccacctcagcctcctaaagtgctgggattacaggcatgggccaccatgcccagacattccttctcacttctattcaacattatatcgtacattttgcaagggaaatttgaaaaggaaaagaaatacaaggtacccagacaggaaaggagaaagcaaattttgatttgcaaatgatataatctctctatacagttaatgttatcttgcatataaaaccctaataaatccacatatacacaaacaatttagttctattagaataacctagttcagcaaggttcaggatacaagatctatatgtgtgtgtttaagtcaattatctgtatacactatcaataactatttcaaaaggaaattaagaaaaaattcatttataatagcaaaaataagaaaacacaggaatgaagttttaacaaaagatgtgtaaaacatgcacactgaaaactataaaactacaaaactgaaagaaactaaagaatacataaataaatgggaggacaatcgatgttcaagtatggaagacttaatcttgcgaatatagcattactctccaaattgatcaacagattcaacataagacttataaaaattccatctggctttttttttcctgaaatggaaaagctgatcctaaaattcatttggaagtgaatttgtttttttaaaacaatactgaaaaagaagaaaggtgaggcactcatacctcctaatttcaaaacgtacttcaaaggtatttccaaaacttagttcaaagctacagtgctcaagacagtatggtactgacattaggatagacatttacatcaatggaatagaactgacagtctaggaataaatccctacattaatggtcagttgatttttaataagggtactaagacaatgagtagagaatagtcttttcaacaaacagtgctgagacaactgaatattcacatgccaaagaatgaagctgaatctctacctcagaccataaacaaaacttaactcaaaatggactatagacctaaatgtaagaactaaactataaaactgttagaaggaaagacagaggaacatcttcatgacctccgatttggtaatgaattattagatatgacaccaaaagcacactagacaaaagacaagaagagatcattaggacttcattaaaattaaaaacttctgtgcttcaaaggacatcatcaaaaactcaaaaagccaaccgaagaatgtaagaaaatatttacaaaccatttatctgaaaagggatttgtatttagaacatataaagaacccttacaagtcaaacataaaaggacaaataacccaataaaaaatgggcaaaggacttgaatagatatttctccaaaggagatatacaagtggccaataagtatgctcaagagaagatgctggaagttcttagtaattagggaaataaagtctctaagatacagtaagctaccacttcacacccaataagatgtgtataatcaaaaaagccagacaatatcaagcgttgttgaagaagtagagcaactgcaacactcatacgttgctggtgggaatgtaatatggggcagctgctttgtaaaacaatctgacagttctccaaatggtttaacatagaattatcatatgatccagcaaaattccaaccctaggtatataccaagagaaatgaaaacacatgctcacacaaaaacgtatacacaaatgtattagcatcattattaattgccccaaagtggaaacaactcaaatactcatcaactgacaaacggataagtgatatggataagctatatccatacaactggaatattatttggccataaaaaggaataaagtactgacacatgctacaacacacataaaccttgaaaatattatgctaaaatgaaagcagtcaccaaggacaacatattatatcatttcatttatatgaaatgtccagaataggcaaatctatacagatgaaaagattagtggttgtcagaggctgtaaggagggggaatggagagtactgctagtgggtatggggtttctttttcagggtgatggaatgttctgtaattccatacagtgatggttacaaactctgtgaatatatttaaaaaccactgaaatgtatactttatgaattttatgatatattaattacatcttagtaaagtgtcattaaaaatactgccagaaggacaatctttttcttccctcccaggggaaaatcaggtaaataaataatcataaaaaatcaaaggtttgtgttgtgtgaagaacgaatgaaaaattgattgtagaatgtagaagtgtgagttaactttgaaacataaaactgctgcgacagtttggatgccttcccccaaaacctcatgttcaaaactgatccccatgttggagatggggcctaatgggaggtgtttgtgtcatggggctggatccctcatgaatgccttggtgccatcctcatggtaatgagtgagttctccctctattattagtagttcccatgaaagctggctgttaaaaagagcatggcccctcccctctccctctcttgctatgtagtctctatacacactgtctctctttccttttcactgtgaatggaagcagcctgaggccctcacaagatgcagatactggcagtatgcttcttgtacaaactgcagaactgtgagccaaataaaccccttttctttataaattacccactcttgggtatgcctttatatggcaacaaacacactaaaacaacttctaagaatgttgagggcattttgatcttgtgaaagtaaattcacttaagtatcctttattcagaaactgaactttgtcaaactgaagaaactattactataactaaagttttatttttattgcaaaaagttcctagggagctaaaagagtacccatttatttcaaatttcaccatcccagaccaactctattcataatttagacaaataaaattggaaacctaatatataatacccaaaaattgttgattctaagataatacactgatgcatacaatggaaaccagaaatcataagcctcatattctctacctcaaagacactgggcaaataacattaagccagactgatgtaaaagtttctttttgatagagttcgagaaagtaaaaattagcttatactgagaaagtaaaattctgcccttccacacctcaagctagaatagagatacagataaaaccaactgacaagttaacggcaaacaatatttcttctaaagtcattctgcagctgtaaaatgtcataattacccgttttgagcaactactgctttcttactcattagacacctcatcttttaaagtcatagactgtcagaaattgtgtagtctgaaatcacatcagaaagaatgaaagtgactttgatgctgagaagcagttatttgcaacccagatgcagactttcacatgaggggtttctgaatatgtcattttacatttaactttgtattttccaaggaaataggactccagatccattatgcagtctggacatggtattgactcttttatacagagcctattttgctgtaagcctatcacatccctgatctcattaaaatttcatcagaattccctccttcgtcaagattatataataacccagctgggtgccatggctcatgcctgtaatcccagcactttgggaggctgaggtgggcagatcacttgagttcaggagttgaagaccagtctggccaacacggtgaaaccccgtacactaaaaatacaaaaattagccggacatggtggtgggtgcctagtcccggttactgggaggcttttaaaggcttattatctcctcttcatcttgaggctatgcttatctagttgtttgttgttggtaaattaagttgtttaccaaaagttacaacatatatactggcactatgatactcagaaaatatcaagactctttgtcttgatgtgttccttttggtctgattataataatcatgcaataagagttcttcatcaatcttctatagtttctttgttagacgtttgtactaaaaaacatgtacctgtaaaataaaagacatttagcactgaaatttcttcttttaaaggactacgctacaaaaaaaaaaaaaacaaaacactaattgaaaatgtcagccgggcgcagtggctcatgcctgtaatcccagcattttgggaggctgaggcaggcaggtcacctgaggtcaggagttcaagaccagtctgactgacatggtaaaaccccatctatactgaaaatacaaaaattagccgcccgtggtagtaggtccctgtaatcccggctactcgggaggctgaggcaggagaatcgcttgtacccgggaggcagaggttgcagtgagccaagattgtgccactgtgcctgggtgacagagcgagactccatctcaaaaaaaaaaaaaaaaaaaagaaaatgtcagcaatagttataagaaaatcaagcaaatacaaaaccaattaaattaaattaataacttattgatagttattatcaaatcactggttctattaaaagtaaaattaaactaagctatgtttagtatgtataataaaaaggatgcagaatttagggaagagccagacagaattaatcttctaccagggactccctttgtcagaacaaaaataaaccatatgaattgtacaccatgtcaaaaagtatggcattttctaaggtttatggttcaaagtctaaaactatgaatatttctactctaagtttttaagaatctaagctatcgtatgttaaaaagaatttaaaaaatcatttcaaaaatactatgtataaaactgaatctcagaatgtattttctcatagaagcaaaagtaaaaaccacattttacaaaaaacatctctggaataaaaccaactttcaaaggataattttaaaaaacttaaaaacataattcttctaaaagcatagtgaatacttgccaaagatttacataagtcattaatgagggatcagaagcttgacaagacaggtttaaaggagatgcaagaaaccgatgtacagatagtggaaaaaagaatgctggaataagactgcaaaattggatacaaacctggttaatgtcctacaggacagtaataccataactttggggattatcttttatcctagcaaaaataattgcaatgtttcaatcttctacaagttaatatctaacttttaggatctaaatattaattaatagtaaatggtaagtcaaacaacataaccctcccctgctatgtcagataacccttagacaggcttgttaagacaatggtctaatatgactctgaaatggcctacatttatcttttatttatttctaagttttggataatttttcttatcacaacaaatttctgatttttattttttctggaaaaatgaagtggattcactactcacatataagaaatcctgaagaaataaaatatctaaaccaatttaaactcatcttaacactatttccacaatgttgatgtactcttggtattttttaatggcacagtattgggtcttacaatgcagcacaagcttcagactacgtaatgataggatattttaccattagtaatcacgatgtgactatctggctagattacggctgccacctctgagagaaatgaaatctgttaaattgatgccaccagccctggggctaccacaccaatcaaataatcattgtgaacttgcaattaactgggaacattgagaatcagaggcagtaaaataggcattttctctgtattcattatatgtacaacagtaggtattacctttaccaattgtgtttcttctgcctgaaggtgaagatcttcatctggctgggtaacttcagggctctgatgggatacaggataagatcattcagtgataggctgcctatgacttacagcagagcctcaacaagcaccaccaatccactgtggatgcagtgtatacaggatgacctcacctactgttttacttagggctgaaatcaaagtcccattgtaacatgcaatcataatctttcactttgtttgggacaatgacaaacacacgtaagattgaaaaagatataactgcttttaaaaaagaacctatcaaaacaaaaataaacttataataaagtgccttcagacactacataattctactttttcatattgggatgaaatctatttctcagaaagtatctatcttgctcaagaataacactcaaaacctactaacactatctgttttctacaattgaaaaatcattacagtgtttggtggggggatgtggctcaacagtcactcaggaaatatttcagcaacctctcataacattgttttcttccaaaacttagaaactgtatctccatgagggccttatttatttatttatttttatttttattttttattttttttgagacagagtcttactctgtcgctgcccaggctggagtgcagtggggcgatcttggctcactgcaacctctgcctcccaggttcaagtgattctcctgtctcagcctcctgagtagctgggactataggcacacaccaccatgtccggctaattttttgtactcttttttttttgtggagacagagtttcaccatgttgcccaggctggtcttgaactcctgggctcagataatctgcccacctcagcctcccaaagtgctaggattgcaggcatgagccactgcgcccagcccatgagggcctgattttatgaatgcaatgaaattttactttaccttctagttgtagttatccatttcagatgctgtgccatttaaaaaaattatggataataaaactacataaagatcactatgaaaaaatgttatgctaactctccctcaacaacatcttgtctaaaaatgcacaaatattcagattccagaaaattaatgatgatgtgaatcttctatctctgatagagacgggttgatcccgtgatacacgattagacaaatatggttatacctggtgatcaagggcaacattttggttttatttatcttttcaagggtattttaaaggactatttacatgttacatattctggctacaaagaataaaagaccacaatcacgggttattacagatcattactataacaaattatatttgttggtattctctttcttctgaatctattttaaagtcactgctaaaacacagcttttatcacattaataataatcccaaggacactcaaacacacacacacacacatttaaatgtcttcagggaaacattaaaagattcatcttaaatatctaacttccagccctatctgtcacaactttccaacttgaatcacaagctcacccactgttctctgcctctgaagccttgcccttaaacccgtttctcacctgaactatcttcataaatactttatgacaattaaaatctcacttgtaattcagtaccagcttaaatctaactatccttatgaactttctatgaccagtttagcccacactatcatcccatttctttctttacatagcactcatctttatcataccgataagcaactactgttcacccaaataatgtaattattacttttgtacattttacctcaatgaaactgtaaattccctagagccaagcactgtcttaaacatattctctcaatgtaatctattaaatctaatcacttcttaatgagtagaaaagagatcactgagagtggcacaaggggaatggttcctgtgaatcagggctggggtatgtgtttgtgtacatatattttccccataatttcctatataaaattttccaattgaaaaatattccattttgctgtcccacaaataactaaaatttcctgggaacaatacaaatttaatatcaaaattaaagatgcctgtcataactaacgacagctcagatattttttgaaagatcatgtgtcctgatatttggttaagtaagtatagtgaatcgtcccatagtttactacccttactgtgaacccaattttcatgggtctatttagttgagttcccagaaggggtgtcgggggaagtagagaagtcgcaagccttcaggcaaagtaaacatgctctcaaaccaagatagtaggtcaaaaacagggaatcccaacttaccaggcgtccaactgagaaaaacacagcagccataatctctccctctggtttcccctctctggaaagagtggagtcttgcaaagacatacctaaggaagagaaataagccatggaaaccaatcctgcctggggaatttcagactcaccaagttggaatcctgacatacaagtgagcatgacctccctaaggaagcacaagagtaacccttaagatcagtgagggacaaagacccttgctccggcagagctcaagattttagcactgttaactatagtcacaactaacaggctagccattgtacaaggaggttttaaaatactttctcattttattttcacatcaacctagtaggaataatattcccattccatagatgaggaaactgaacctaaaaaaattaaagtacccaaggccatgcagatacatgaccccaaatcaatctaattccaaagcccataccttttccactgaatcaacatgctgtgtgaagtacgaaaaaaaatacttcagtctttctttgccacaatcacttactcatctaacaattaaatattctaagaatctccttttcttgcctttcccacgaagagtctatttcctaacattttcagagatctgtttcatgtaaagagaacactacgacttcaaaatttaaatgatattggaaatcttgatttacccctccgaatctgatattcaaatagatctttatcctttctatatcaggcaaacttaaacaaaaaggaagcaggtataataataataataataataataatagaagagacatgaaattcagtgcacaaagcattaagctatagtctttttatattgaaaaaaaagtatatacctaataaaagttttatcctatggagcaacagggtggcagagatcttttccagggatgcttgggccctgcttttctacctttggctaatgatatgtatggccttgctgaggctgagtttggttcaagaaccaggagtgcctgatgtaggatatcaaacagtacagattgtcaatataaattcttctaggatggtaatactagcctcatgaatctttattcatgagggcagtgacataataagtattaagtttttgtacaaaaagtgttataagcaattatatggtcctgcaagtagggcctttgttatgcttaaacatgtggaatctgctccttccctgaatgtgcaccttgcttctcataacgttcagtagctttgctcaataaacatagcagaacttaatctaaccttacagtgtctaacaatcagaagctcatctgaaaagatacttgaagtacttaaccattattctctgaaaaacaagaatatataaagcaaggttatcaagaatgcaaagaatattagagatataaaaattaactagatatgggtatactgaaacatatactgtcagattaatgtattaactcaaggaggagaccagggttagttaaatcaagaaaatatgtaaatatcttggctgggcatggtggctcatacctgtaatcccagcactttgggaggccgaggcgggcagagcacctgaggtcaggagtttgagaccagcctggctgacacggtgaaaccctgactctactaaaaaatacaaaatgatcagccaggtgtggtggtgcacgcctgtagtcccagctactcgggaggctgaggcactagaattgcttgaacttgggaggtggaggttgcagtgagcagagattgtgtcactgcactcctgcctgggcgacacagcgagactccatctcaaaaaaaaaaaaaaaaagtgagtatcttaaaaatgtagagtgacctgtttcatgacactggggctttcctaggcacaatgaaaaggttttggtggaagagaaacaatgagaagttgagggaggaaagcggtacagtgtggagataaaagaggtaaagaaagaatagtctgaggggattcctgtattgaagcctcaaggtaaccagtaagtggttttgccttatgccagtgtttctctagatttttctgtcatagagccttttgcaaatctaatgaaaattatgactcctctcctgttttctaatgaaaacgccacatgtataactagaggggtctcaaatctgagaatgcaaaaaactcactggatatgcttattaaaaaggaaattatttggccccatccaagatcaaaatcaggatctctagatgtgaggcacagaaatatacagcttgaacaagtacaccttaagaaatatttagtttaatataatgttaacatgttaattatataatgttaaattatataatgttttagttttagtgtaatattttaagaaatattgcctgttacacaatagggattctgaagggtgaaggagtgggaggggggtggagaataaggaattacttaatgggtataatgtacgttattctagggacagataccctgaaagccctgatctcaccactacacaatctatgcataccagtaaatcttaatttttgggggggtacggacccatctgagaatctgaccttgtccacaaaataatgcacatgcatatatgatgttgcatattacttcagagagcttgaaaactgactctccctcccaagcccatacactgacccccaagttttacaaggttgcaaagaaaaaaaatgagccaagaatattgccccatcccgcaacccccgaacactaaagcagacctacaaagagcaacataaggcattttcaattccgaaggtctagagtaatggttttctgcatctttaacatttatcaagagtgagctgagtcatcatttttaaaatatttgtaaatattaataaactctttggcaatactttatgtagattatgtagattatgctcgtaacatatgtttaacaaccaaactacaataaatcccttgttttattttataattagaataaacaatatttaacatttaatatattcagcttgatctcaattgtgcaaatgtaatgcatagaaaaaaagactgagtaacccaaaactctactgagacctctgagacctggggctgtgatgtttacccttctttctgcttttctgtactctccaagcagacaagaagaagtatctacctatacataggagtgtggaataggaataaaatcccagagtggctggccacatccccaggttctaaccctgctttggctaccgtaaaactgtgaccacaggcaagtcacttgagcacaacgaatcagctattagtacatgacagtagccaccttatatgtttctactgtcccctttgtcattatgcagaagatatctaggccactattccccagttataatttccctatttacaagctctgtctttccaactattgcaaacgtatccagagacttaaggagaaactttacttgttttgcttccttggccagtgcagttatttagaaataatgaagggtccatgtttttgctgagaatctcagcgccatgtaccagtccagcatttcccaaccaatgcaataataccattgtcatgtcagggagtgacaagtgattaaaaggtgattacagtatttgaaatgtgacatttcaggaaaagctgcctcggttactgagtagcgcaggtcccccgatgtggaacctagttccatccctgccagttcagaagccagagcggatatgctcctgccaacctcgccttctttccctaactgctctcctctacccacttcgggtatgccctcctcagggcctgcaaggcgcggggctgggaagaccgggaaagtcgggtcaggggcccgcccgccctactcgactccctgcgccctgcgcccggctctttttaaccccagcgccgccaggcccgcagggagggggttcccgggtttggacccggactaggaggccgcatagggcacgcggccctacctgtgagggaggccagctggagactgaacccacactcgggaaggaggcccagccccaatcgcctctcaggagtgggcgggtccgctcagggacaggggctctagagggaacggccacgccccggacgccgccgggagccaagcgccaagggaggggcggcgggcaaccgaggccaggcgcccgggacaacgagtacctggcggccgaactgaggacaactgagggaactcgcagagcagggcgggaacgcttccagcaatggcggcggctcggcggtgccggcctc

SEQ ID NO: 2380 - DNA, 197714 bp, Homo sapiens
ttcatatgacttgaattgggagaccagtagtcatgtgaggaagacactttccacagtaccctccacatttgccgaaaaatctagttccatcctgaaaatcggaagaagaaatacagaagaatcttatacaagctggtatctgtatgcaaatagcagaaaaagcaaatgctttgaatcatatggctaaaatcattagcagaggtttcctataacaattgcatttgaggtcaaagatcatatgccttttgatattagttcaaattggtggacatgggaaagttaaaggatattagataacctgagattcatattagctagttgaatattatatacaatttaaatctcaattaagatttaaatccaatccacatatttcaatctcaatccacatatttttcatctaggtatgtatttgcttcagtgagtttattaaaacctctcccaatttgcaatccagtatttacataattttatataataatctctttaaataaaagaaagatattgtacaaatgattttaaaggcatataattcattttctatcccatttatttcaagcatctcgtggaggcgttagaaacacactctggagaaaagtatagaaggtggtaaaatggagaaaataaataaataaaaactgggctgaaagcaatcattagaattagaaaagaactaaaatgggagattgttccataagcagagcagttcactgaggaacaggtggcagaggtaggctgaagtgggttggtcaggacgtgatagacgcctcacgtctttaggtctaaaagtcaagactgaagacatttccagaacatgagacaaaaataggttgaactcctatcatatctggaaaaggtaatttttttaaatctaagggagtaaagatagagaagaaaactgtaggttcttgggacattttgagatggaagaatgttttgagaccggaagcttttgaagttaccttctctttctaaagcaatttaactctggagaatctgagtacacagagaagggaatggcagtaaaatctcagagttgtataattccctattccctctgttgaagtaaaaactctatcttcattaaacttattggcaaaggaaaatatgtttgcatttctgtaagtatatctggattttaccagtcagtttcacaccaggcatcagatttcaagaactagttatgtgcaacatttttgattgagatagaacttctcaacgaaatgaataatgaattaatcttgagaagttaataaaaacacaaatccttcattaagcacaattttatcatcttcagaaatagaatgttttaaaggctatgactatcagaatactaaatttcatttatgagaaatatttatataaataggagtataactaaatttacttttatcataataaataaaagtcataaaacattagagtataccggggctgttgctggtgctaatttatgtgtgatataggtgagaacacctataacctagatccagatttactatgagcagggctatgttatctaagacacaataaccataagtaatagaaagcatttcatgaagtgtacatgttagaacaccatacctgcagaaaattaagtggattctactttggataatacaacatgtgctatagttacaataattataagaataaactataaaaatagttataactatatatataaatactacataacagtctacattttcatagataaaataacaatgttatctagataaagataggaaaacatgagtacaacataaatacataatcctaattcttgaaaaaactgtgaagaatatttgttaaatgacaagtgtctccaacaccacccccatcactaaaacagtgagggaagaaaacaaaaaatttaaccctcattttgaaatattaaaacctgtaaaccttcagtaattaaagtatagtaaaaagcatacctttcttgaacatctgtatttcaagtcattagctccaaacttgagatagacaaaatctatatgtcctggcatttggcaatttatgttcaaatatctatagcctatatatggattcataaatatacaaaacctccacatgcacattaatacaaatgaatcctgtttcatttcataaattaatgttgtgctccattatatgtaatatacccattatatgcaatatctctttagtcatcaatttcatataagtttacattttaggtagagaacctttaatgctagttcatagctcagaagtatttcaaacaggctttttggtcccgcaggacttacctctgatcttcgtatgctgacagaggtataactcccctgagtgagccactttgctgtgctggatatcttcatcccagttcctgacaaattaatgctaaactgtccctggattgtaaataaaacaaagaaaaatagatggaatttacaaaatatttgattacaaataagtcttctcaattgcaaggggcaactgaattaatactatataatgttatttgtggagaagtaactctgcccaactctaggactctatgattcgacaattagaactaatggtcctgtagaaattagcaagttctgacagaaatagtgttcacggggaccaacatttgctgcactttaacatttctacacgttccatttttgacccttcattgctaacttctatgctgtttcacctatttgacatattttccagaatctctgttattgccccattccttttgtggtaagaatattacttcttaactcaccacacaaaactatctaatataatattattttcctggcaattacatccattttaaacaccagaaacagcgtgcagatgtgtgatgccacatgatttacacacattatggtgtgtgggtcccctatgagcttcatgatctaattctttccaagtgcaggaccatttttatgtcaaaatacttcagactatctttgttaacagttaaattgtaaatattaactgagaaaatgtgttattaaaataggtaacatttgtgtcatatttatataattttacagtacagatttaaacattgaaaagtagaactgcaaacaagttcagtctactgacaatgttcagtaggcatatagattcagaacaatattacgacattctttaattacctcacaatatctcaatggcttaagactcatgaatcttgagcaagattgtgatgaaacactggattttatattatatgaatgaaaatattatcttgtcataaaagcaaaagctaaataaactctgtatatataatgtgaattattaatattgctaaaacaaatagatatcaatttagtcattaacttggatttcttagcaatcttatattgtatatttctcatttaaaaacaaatgaagatcaaatattcgcataaaacaatgacaataaatggagaattttccattgcagaaataattagttttagataaatttcaaagaaaatgtatcacatacaacatcacttggttatgaaatttagaatatgaactctatgtcagtttcattgctatattcccagagcccagaacagggcctaagttctcaataagtgtttttgaatggatgaattaagtgcagcattaaaaacattaaatagtagtattataaaagtaaatacacaaatacatatataaaactcttcagactctgataatgaatgacactaaaaccagacaaagtcgtattttatgttcacaaatatttgaataaaaagaattgattcttaggatatattattctatttgatacttaatcaacctgatacaggttttgcactgtatacctccaatctcacattccttctcagataggtttttcaccaaataaagttattaaaaaatgaaaatatattctaccatgtaaatttcttgtaaccagatgctccttgagtgctcaattgggccatgcaacctaatactgttgttccattcttccatttgctctctacctccctgatcaatgtgccttaaaaatattcaaatgtatacacattggaagtaaaaggaataaatctgactgactactgagagccttaggtggtcattaacacaattagttgagtctagaactatcgattgttccatttctctgtactaattttcatgagctttacttctgttcttagtcctcacttagaaagctaaatatgatctcaaaaaaaatggtaaaacaattatctaaaatttggtatgatgttgacggaggtaaaaatacatctcactcatttgttcaaaattaactgactggcagacatggtgtcaagtaccatgaaagttcagacagatctcactctaaatctgttaagtgaaatagcatatgtacctaaaaaaagtaattcggacgggcgcggtggctcacgcctgtaatcccagcactttgggaggccgagacgggcggatcacgaggtcaggagatcgagaccatcctggctaacacggtgaaaccccgtctctactaaaaatacaaaaattagccaggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaagtaattcaacaagagaactataagtgccataaaaaggtacttatacattcctataggattttagaagtaataaataagtgagtgtgaataagtgtgttaattccaatacttcatttaagattaaaatttaaacctcaaacctaatctttaacttaaaaattagttcaacatacgaggtcctctctctctctcactgtctctctctccatacatgcatatgtagtatgaaatgtcaggagagtagatacgtagtatgaaacttacctcttcttctactctcctgacattttgaagaagcagccactaaacaaagtaaaattccagtagccaaatcacaaatggaaggtaaaatgattcaaaagacctaggaattcaataaattggaatgtttattcttgagtaactggctgcatcaaagaaaaaggtaagtatgggtataagatagaggagaagcatatagatagatgcaagttttaacgtttcacttcttggattgactggttggttcatgtgtgctcattaaataattatgttttacagtttttaaatgtactgtacacattttattatgtatgtaatctatagatctaatataataccaatacaaattttccacccagaatctttgtacatacggagagttgattctaaaatttatatagaaaggctatggatttaaatagtcgtaataagcttacaaaagaagaatgaagctggaggacccatgctactttaacacttatcgtaaagctatcctaatcaagacgtatggtgttggtgaagacagagacatgtagatcaaaggaaaaaaaagacccacataaatatggccaatacttttgacaaaggtagaaaggcaaataagtggagaaaacattgtcttttcaacacatggtgttagaacagctgtctgtctatatgtttttgactcagacaaaaaatcaagtctataaatccctcagacttaatacaaaatttaattcaaaataaattgtaggtctaggtataaagcataaaactataaaaagtttttgaagaaaatttccaaaaggagaaaaatctcagtaatttgagtttaatgatttctcagaaatgactctaaatgtacagtccataaaagaaaaatttgactttattaaaattgaaaactgctttgtgagagatatttaaaagaaagaaaagacaaggttcggactaaaatgccgtatccaacagaagaccagaacatataaaaaaactcaaaactcaaccgtaaggaaacaaacaactcaatttttaaaatgagtaagacttgaaaacacatatcaccggccgggcacggtggctcacgcctgtaatccctgcactttgggaggctgaggtggatgtatcacctgaggtcaggagttcaagaccagcctggccaacagggtgaaaccctgtctccactaaaaatacaaaaattagccgggcgtggtggcagtcgcctgtaatcctagccactcaggaggctgaggcaggagaatttcttgaacctgggaggcagaggttgcagtgagctgagattgtgctactgcataccagcctgggcgacagagcacgactctgtctcaaaaaaataaataaaaataaattttaaaataagcataaaaagacaaaggacataaaaagagagtaggggtagcaatgttgataaaagataaaggagaatttgagtccccaatcattaaaccatgacaaggaagtgctaaaagtaataatccataaagaagacataacacataataaatattatgtatcaaatcatagagaacaacttttatgaagcaaaaactatgagatatgcatggagacacagacacaacctaataataggaaaaatcaacataccacttgcagtaacaagagagatcacatgaacaaaagtaaggacatgatctaaacaatgtaatcgaaagggtagatcttatggatatatattaaactctacaccctgataataatgaatacacattccaaatatctaacaactgactcttaacattcaaactggatgctggccaagacccactgacattagccgaatatgattatttctcttacttttatgtaattaccaaccagttaaatagatccacattacttttgttttttaaaagtttttgtggctttgcaaaaagtgcaaaacatttactttactttactttcgacatatgcattctaaagtcacaccacactccttaacttcatctcatattgcaatgtggcgaagtttattttccctaaagagtgccatatgtgtccatactcttttttagcattcctatcccagactatcctgtcacatgcaaacacagaggatttgggtttgatgaatcccaaacaacagaataagttctttctgtgacgtcaagcatctggagagtattcatgcaaatgctgtgtaacataacacagaatctggtttatatattacagaacatctccaaaaatattgggcagtttgtatttttggtaacagtagcctcaaggagacaaatacaggctgaatatagatgggcacagctccttttgacagcatgtgtctatgcccaataacaaccaattttggaaatggagctttgcgtttcagaaatgcctagaaaaccatgcaagagagacatctcgccccagtgggcaggaagagcattttattgccagttctgcctatgactttcttcaggatcttggacagactgttaacacagaatgtctgtttcttcagctataaactgggcaatcgcagtttatagctatataactttttcaagatcttatagggaaaaaagaggattacagagacattggagaaagggagttagaaagaaatggaaatagctatcttatgatttaaaaacctgattgtgcaaatatctcattcaaattccatgtacatgaagaaatattttatttgtaataattggacttatgttaaggtatttcctataagaaaattcattaataaaataaaataaaattttaattccatttgacagttatatgatttacttgtatatgcgtctcctgtgattttcttgatgtctcattgaccagacctttcccaatacaacatgtaatgacaaggaccagatttccagaactgggtgacctttccaaagtaacaacatttgttaggccttgtattagcagactaggttgcattgtcaatttacttatctctaattacatcaaatatatgaccagaaggcacagcttaaaaggaggatgggttgttggacaaagttgaccagtcttgagataggttaaccattgtagaatgtataatctccatttaagagagttgaaatggatgtgtcaccaacaaaagacatccacatatcaaggaaaaaactgttcagaatgttaaaagttttagattacacatccttgacttaagaacacgtataaaaagagacagtgcagaacttcaggagaggagggactcagcagagaaaggacagtcctgggaaggcaactgaatggaaagtagtaggtcagagtcaccatgttggaggtaggtactcatcaccaatatgggtgaaatagggaattgggaagaagaatggaaataaatagggctaaccagcctcaaagattgaatgagaacataggattcctctgcaaagttgcctgcctttaaaaatacaatcatgtgaggaaacacttctagaatggtgatgtgaggagcccatggacactctctccagtgaaacaaacatgactggtgaaaatgataactataaccaccacttaaagtctctgaaatttgttctatggttatacggaaaagggagaaacatttattcaagaaaatcttcttcaagaagacatttattcaagaagaaaatcaagaagattttcttcttgatttcaccacaccaacatggcacatgcatacatatgtaacaaacctgcacattgtgcacatgtaccttaaagcttaaagtataattagaaaaaaaaaaaaaaaggtgaaaaggggccaagagccagggaatgcaggcaacttctagaagctggaaaaggcaagaaaacagattatctcctaaagcctccagaaaggaatgcagccctgctgactgcttgattttagcccagtatgacccatttcggatttctgacttccataactgttaaataataaatttgtgctaccaagaaaaaaaaaagaatatctattaaatctaggtaagaacagtgagaacctgtggcatctgaaccatgactcaccctcttttcctcccacctcccatgactcgccctcttttcctcccacctcagcaagatgatcattctaatcatggtgaatgcagttaaggatacaggactccatttccccctagctccctgttaaggctatggtttctctttgagacaggcaggccaccagcatttctcatcccacccaagtctgtactgcagaagttgtattataggcaagagtagctgagagtctgaagctcccttcttccacccagtccctactcacagagcagtcaatctatcccaggcatggtagatcaagcacactaggcctgaaatgtccccacaaaaaatcactggtaaggcagacactccatgctgacaaggtcaaaagccaagaagaccagggattactgccatgactcagcactctatttattgagcaggggtgttactctgaggaatgggccactgtccctgtccccagatccacagtattgcagagcttcttcccagggagagaatcaagttgtaaaaataggaaattcactagcttttcctattgtgactagcttatttggaataaaacctggagaagttcaagtttaggtactttctggaaaagaagattttagtggtgtgttgttaagaggagggtagtagctcaatgaaggcaaatggtagataagattgaagtttaacagagagaatcagggaatgaggcagctaagaaaggctcttcttggggactttcctgatctcaaaaacagactataagactaattgaggccatggggcctctatttaattggatcagattatggagttatttatgcccccaaaatattgttgaaagaatagggaaatcatctagcaattagtggagactaagagctaagcatgatatcagtagagacagaccacgcataaactcaacacaatttcagggaaagagaactgaagaaagcccacctaagactattgttatccctgaaggagaggagcatcacggtcactgtgcatgcccaagactgtgcccactgaggagtaacatcaaaggctgcacactacaagggaaatagaattcactgaaacagttcagccaggtaattaaaaaaaatacacaaacaaagaagtaaacgataaccataacaagaagcctcaaaagggagggtgaaatcagtaatcacagttgctaaaatacagtacctgaaatgtccagttttcaacaaaatttatgaggcatacaaagcatgatgcatacacaggaaaaaagtcaagaaaaacttcctttgagagatatcagatgtcagactaagctgacaaaaacttcaaagcagctaatataaatatgttcaaaggactaaagaaaccatgtttaaaaaagtaaaaggaggtatgataactgtgtctcatcaaatagagaataacaataaagatgaagatatcatattttacaaagagtcaaaggaaaactctgaagatgaaaagtacaataatcaagattaaaaaattcacaaaggggctgaaattgtctactggagctagtagaattcgcaaacttaaagggatgttaatgatgcaatctgaagaacagagaggaaaaaagaagaagaaaaatgaatagggcctcagaggaatgaacgcacaccattaggtgcaccaacatatgcataaaagaagcatcaaaaggacagaagaattaaaaagagcagagaatatatttgaagaaataatgactgaaaattttccaaaatcagtggtatatattaaaataatgactgaaaactttccaaaatcagtgaaacttattaatttacccatccaagaagcttagtggactccaagccaagtagacacaaagagatgcacatcaaatatgacacagtaaagacattgaaagacaaatgcaaagagaaaatccccaaaaacaccaagagaaaaaggaccacatccatggaacccaataagataaacagctgacatctattacctacttagaagtcagacagcagtgtgatgacatattcaaagtgctgaaaataaaaaactgtacatcaataatttttaataagcaaacctatcattcagaaaggaaggcaaaataaagacactcctagataaacaaaactgagaggacttcttgctagcacatctactttacaagacatactaaaggaagttcttcaggctgaaatcaagtaacatcagacattaatacaaatcaacttaaaaaatcaagagtgctgataaagttaattatgtagataattataaaatacgctataattgcatatctcttcacttttcttattttaactgatttaaaagcaatcgtataaaccaaggtgtatataagtatattattgacctgtaatatatagacatgtaatatatttgacaataatggcacaaataagacagatggaagcaaagctgttttagagttaggaaatgacacaagacgataagtcaaatccacaggaagaaataaagagaaccagaaatactaaatgagaaggtttacgtaacaaactctatgaatatacaattgctctatcttctctcatattatctaaaagacataaaattatttaagttaatataataccaatatgttgcaagtttgttgcctttataaatggtatatgtataacaaacatagcagaaaaagagaagaaataggtcatttatagtagtactgtctttatatttcactggaaagagaggaatgttcaatagtaaaatgtaaagtacattctgataagatatatattgtaagcctttgaataaccactaacaaagcaattcaaaaataatgaaaaaactgaggaaattaaaatgttacaccagaaaacattcactgaataaaaagaaagcagtaaggaggaacagttgaacaaagacaacatgaaacatatagaaaacaaaaagtaaaatggcagatgtaaatccagacatagcgatagtgatgttaaaaaaatccaatcaaaggcagtaatccaacaaaatactctataagagacattcttaagagccaaagatataaataagttgaaagtaaagggatgaaaatatatatagcaattctaacagagctggagtggccacactagtatcagataaattagcctttaaaacaaaaacattactgtagataaagaagaatattttataataataaaaaggtcaatatgttaggaagttatgacagttatatattcgtgtacaacaaaatctcaaaataaatgaaacaaaacaaaatacataaaagattgaattgagaaacagacaatttaaaaataatagttgcagagtttcagcagatagaactaagcagaagatcaacaagaaagaaagagttgaacaacaatataaaccaataaggtctgtagtctatagaacacttcacccaacaacaacagaatgcacattcttcccaagaatgtattgaatgttttccaggacaaactatatgttatgacataaaataagcctcaataaatttagtggataaaataacacagagcgtgttttccagtcacaataaaggttgaaatccaaaaaaagaaaatttgggaaatttacaaatatgcggaaattaaactccacactcttaaataaccaatataccaaagacctaactatagataatagaaaataaaataaatgaaaggaaacacaacataccaaatattttgggatgcaacaaaagaatcgattaaaggaaaatttatgactacaaatgcctatattaaaaaggaaaaataatctcaaatcaataatctacccttctaccttaaaacactggaaaaagaagagcagaggattgtaagggaatactatgaacaatgtgtgacaaccaattagtcaacttagataaaacaaacaaattcctagggagacataactaccaaaacaaattcaagaacaacaaaaatttgaatacatctataataaataaagagagtaaattggtaattaaaacaactttcacgaagaaaagcccaggctcagatggctttgctggtaaattctaccaaacatataaagaataatttttttgcaaactcttcccaaacagtacaagaggaaaaaacacgtcccgctacattctataaggccactatttctgtgataccaaaatgagacagatatcacaagaaaaaaaatgatacaacaatttctactacaaatatgaatgaaatattctcaaaaaatagtagcaaaccaaatttagcaatatatgaaaataattacatcccatgactaagtgggatttatcacaggaacgcaaggttgtgtttcaacatataaaaataaatcagtgtggtaacactctatcaatccagtaatggacaaaaaccacaggatcttctccacagaaaatccagcatcctttcataataacacttaagctagaaacaaaaggctgtgtcctcaacctgatcaaggacatctagaaaatactcctagctgacatacttaacatacacatgaaactaacatacttactgctgaaggactgaatgccttttgcctaatattggaaaacaaggatgttcactcttgccacttttattcagtattgtaatagaagatgtagtccgcacaataaaacaagataaagaaattaaagatatctagattgaggaggaagtaaaattatctttattcacagatgacatcactgtgtataaagaaaatcctaagtaatctactgttacaactaataaatgagttcagcaaagttgcagaattcaagatcaatccatacaaatataggcaaaaattgattatttatttgggccccagatttgggttctccttaccaaccactctacctgtcaaagccttcttaatgttgagctggaacctactgccctattaatgcctctggaggaacacaagcaacctcactcctctttcatggtagttctttaaatatgtaaagatcgttaccattgtctctcactcttttcctggctaccttctccattttccttagttgacatgattcaaacccttctttctttcctgtgatctcctcctactcctaaatagattgaaaatgatgttttacagacagaaattttaaaataactgtaatgttccagtgtcaaataaaaataaatccttcagtcttgctattttgttttggaaccttacgattatattaggttgtttataaatcactccctgacctaaaggagtcatactgaactcatgctgggcgaagaaacacctatgtctttttcatgtaacatcaccactttccgtttgagtttctggacctaagttaagatgtatagatttattcaggttcttactcattttagcctgtagttctagtgtctcttgatctcctttaagttctctaacagaaaatgtcctctcttcctaatataagcgtaacttagatgtcatataatgaaaattataaatggaatagtctaagaagagactatgacaaactattaactacttctcttcaaaatgatatcaatatagtaattaccacttgtcttaggtagtagatttgattcatatattcaattagcaatgagtcacctaaaagtgctatattcatctagcttacaattcttcatctatcataaaaatgttcttttcattatctatgtaaaatctctagttaataatgtgagagaatattttcttctaggaaaacatgctctgtattggaaatcatggaaatgacataagagcatgtgaagagaactctagaaataaaggataaaagcgagaataaaaatatgaaaatgtattcaatatacattttattgataacagactgtcatttggaggacgttacagacccaggaagctaatagaactgatgtcagcagaagtgtatgaaagtcacatgcttgtgatccgttcctttgccttttgacaaatatctattcatttccatggactaaacggaaagatgaagaaactgataacacattatggaagaagaaatagaatctgtttaaaattattgttatgccttttaaacaaacccaaaattggcaaagatgcttttcctccaaaggttatctataacctttgaaacaaagcgcatatgtgaagttttgcatttctatttacttatgtttcttgcaatattctggttaaaaaaatgaatgaagagaagctataatttttttcacaaagaaagaaaattaatcaaacaaatatgaaatacctgtgggcatctgaaagcactgtagcaatctccagctgtggcaaatggaactgcatttccaaatattgttttggaaaaaagaaggtccgtagctagaaaataataaataaaactctttagcatggagacaataatgcaatcgttgttgtcaaacacagagttttcttattacttacttagtaaatatacatatttatatattaattttaaaattttaagcacaaatgccacaattctggtatatatcatagaataagctctcattgaacaaattttgtttaatataaaaatgttcatatcataaattgccctaacaaagggcaagcacatttgtaattaaacagaagagttaaaacgaaataaatgcattattacatttgaagtcatagaatatctgaaataggtaaagtggggtcaggagcaaaatcactggagaaaaaagggttatgtaaacataaatgacaaaacaataaaattgaatgcttataaacagcacatacaaaaattcatttaggtaattcaaaatctctccacaaaaaagtatgccattttctttttttcgtgtcttattgcattatgttattctttttatttttttcaaacttacttttgctaacagtgttagcaaaatttcctgactggtaataatgctgaagagtctacataaagtatcaaaaatagagccattggattaaaacaggctggaaggaacactaaaagtcagctgcttcaatcacctattcatgtttgaatcaaatattatcccaaccaaatcatctagccagtggctgtcacctccactatgtattccaaatctcttcactttcaagactgcaaaatcactgcatgtcccaggatgacatcagtccttcagaggcaattcccaaaggtagcatttctggaaatatttgtcatatctccaaagggcagtttcaaaaaccaggaagctctccatggtttaccagagccagcttgtaccaaatagtgagagccaactctgtgcatttcttcccaagcccaggtacaatgaggtcatgttggtagctcatgattggtcagggtgggaatacatacaccatgtatatattagtgcctgacaccacaaatcagactttttcttccctggataactggtcgtcattcatctgcacaccactatttatttgtggcatttgtggattatgctggggcagagcagagacacaactttcaaagcatctattgttactaactccaaaagcatgtcagtcaacagccagtttcatcagccaattacacaatgatgactcataagtatatattccagtccacctgactctgatgagttacagaacatatatcaaattcctattgggcatcattacttggatgacctacagatatctgtaatttaacatgttcaaagctaaatgcattatctttttctccaaatttatttgccctgctctatttcccatttcactaaactgtactaccatctgtcttgttattttagaaacctttctaaatattccatgtcactaattctcacaccccttctatcagaaaatcctgtagtgtctacctctttaatatttctcaaataggtatcctaacccatgttcccagtactcatcactttttatctgaattgttacattcgcttcctaatcatttttcatggatacaatctgttctgcctccaaccaactctattccttcccctgcttatgcctttatgcctttattccaatggttcctataacttgcaagataaaattcaattgtatagtttagtatgcactgttcttcatgatctgctccctgcgaacttttctaataagctaccatcccccaacctacatttgatttatgttagacaaaactagactgctttttattctctgatatcgccaaaatgcttctcccttccatgcttttgttcatgcttctccctcctcctaaaactcatttttttgcctcttttgttaactcaaagttgtcttgagattgttcaaactatctgttcctataaacctcttgagaaaagcgaggacttttaattcaacagatacttatttacaatatattttgcattgggcagtattatagatattgcgaacacaacagtgggtgaaacagaggccaatggaacctgagtcttaccaggaagagacaagttataaaacaaatattacagtatgttaggggtgatacttgctatggaaagaaaataaagcagataatagaatggggaggaagagaatttagtggtggagagtggttctggatggtcttatttagaagataaatttcagcagagacccaaaagaaatgaaggggtaaaccacacagacagctacagatgaatgttcccggcagatggaacagtaagtgcgaaggccttaagatgggggcatgcctggtgtgttcaaggaacagcaaacaggccactgtgtctgtagtaggagtgatcatggggctcagggcagcagaaaactgagagggaatagaggtggaaaggtcatggtgactcttgttgaccagtgaaatgcacaattttgtccataacagcatgcacattgaaaattcacctgacagaagttgatgatgaattacatgtgggtgtggaagaaaggtagaagttgaagatgttgctaggttttagctagactaagtagaatattattggtggcatttactgcagtggtaaacatttgggtttgacagcaggtttggcaggaaatgttagaagttcagttttggatacattgagtttgacatgcctattagacattcatatgaatatgctgagtagacagttggattttggaggttagggtagcaatccaagctggaaatgtgcatttgggactgtcatttaatagatggtacttgaaatctataaatttaatgagattcccaaataacaactgaatcctatagctcctcaacattcagagttgtagaagatgaagaataacttgccaagtcgagaaacagtgagaaagacaggagaaagagtggtcaagaaagacacaaaaccattagaggatggtgtcctgggatccaaatgctgctgatgcatcatgtaagatggaaaacaagactttatcattgaatttaaggaaacaggttattgatgactttgataaggactgtttcctggaagtgacatgaataagagattgattagagtatagcatggggaaagagaattggagagtgcagattataactcatttaagaaattttactataaatgaacacaaagaaactggtcagtggctggctggaaaggtagaggtcaagatgatttgcttgtgattatgacgaaagaaataaaatgtttctctatgaagaatttaaatgattcagcagcagaattgaggatgtgagagagattaggaaatatgctgaaataacgttcttgagtaggtacaaggcactgagcctagaggacaaggagcaggatttgccttggatgggagcatgaagagttcatccagagtaaacaggagaaagcaaggagataggtaaagattcaggtaggctggtagatgtggcagtgggaacttgagcaattcccttctgattcttattttctcagtgaaatagcgagcaagatcaccagcagtgagttagtagagtggaggtattaaaaattttgaaatttgaagctacaggagaaggtataagttagacatttagaaaagtaggagagagaatggactagggaagtgcagtaggattatttggcagtgccatggatccgtgtaagcttagtactcatgtgtttaaaatggtatcagtcagaagggctgtgtattatttgccacattcagttttatgctgcaagcacagaatgggtggagatttaatttaatcaaggctggatttttaccatgcaagtttaaggaagaaaaagagaggagaaactgtatatatttgacattgcatgcttgcatgctctgggcccagaccaatgcctggcaaaatggcagctttgttaaaaagcagtctagttaacagcaaataagctattgagtgtctattagaaacttagagcgctaataacatacttataaccatatacatcattaaataataaccaatatttatagagcatgtactctatcagggatgtctaatcttttggcttccctgggccacactggaagaagaattgtcttgggccacacataaaatacactaacactaagaatagcttatgagctaaaaaagtcacaaaaaaaatctcaaaatgttttaagaaagtttacaaatttgtgttgggccacattcaaagctgccctgggccacatgagggctgcaggctgtgggtttgacaagcttgtattatatgtaaaacaatgactagatatgttagaaatatcatctctttttttttttttttttttttttttttgagacggagtctcgctctgtcgcccaggctggagtgcagtggcgcgatctcggctcactgcaagctccgcctcctgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagtcaccgcgcccggccgaaatatcatctcttaatcctcaccaaacaagaataaaaaaagaaggaaagaaaaaggaaatgaagaaaaaaaccttagtaatagtttctcattttacacatgagggaaccgaggcttaaagacatatgcccaaagtcacagagctgataaataaagaattacacccagacagtctagagtttattattgtaaccatagtaatataatgcttccacactgtagtagatggtggatgttcagtaaatgatagccatcattattaataataatggttcataattttatgactataatttatatattatatattcatgcatatactgtcttaattttttttattgctttctatgacttatgcaccatgctaggcactgatgattcaatggcaattgagatggagtctctgctagtgaaatgcacttttttgcctcttcatgtagatatgtaactttctggacagcagcctgcatttgccaggtgcatatgaagttctataaatacgttttgacttgattgtattataaattactttctagataagcagtatgatctataatctaaggtctatgagtaggactttttttccctaatgccagtactaactgtatgaatggaacaaattgcttaacttccatattacttacaacattgtgatatagtatctgccttaactaatacaagagtgttaaaaaggtcaaatgagataatgtatgggaaaatacctgataaattatcattagaaactaatgtaaatgattactttaaactctgcaaaaagcttccacaagtagaccgaggatattaactttcttatccttaatgtacctgaggattttaaggtagagggttttatcttggaagggcagtatcttacttgttactgtcattacatttttattaagagtccccagctgggagtggtggctcacgcctgtaatcccagcactttgggaggccaaggcaggtggatcacctgagatcaggagttcaagaccagcctgaccaatatggtgaaaccccatctctactaaaaatacaaaaagttagctgggcatggtggcgtgtgcctgtaatcccagctactggggaggctgaggcaggagaatcgcttgaacccaggaagtggaggttgcagtaagccaagatcatgccattgcactccagcctgggcagtaagagtgcaactgcgtctcaaaaaaaaaaaaaaaaaaaaaaaagccccatggtgcatgtcattgcagaggaagtatgtagctaactgtttttaaaaaaagtaagtaatttttgcacaatgtcaggtccttctctgtaccctggctacaacatataccaacatattgtttgacgttcataagcaaatggaggctttttgattttaaaatatagattgagcacttacttttaatttgcatggaagtgagatcaattcttattttgctgaaaacagtgtatccagcagctaagtgtccattgtcacattcacagtcttcccttctactcccattaaaaggacattgatatggattttttagtctgtaacaacattgggatattttagtattagatgcagttacgaggccataatgtagacaaactttgggagtagaaaaataaaacacactcctgctctttaatattatagtgtcaacaagttaaacaagaaagaagcaaaaatcacttaaggtgaacatacaacattttcaatgaaacatctaagaagagcttgtagaaaaataattcaactgcattcttctagctttgattactggaattagtttgactttatgaaaatgcacatagttcttaaattcttcccttctctatgtccgacttctcacccacagtattcttagtcaatctctctgttaatagtcaatattaacaatacatgttagtattcaaggctttatttctgaacaggcattaacaacatctagtttaggtcctaacatgtctacctgctcctacattatttgtctcacatgtaagctattcaagtatcactctgagggctagaagttccaattctcttggaggaccatgaaaatgctcagatagaccaaaacacatctcgtacctaaagccatacacttcagaaaagttttcttcaccttggaccagtgttaaatattccttagggttctccaagtacatgtctgcacaataaatctaaagaaaaaatgtaaacatctagaaaaactttttccaaagtcaatgatcaatgttaaaataaaaaaggaactgttttcataatacctttattattcttcccttaatgttaaggtaatagtcaccatcctttctaatgtggtttttcacttgaatttctttgcaggtggtaaatgatttaccttcaaagacaaattaacacaacttaacacagagcaaattacaaacacagcaagaacttaatcatagaaatattgctacactctgaatatctgacactttgttttgtggagtgtgaaactactacagatatttattttaactgaaacttattagaaacccttaggtattagatttttgaagtctactacttacagtcattggcataacatttcttttgagcacctggttttaaatggtttaaacataagtcactggacaaaccatgtttggtaatgcatttcacttgtctcttcattatcccaattccacaagtcactgagcactgtgaaaagagtaaaatttgaaggcaaactatattatgaatcttaaggccataaaatccaagtctccttttcttagaccaggtatttctggagcacactgagggtcagtagtggctagatacacagaagacacaaaactatgctgggggctggatagtcgccggtgggaaaaatccttaggcatgagcctgaatctattatttctcagttactggcttcttttaattcattttgtgcagttagcaacaatacattgtaaatacttaataaacattagtcagtgatggtaattaaaactatctcattaagttatatgctaagtttgcaaagtgatatttacttgctttctatcaattaaattggaaatagaatatgatataaataacttttattactcatatattagatttatttacttcttcacttaaccaataaatatttcttaagcacttactcaaagtgcaagccactgtgctaagttatctaaggaacagaaataagtatgagttatggtctctgctttaagcgagttatagcaagcatcgaacaagagataaaatatttatataaataactggtaatgtggattttagaaaatagtggtctgaggcaactctgaggatctagttagacatacaaacagattaccagatttcccacacctagaaagtcttattcagaagttttaaaattcataattgtacaccgaccttgctccattttccaactttccaagtggccaaatgcaaacagctgttaatgcattggtaaacctgagaggaaggcaccacagggcattcttgataaactataggccgaagtcgatggagcttatgtttcttagtagatgggatctcggtgcaatatgtaatcctttgtctgtaactaaatccacagttgtttgcacactgaaaaatacataattacaagaaagaaaatgtcattaactttagccagggcctaatatttgtcagatgcttaatatatattatgctgtgtcatttccacaacaatcctatttaattagcttcatttacagatgagcaaacataggttcagacattagacaagtttcccagagttgtaccaataaaggaaagaaactcagatccaggctagattttctagctgtagtgcctgtgtgtgcgtgtgtgtgtgtgtgtgttttcattacattaccatcttaattgtatgaaactatatctcccaataggcacagcattggaggaataaaacattttgagggtccttactggaaataaagggcatctattagccttagatcactggtaactatgtataagttagcacacatgtatcttcatagatatactgtaaagtctaataacacttgactaaaataggtaagtgatttaggtgtaaattaaagccccaatccaaaaatgggcaaatagatttctgcttttagcaaaagaggagtaacaaggaatagatttaccttctaactttaaacaactaaaacatctgaacaaaatatataaagcaatggcttttaagacactcaacattggacagtaaagaatagtaatccatgacagatgagaaacaaagtgacactataaaatcattccagcctactgctttgaaaaactttccaggtcttggcacaacgaaaggaaggcagcagagctctgaccagcagtgtgtacatacctgtgaggacaccaaccaaagtaaggcaattaaccaaacaaaaggcttagaagttactttctctaatgatcacacagaaccaaatatagtgcctattccctccagctagactggaaaatttaaatacatgaggaaataggtaaagtactcaaaagggtcttgccacagtagagaggaacagttaaccctagattaaacaatatactgatctgcctacaaaatcttaagtgcaaggcaagagagagtcaaactgttctccaacaaaattaatgcaacccataacaaaactcaaaatacatgtataggaataaaaaatatctagtcagcaaaaaggtaaaattcatggctgacatgcaacagaaaattaattggaatgcaaagaacctggaaaataagactcataatgaagaaaaaacctgtccatcaaaacatccctagaggggtgacatctgtgaaaatggaagagtaaggacatctaaaaattctctcttctataatagcagtgacaaaatgggcaaaatttgcccgatcagttttttcagaactctagaaactgaccaaagacttgcagcaatccagaaggcatttattcaataaacatggctaacttttggtaagaagagcaagttttgtgatggtttaacttctcctatttccattctcttctttctagctccatggtaaccttcaaaatcaacagccctgtgattatggtgaaaccagaattccggcagccactggaggggagcagaacaggcttggatatcattcaaagcctcattcccagagaattgtcattatttgaactgtttagtggttttctggaagaccccacttgcaagaatgtctttatttgacctgacctgctcagtgctaaaaatctagggacatttgttgcgctcaattaaaaaccattgtttaactttgcagtttccaggatgctgaataacagttggagcaacaacaggctagctaaaaaggcttaaaaggaaaagctagggaataagatgtccatcagagctttgaaaagctccagtgtattaatgggatctagatggccgtgaacatgcatcagattgtacacatgtccaggtctgtctgcaagctcaggaagcatctgaggagggcctgcagcctctcttccagctgacctcaaggctctacacaagcagaaagttaagattaaggaacagttgtcaacaacctgatgagtgttgaaggccacaccctactcccaaccccccaacacacagtaccttggcaaaggctagggaaccaaaattattggttccagatattaaggaaattactgtctagtcatagctgacaactaaactaagtgagcagagacttcaatggccatgtatgacaaacaatatagacttaacagttagttcagaaaagtcactaaaaaacaaacaacaacaaacagtagcaacaacaaaccctggggaggaggaagaatctgaatagacttatcacaagtaaagagattaaatttgtaaccaaaacacttcacacaagaaaagcccaggaccaaatgcttaaagaagaattagcaccaagtctgccaaaagtattccacagatagaataaaaaggagcactgcctaactcatcctatgaagccagtttttcccaaatccagacagacatcacaaaaaaaaaaactatagaccagtagttcttaagaatatagatgtaaagttctacaacaaaacactagcaaaacaattccagcaacacataaaaaggattatacaccatgacgaagtaagatttatcccaggaatgcaagattattgtaacatatgaaagtcaatctatgtaatacaccatactaatagaagaatggacaaaaaatatgataatttcagtagatgtagactaaacatttgacaaaatctaacacactttcataatataaacatgaagcaaactaggactagaagggtacttcttcaatctgataaagggaatctacagaaaatccatagttagcatactgaattaggaaaactaaaagttttcctacagagagcaggaacaagactgaaatgtctgtttttaccacttctatttaacattattctggaatttctagacagggaaattggacaaggaaaggtacaaaaggcatccatctttaaagaaagaagtaaaactatctctatttgtagatgagatgatattgtaagtagaaaatcccatttaatccacacactaaataattaaatcccccaaaaaattttcaatacacaaaaaacaattctatttctatacacaagcaacgaataataagaaaaatgaaactaatagaacaattccatttacagaatataaaaaatactcaggaataaattaaaagaagtgcaagatttgcacactataagacacacttgaaataagttaaaacctaaattaatggaaattcattccacattcgtagataagaagacagtattattaagataataatatctaccaagttgaacaagagtcattgcaacctctaacaaaatctcagctggctcttacatagaacttgacaaactggtcctaaaattcacatggaaatgtaagagactcagaatagcccagtaatcttaaagaggaaggaaaaaagttggttcactcatacttcctgacttcaaaacttactataaaattacagtcatcaagactacatggtaataatatattgataggcatatagatcaagaaaatagaattgagagttcagaaataaaccaatacatttatggtcaattgtcaattgatttttgacaaggatgccaagctaattcaatgggggaaagaataatcttttcatgcagaaggatgaaattagacccctacctcacatcacatacaaaaattaactcaaaatgtatcaaactcctaattgtctgagctacaattataaaagcctacaaagaaaacatagatatatatctttgtgagcatgaagtaggcaatagtttcttagatatgatacttaaagccaaagaactaaaacaaaaaacaaaataaatttcacttcatcaaagcatactattaagagaaaagataacccacagaattggagaaaatatttgcaaatcatctaactgataaaagttggtacccagaatatataaataatttacaactcacccagtgaaaaaatgagcagccaggcatggtagcttatgctatagtcccagcacttttggaggtccaggagggatgatcccttgagcccaggagtaagaaaccagcttgggcaacacagggagaccccatctctacaaaaaaaaaaaaaaaagctagagatggtggcacatggctgtagtcgcagctactcagcaagtttaggtgggaggattgcttgagcctaggaggtcaagacttcagtgagctgtaattataccaccgcactccagcttgggcaacagaacaagactgcatctcaaaaaaaaaaaaaaaaaaaaaaaagatgggcagaagatttgaatagacatttatctaaagatatacaaatacctaaaacacacacaaaaagatactcaacatcattagtcattagagaaatgcaacttaaacataaaatagataccatttcatacatactaggatggttatgttaaaaaaaagatggattataacaagtgctgttgatgactgatgatgatatggagagagaaataggaacctttatacattgctgataggaaagaaaaatggtgtggccactgtggaaaacagtttggcagttcctcaaaatattaaatagagttatgatacccagctattctatccctaggtatatgcccaagaaaattgaaaacatacatccacacaaaaacttgtatgcaaatgttcctaacagcattattgaaacgtcaaaattggaatcaatccaaatgtccatcaactgacaaataaatagacaaaatatagtatattcctacaatggaatattatttatcataaaaaggaatgaagcattgatgtatgataaaacttgtataaagttttaaaatatcatgctaagtgaaagaagctagacacaaaagaccacatatggtatgattccatttataccaaatgtgcagaacaggcaaatccacagatacagaaagcagattagtggttgtctgagactaggagaaaatgtgagaataaggaattactacttatgggtgcagatatttttttgggagtgataaaaaggcctgggattagatcatggtgatgcttgcacatacaggtgattatactaaaattcgctaaattataaacatgtgcatagatgttagaattagatgtccagaagaagatgttaaaaagataatttttaaaaaaattcaagaaaaaaataaaataaaaattggaaaattttacctacaaaaataaaagtaactatgtttcatatgttcaaaatgttaagtagagatatggaagatataaaaaagctgaaattaaacctctaaagatgaagatgataatggcttagataaaaaaacagactggatggggatcagacatcagaaagaaaagaaaagcaaatgtaaagacatctatataatggaatattattcaacaataaaagaaaaaactattgatacatactacaacctgatcaaatctcaaaatacttacattacagcagacaaaaaaagtatgtactgtatgatccacttatataaaactctagaaaatgcaaacaagtatagtgatagatcactaatatagaaaacaggtaaggtcacttattgggtgaggagggaaaagagaggggggaaagagattataaagcagcacaaggaaacttttgggagtgatggaaatcaaaatggtactggttttatggctgtgtacatgtgttaaaacttattaagctatatattttgaatatatttagtttatggttcatcaattacacctcgataaagccatttctaaaaagtggacaactgtacggtgccagtttgccaaattgttcctggtggttggtttcacagttggcacctactgacacttgagacttgcactagagtttaacacatatgtcactattactctatttgcaccatccaactgtcagtggtctcattccttagattgatatgcataccatcatctgccctcatattcaaattttatacccagtttcagctgtgtcaaattgtagatccagctgttttatcaaggagcaaaaattctcaacttcctttctttaccttacctgtgatgagtctgctgttaccacaatgtaattgcaaggagggttcctgcaattcttggatgtaagagatatggttgaagaattatagactatttcattcacttgtctgatttggttatctgtgcactccattcgttgatgtgaatcttttctctcacatgatgttgaacactagaaatgcaataaccaaatgaataacacattcttatatgcagtgtctttgaaaatttacatgtcgatactcacattcagcctccctctttccatccccttgtgctgcacacagtcctgactccaacatcgcctctgagaacaaggtcgggtggactgatcacacatttcttcaaccacctgaccaacacctttcagtctgcagtatacatccctctgctgaactccagagccacaggtcacagagcactacaaaggagtccagttgatttgaacaattagctaataaataccaaattatataaaagtagccaatggagccattacatattatttattttaaatacagcctggtattaaaacatgaattagataaaaaatacatacaataagtatttttaccattatctctgtaaatgtatattttccctgtttggcataaggcacttcaagctttacagaaactctgacaagcgaatcaagttatagtagacagcatctcaatcaatgactctgtcttctacttaaatgagtataatgtctataaaaattaccacacaattaatcatgaattattccacaacattgcttttaaatgtcaattaaattcttagactatactcattatctccctcaaagaaacaataatttccaagattgtgttatattcatctttttatctacagtacctactatagtttgtacctgttatggaatctaaatacttgctaattttttttaatactttaagttctgggatacatgtgcagaacatgccgctttgttacgtaggtatacatgtgccatggtggtttgctgcaaccatcaacccgtcatctgcattaggtatttctcctaatgcaatgcctcaccttgtccccaaaccccctcgacaggccccagtgtgtgatattcccctccatgtgtccatgtgttctcattgttcaactcccacttatgagtgagaacatgcggtgtttggttttctgttcctgtgttagtttgctgagaatgatggtttccagcttcatccgtgtccctgcaaaggacatgaactcatcctttttttatagctgcatagtattccatgttatatacgtgctgcattttctttatccagtctattcttgatgggcatttgggttggttcaaattatttgttattgtgaacagtgctgctataaacatatgtgtgcatgcgttttttatagtagaatgttttataatcctatgcacatataccaaaaatgggattgctgggtcaaatgctatttctggttctacatccttgaggaatcgccatactgtcttccacaatgattgaactaatttactctcccaccaacagtgtaaaagcattcctatttctccacatcctctccagcatctgttgtttcctgactttttaatgatcaccattctaactggcatgagatggtatctcattgtggttttgatttgcatttctctaatgaccagtgatgatgagctttttttcatatgtttgttggccccataaatgtcttcttttgaaaagggtctgttcatatccttcaccactttttaatggggttgcttttttcttgtaaatttaagttctttgtagattctggatattagcgctttgtcacatggatagattgcaaaaattttctcccattctgtaaattgactattcacgctgatgatagtttattttgctgtccagaagctctttagcttaattagatccaatttgtcaattttggcttttgttgccattgcttttggtgttttagtcatgaagtctttgcccatgcctatgtcctgaatggtatttcctaggttttcttttagagatgttatggttttagatcttatgtttaagtctttaatccatcttgagttaatttttgtataaggtgtaaggagggggtccagtttcagttttctgcatatggctagccagttttcccaacaccatttattaaatatagaatcctttccccattgcttgtttttgttaaagatttggtcaaagatcagatggttgtagttttgtggtgttatttctgaggcctctgttctgtttcattggctattaattactacctcaatttcggaatttgttatgggtctattcagggatttgacttcttcctggtttagtcttgggagggtttatgcgtcctggaatttattcatttcttcgagattttctaatttatttgcatagaggtgtttatagtattctttgatggtagtttgtatttctgtgggatcagtggtgatatctcctttatcatttttattgtgtctatttgattcttctctcttttcttctctattagtctggctagcggtctacctattttgttaatcttttcaaaaaaacaggtcctggattcattgattttttgaagggtttttcaggtctctatctcctttggttctgctctgatcttagttatttcttgtcttctgctagcttttgtatttgtttgctcttgcttctctagttctcctttgcttacgaagcttagtttggctggatatgaaattctgggttgaaaattcttttctttaaaaatgttgaatatcggcccccactctcttctggcttgtagggtttctgcagagagatccgctgttagtctaatgggcttccctttgtgggtaaccagaccattctctctggctgtccttaacattttttccttcatttcaaccttggtgaatctgtcaattatgtgtcttggggttgcttttctccaggactacctttgtagtgttctctatatttcctgaatttgaatgttggcctgtcttactaggttggggacgttctcctgaataatatactaaagagtgctttccaacttggttccattctccctgtcactttcaggtacaccaatcaaacataggtttggtcttttcacgttgtcccacaattcttggaggctttgttcactccttttcattcttttatctctaatcttgtcttcacactttatttcattaagttgatcttcaatttctgatatcctttcttctgcttcattgattcagctattgatacttgtgtatgcttcacgaagttctcgtgctgtgtttttcagctccatcaggtcatttatgttcttctctacactggttattcttgttagcaattcccctaaccttttctcaaggttcttggcttccttgcactgtgttagaacatgctcctttagctcggaggagtttgttattacccaccttctgaagcctacttctgtcaaatcgccaaactcattctctgtccagttttgttcctttgctggcgaggagttgtgatcctctgcaggagaagaggcattctggtttttggaattttcaggctttttgtgctagtttttccttatctttgtggatttatctacctttggcctttgatgttggtgaccattggatggggttttggcatggacgtccttttgttgatgttcatgccattgctttctgtttgttaattttccttccaacagtcaggcccctctgttgcaggtctgctggagtttgctggaggtccatgccagagcctgcttgcctgggtatcaccagcagaggctgcagaacagcaaagattgctgccttttccatcctctggaagttttgtcccagaggggcacccatcagatgccagctggagctcccctgtatgaggtgtctgttgacccctgctgggaggtgtctcccagtcaggaggcacagagctcagggatccacatgaggaggcattctgtcccttagcagagctcaaatgctgtgctgggagatccactgctctcttcagagccagcaggcaggaacatttaagtctgctgaagctgcgcccacagttgccccttcccaattgctctgtctcagggagatgggagttttatctataagctcctgaatggggctgctatctttctttcagagataccctacccagagcagaggaatctagagaggcagcttggctagagcggcaaagctgcaagctagagttgtggagggctccacccaatttgaaaaaatgaattgtggtgggctccatcctatttgaacttccctgtggctttgtttacactgtgagaggaaaactgtctgtcaagtctcagtaatggctgatgcccctccccccaccaagctccagcatcccaggttgacatcagactgccgtgctggcagcaagaatttcaagccagtggatcttagcttgccggactccatggggtgggatctgctgagctagaccatgtggctgtctggcttcagccccctttccatgggagtgaacaattctgtcttgctggcattccgggtgccacgtacaaaaaaaaaacctcccgcagctagcttggtgtctacccaaacagccacccagttttgcgcttgaaacccagggccctggtggtgtaggcacctgaaggagtctcctggtcggtgggttgcaaagaccaggggaaaagcatagtatccgggccagataggaccgtccctcaaggcacagtccctcacggcttcccttggccagtggaaggagtttcctgaccccttgtgcttcccaggtgaggcaacatcccgtcctgcctgcttctgttcaccctccgtgggctgtacccactgtctaaccagtgagatgaactgggtacctcagttggaaatgcagaaatcacctgccttctgcattggtctcactagaagctgcagacaggaactgttcctatttggccatcttggctgatttgttgattcatgattatatttcaatggataggagttttggaaaactggctgtgtaaactgtaaacttagacaactttgtccaagtcttgtttttcttatgtgtacaattttgtgttacttgtgaaatgtcacagaacactttccatacatttattcctgtcaacagctctataaaagcggtactatggctgaggacactgggactcagagaggttaaagtcccttgcctgaggtgctgcctatagttagtgattgtcttagtctgttcaggctgctataacaaaataccataaacagaatgtctcacacaccagaaatttacttcccacaattttggaggctggaatttcaagatcaaggtgctggcagattctacatccagtgagagtccactttctggttcctacagggcaccctctcactgtgttctcatatggaggaagggatgagctagctttctggggtgtcctttataagggactagaaaaggccccacctcctaataccatcaccttgggggatagaacttcatcatataaattttgaaagaacacaaccattcagatcatcccattctttccctgccccactcctcaaattcgtgtccttctcacatgaaaaatatattcattccatctcaataataccaaagtcttagctcattctagcatcaattcaaaagtctataaagtccagactctcatctcagtatcatctcaatcagatatgagtgagattcaaggtataattgattcatcctgaggcaaatatctcttcagctgtgaacctgtgaaatcaagaaagttatgtgcttacacaacacaatggtggtacaggcaagccatagggtagacattctcattccaaaaaagaaaagtagaaaagaagaaaagggtaataggacttgagtaagtaaaaaacccagcagagccaacaacagtaaatcttaagtcttgagaataatctttgatgcaatgttccaccttctggacacactggggcagggattgggtcctcagggctctaggtggcattgccccatggctttgttggattcagcccatgccacagttctcatggattgtagtttggtgcctatggcccttccagactgaagttgcatgccagtggctatagtggtctggggtcatgggggcagctctgatgccatggcatcagcttagtggggacaattcagccaggttttttttgtttttgtttttgtttttgtttttttgccactttagaacaaggatggactttcctccactgtccaataacatgataacatgttatgatttccatctgagacctcatggcctttactgtccatatttccatgaacatatctctgcccttgcaatggccctcttccttgctcatgtgcccaagtccgtaggcagctctatcctttgaaatttaggcggaagttgccacacaagcatgactcatttactctgtgtgtcagtggagatagtcccacttggacactgctaaagtttatcacctgtgaactctggagggatggccatcatagccattgctgtacttgggaccactggagacacatctggggtagttgaggactgctgtgccagaatgtgggaagcagagccaataatgtggggtggcaccaaaccattgcagccctgttctgtccttaggccattgcactctgggcctatgcaatccctgaggagcttcagaatgctgttgggaggccatccttccattgtcttagacaatatattatggcatctgtttagatagctgtctaatctccctgttgtactgataaacagctcatagcttagattgaaattgctgattcaaactaatcaaactaatctccttatcaaattcagccacaccttttgtattctctcctgaactttctcattttttcaaatataaataggctgagaattttccaaaatgttaagttctgctttcttttttattaacaactccatctttgtatcatttctctttttaaatttttctattagcagtcaagagaagccaagttgcaccttcaatactttgcttagaaatatcctcagcctaacagccaatttcatcacttatcagttctatcttccacaaaacactggaacatgagtacagttctgtcaggttttgtttttttgtttgttttttgccactttcgagcaagcatggactttcctacactgtccaataacaatttctatctgagacttcatggcctttactgtccatatttctaagaacattctgtttgcaactacttaggtattctcaaagattgaggctctctctaaagctctcctcttctctttatgggcttttacaagaatagcccttaatgatccattcgtggcactataggctttttctagcatgcatttcaaagctcttccagctgctagtcattacccagttccaaaaccacttctgtattttagatatttgttatagcagcacctcattatcagtaccaatttttttttatcttagtctattagggctgctataacaaaataccataaactcatggcttataaacaacagaaatttatttctcacagttctggaggctgggaatttcaagatcaaggtgctggcggtgtcagtgtctggtgagggcctactttctgatctgtagaagggtgccttctcactgtgtcgtcacatgggtgaaggaacaagctagatctctggagtgtcttttataagagaactaattccaacaatgagtgctctaccctcatgatttagtcagctcctaaagtccctacctcctaataccatcacctcaaggattaggatttcaacacatgcatattttttttcaggtgtagggttggcaaatattcagatcatagcagcagtgaaaaatagttgaagttctgttcttttttactccagactgagctcttactgtgttgcctcctggggatgaaggaggacttggcaatctttcaactctaggatgtcacatcttccaaaattaagtagtaaagccatataataacagagcttaactacaagagctgtgatgccaacgttaaaaaagtgtagagtatgtctaaagatatttaatttgtgagtttcattgtttatattccttgtcattccagtaggaattggaggtcataatgagtaatattgtttggggatccattagtattcccaactgtaatattataagggggaaaaatcaggttattcaccaagttcattatttctgcaggattccagagtaactaatttccttttcacaacagtaaatatatatctgcaaaatacagttttaccctgaaagaaaaaaatttaaagcccacaaaagctaagaatttcgtttacccagtagactaaaattcctctcataaactgtgtcaacatttttactggaaaagcactttaaaatttagttttctctcttgtgagtataagcagcaaccaccaacttcaaagagaatttttgttgttttacttatgaagtaaaatataaggcatatttaaatgtataaaatcttatgcacatctacataacttacactgaccttcatgttatgcttaagcagttgaattttgccaactcattaaatattttcagaaaaaaatatacagttttttgtgtagagaataataatttcatgtgcactttgtgtatggcacaatattaaatagactaaaatgtctggatgtagtttaacgtaaatgaatctcttatgaaaatgtctagcctataaaataaagctcctgaaaacatttttcacagctaatttcagaaatataaactatatttggaaaacatcctgcctctaagcctgaaaaagaattcctggaaaaaaatagtttataaaacacagtttagcaagaagttctattagataaatataatttcctacaattcaataaaccacacttaattattggtcctttgatcctagcatgagtttttaaaaatccactaagagagcagctagctactatattttcgatatgaacctcttctctaaaaagaaaaagaagggactactacttggaagaaaaaaagtaacttgtttttcagtttttaggaataaaagtacaaaagcataaatcagtatggttttagattttaacatagacgaattcattgcttaaattgaatattccttagcctgctgtcatcaataaccccaactgccaagtccaatagaaagttttcaaatcttttcttagttaatctcccgaacacatttggcaccactgatcactttctgttgaatcattctggttctgtgattgaaactcctttagttctagggggtctcctcttacctcttgaattgctccttctcagggtcttttactattttctctgcatattctttaaatgtcagcatatcccagggctccatttataactggcttctcttaaaaagctctttctgagcaatttcttctatacatgagtaatttctaaatgttatctccagctttggtcacagttctgagttctgcatttacattttcatgtatttataagaaccgtttcatgtatttacaagatttttatgtgttttctacttagatatgtcaaaggcacctaaaatgtaacatttccatagcagaactctttcccttttcccaaagccattttcttctaaggttgtagatacagggaaaacactatcatccactcttaagtggcttactagaatggcttctcaaggtacattataactccttaatatgtatccattattttaacagtgttatagaactaatataagcatgtcaaatttcgtttttttaaaaaatccaggtaatgaatgtaaaggcattgtgaagctgtaagtgcaattataacaccacctaattgactgggatgcactacttcttcatctatattacataactcaatccagacagttcataaatatcctatttatgaaaaaatataacactgcatacattagtgctttaaagacttgagagtggaaatggattaggtaaattttagcgaatccacaggtactgtaaccattatagctattgcggagcagagataaggaaatattagattctgcattgcaaaaatgggttcatcaaggctgactcactctgctatttaataaataattatttaaaatgaaaatagggaagtcttctcttttgaagccttgtttataatttttttattatggataaggttttgatttcattatagtcacttatttgcaactatggtttatttcaagggaatcaataatatagtagtaccattagcagtagtatagtattttgaggttaaagagactctaggaataagtaatcctaatttctctttcattatgaaatctttctataacaataatgaatgagtgaccataaaacctacccatacttaacttcattgtggctatgttcaccgtattgtgaaagcagccatggcattttttaatctgcaatattagcaaatattctcttatattgaactagaatattttttaaactttaatgcattgtccagaatctgtctgtcttttaaatgtagaacaaatacatacctaatttcatgtgagaaagtatgaagatgtgaggactggaactgtggcagccattttatgaccattacaagttgaacaacagaatcacagaaatgccaatccagcaccctaatgttgtagagctgctgaattaaaattaaaatcagaaacactctgattttgttatacgaaaaataaaagtctttgtagtttaaatcactaataaaatcagggctcttgctactggcagcagaacactagacaactgacagcatagttgctaccatttaattgtttttctctagggatatggaaaattgtcaagattttacttataatctgtattccagaataggcaccacttcaaatatctgatcaggatatattagtgcccaacactttgaacatcatccttctgttaatgtaacctagtatgttagtgatttaagcaactccatcatatttaatatgtgatcaactatatcctcagttatttaccctttaacctgtaaaatctatatatataatatttcacatttatgcaacagacatttttacattaaaaacttgccatgaattcagcacaacttagaaattacatttctattgactacactattacatgcagtgcagtgacggcctgaaattgtgaacttcatgtgtccttcttggccaaaggggcaataatttgctaaggaaatataaggatgagctaatgtataatgatattaatgggataacgataactagtataatggagaaagctcaactagacctctgttcaaatccctgcccccaacatttcctgcactatgacctacacaagcttcttaacctttctataagctgctgtttcttcatctgtctaatgaacgtaataaaacctgcatttgtggggaataaaaactcttaatatagtatcaggaagtgactgtcccttgctgctcccttcttctcatttttttacttttcttatggagattcaaccatttatgccttgaaaagtttgataaatgccctaagttagagtgctagtcacctcagcctaccccaagaaaggccattttaaatatcaagaaagatgataaaggaggagcattaacagatagcactgaaatgaaaaatagaatttcactatctagaaaaaattaggaagcaaagtttaaccagcgctggaagcaggagggcatcctccctgtccctgaaccctagtctaccttcaccagtagaaatgtcactgaataccctgacatttcaaatgaagggatcacagattcttaggagctttagggacttaaaaaattaacatttactatttttcaaattataaaacatatatgtatatgtcagaaattctgaaaatatagaaataaagatttatacttatgtatttttgaaatatagacaatatggaattacagaaatacaaaatatcttaaacatctagcatttagcatacagtttctttcttttcttttttttccaaattaggggctttgggtggggagcactgggcagcagatttgtgggattttggaatttatatcacctttggtcccagctctggtcttaaaatgcaagtaagaaaatgatgggtctcaaagaaggtgtaagcagccaagaggctgatttgacctggttctacattgaatactgttgtgtgagattctttttttttttttttttttttttgagagttttagaatggatttactatatgagactggagaacacactatctgaccatacttcttaggaaggtccaaagaaaacacttcattcaccaaggtaattaagaatgcactggtgaggggacacaggctgtccagcaggtttgccatgattaaggggaggtgagaattcagaatatttttttcctagagattgtgcatttggatggcactaaagtaagtagatgggacctgagacaatgaagaatctagaaccatactagctttaaaaacttgaatttacaagtgaagctgctattcccaaatagataaaattaaacgaaaaaaaaaatcccctcgcttccaggaagtgggggtggggtgggattattttttcttttaaatgattcaattatttaatttgcatctaaggatatacatttgaacatagaggacaaacggccctgtatagcaatgtttgttcctgtttagcaacagtcattaaaatgcgttactaaatcctttcgttaaaaaaaaagatacaaatatcaaatgaagagtgttccttcaaaactcatttaagcacctctgtggtcaaaatttaccaaatgagtctttccatttgaggcatcatgtaaaatagtaataaaatgaaattattttaagagtgagtgattatattaaggtaatgttacaatttatacaatcggaataaagcaacaaccagtgattatcttgtaactacctctgaaattacgcttctgtttaatacattattatatgtagtgcaatgacagcttgcaattgttaacttcgtgtgggtgctttttatagaataaatcaaaaggcaatgacttcacaagtggtcatttgtttctggcagagatttggggactgtgtgggtgaatgcaactaatttctatgacaaggaaaactaattcaaggagaagcaagcaaattatataaaaaagcatctattttttatagtccttaaatattcatatctgtatttttgaagccccagaaatatgttcctttagcagattttatataatttcatatttggtggtaagccaaggccaatttgttaccacggatgatggattcactattgtggagctggaggttcagagacagaaagtgtctctcatgaataccaaccacagcagctgcagcagctgcaccgcagcaaaagaatctttgggaccaacaggaatattggtggccaagacacaaaaagtctctcccacttccactcccatgcccccgtggctcctgcctgatgtaggaactgggagttaactgctggacagatctgtggccgttcatattcagtgcctttacaatgtttcacacgcttaggggaaagctactttgccattatcctgacacacctctatccagatcaagtaaggcaaacctccactttaagcaaaaccacaatattggaaacataataatttaagagatggtgagtatttttgcaattagatcacagtattcaaagtaagaagtatttagcttagatacaaagctaggtgtggaaacaaaatgtccattgtcgccaagaggaaaagagatactggtctgagataattctgaacaagtgagcatgggttaggttttagtcttactccctaaggataatgcttagtcacagatgatattaagtgacacaagatgatattaagtgacacaagcatatctgagttcttctgagctcacactatgtgaatgtaaataatggccaaaatatatgtagagaggccattacagactcaggaacagatgatgatgaactattaaactagaccggggtgtgtgcaatggagattcaagagctacttgaaagagatgagagaacctgttgagtgactaactatggaggcaaggaaaaaggataaggatggatccagtatttctttcttgaacaacttagtagagagtagtgacatttacaaaataaaacaagttaatagagaaatcttttaaatcatgacctctggtaaagcatgaaaaataattgatttatttgatgaacattcaatatagaagcaaatgcccaataatacatctttttttgtgggataaaaaacagagatgcattagcatctagttttcaattaaacattgaccacaagccccagcacattaacacttgacagaggctgcctcttctacaaagaaatttgagatttttactcaatttggaaggcttttattcagtatcagtgaggcactgacataattccactccaaagctgtgtgccctgcattgacatgctgagcgcaaagagagaatgatgatgacttttgaccccaggggaaactccatttccttctagctccccaatagacataactcaaacatctgacagagataaggaagttccaacatcagaagatgggtgtctttttccttttgcaggactaggccctttaagaaatagataagctctctgaggtactactgagagcagccagatggctacattgaaagtctagacccattgaaattagtcctcaggaaattattccagttatcttttctgacttcattcatggcttttgtcctgtcaatatttcccaagctggtggtgtttgacagtcattttcaaatgcatgcctacccgaatttaaattttgatctctttcctctgagtatgccaagtggtatcaattacccttcttttacaggctaaattgtcagccagggtctcatttatttatcagcttcatttttgctgagtcttttcatttttggtgagtcttttcattctagcgcagcctaggctatctatctctgacaacttcctaactctcaatctcggattacaatcccatctggaatttaccagtcccttctccaggattcaatcttagctaaaatccaagatttgggggtagaaacaaggcagttactaaatgtatcatcatatatatttttctgttagcctgcatagaatactattatgattatcagtagcctctgctagtattcagtaacaaaatttcttgttaagtttatagtcacaaaaatcaaatgactaggctgggcacagtggctcacgtctgtaatcccagcactttgggaggataagatgggaggattgcttgagcccaggagtttaagaacagcttgggcaacatagcaagaactggtcttaattttttaaaaaatcaaatgactaatttattatttaactataaacttaggaaatgtgttaacactgtttagtattaatactaacttacagcatagtgcaaaaaagtatataacaataaattttagagaagcaaaacattcaaggttatgaaaaataagaatgaattttctttttaaatacaaaaaaatacatatataattataaaatatacatcatatacctcattccagctattggctttccatgaagggcatctgacagatctacaggctttgtgagttggaggtttctgtacttgactgcaatttgtgtcttctaatttcctttggaattggtcaatgcaaaacacttcacggtactttctacctttaccacaagaagctgagcactagaaaagaaatatgaatgcacttgattcattttcttcttgattaatttaagcttatcttaaagaagtacaaaatgtaacaatccacacataattcctttgatatttttatgaagatatgctctagtatttctaattagtgaaaagttaaaagttaccaatctgctctggaccatcaattaatgtgaatatcataaggtaatatgattacatttttataatttattctacaaaaatgtattgattgtctacaatataccaggtactcttctgacacaacaatgcttcaaatcttttaaggttagactatcctcaactaactccttttatcatccaataaaacttgtattcaatcttgtagcatcaatacccattctatttttatctccacatgcttttctatactgtaaagtatgttttctatgttaaaaaattttagtaatctctcagtgcagaaaactgattgagaaagcagaaagtttatttttttaacagcatttcagttcaggttgtttttggcatcagtctggaagatgtctttctctaccatcggccttctgatttatttagtaaacaaaaaataactgaagtctttttaaaaatataggtaaaataacgatttgacttcatttgtcagccagttttcattttatgagtgaggacagtgcaatatggtagaaagcacttgggctctggcattgagtatcacttctgccacttatagctgggtgactttaggcacatttcataacctgtccaagtcttgattttttttcatttataaaacatgagtagtagcatcaatcttacaaacttgttatgaagattaacataagataaagaatatgaaatgtctaacccagtcctactacacttggtagatcctcagtaaacattagcttgctcttctaccattttccttcatatagtctcagagaggatattgacaatttcagcatgatatatgtaccaggggaaagctaagcaaagaagtcatggagttcagacaacctttctcattcctctgagacagttgttggcatatggtttcatttagaaacacattatgcattttatgcatattgtgaactcatagaatattagactatatggcctatttgatactcaaatactttaaacttttaaaaaatgaacagtctggagaaaatttacctttttatattactagcaatatgttgcaataatgcattgattattaagaactattatcatatcttagatgttctcgacctctcctccacctcattaatacagccattccatgctgcttagagcacacttggttctgtgaaaatctctaatggatcttcatatgttgtattaagatacattctttccttctattgatctagacctacctatatgctttaccgttcctgaccatgttatcttgggcacttaccctgcctctttcttttcttcattgtttatttttcagagtataacctattctatactaaaaaaaaaaattcaaatattattgagtatcaagtatataccatggagtgtgctgactactttgagtatgtacatgttcacacatggaagaataattttcccctaaataatacttttaaattgttactttttgaacaaaggaagcatttattactccctctgctagccactttattaaaaggtaataattactgtgaatagtcatgcaaagattcattaaacagcatctcttgcttttgcccttgatgtatcctccaagtgcttataatctaaatgatacacatcatctatgaagtgaattataccagtgtaggtcttaatattgcactcaatgaagatcagaaaaacaaaaacactacacgataccaaataccattaaaaggatacaataaaaagtatgatagaatttaaaaattcatgaaatgtagccatttctttctaggatatttgtaagtgttcaaagagaagataatatttaaattcattcttgaaggagaggtaggtttgttgatggacaaagatgaatggtcttatgtgtatgtttgatatgacttatctagacattgtccagctgtgtctgttttgtaaaattcccagagttcgtttaacaatgccaagaatccaagaatcagccagtaaatatacagtaagttgttggcatttctgataagaatggccaattcatttacaaagctatgtaacataagaggagacaggttaaattccaaattctaattaagaattcagcaatacatttcctctataagcattatctatgagtggaatataaactcacacatgtagtacactgccaaagttaataattatttttcaagaaactgaatagtcttctactctataactttaggtcatctttgcttctctctcttctttgttactttaatctattaaactaatataacttattactagtctaatccagactgttattgtcattgaacataatttaaacataaatctatttttatcaatctttatattttataatttataagtatatttttatgcttttttttttgctcaagtgctaacaatggctctcttattgtcttaatagcaaaccaaacttatactccttgctttcttgatccaccaaattttagtcaacatgcctttccaacttcatattttgctgcttttcaccatgcaaacctttgctctctttaagtataattgctttctccttaatgtgacacattcgctcaaaaacagggcctaactcattattttctttacctagactaatcacttcctctaataattatccttaaagccctaattcaatcccatgtctagggtaaatacacatcaatctttcacttccctgaactcttctgagtcctaccctgtttttagcacttcatcattttctgcattttcaacttttgtcacatgcttcatctacccagcttcctgaaggtcaagtccttttagatcacccatatcacctacaaagtggcatgtgtaataactatcagctgatggatgtttattaatggtataagcaatttttaatttgcttttattaaactctaaaataatttacttaaaaattttaaattccatgaaatatatttattggttaaaaaaccaaaagtcctctaggaatgttagaaaaaaatacaaaatcaaagaattataaaataaattatgctttatacttttaaagtaaagttctttttctccaagatctgaagagggtaagtacagattctatcctcaagatttaaaaaggaatacatccagtattttatcatatctgatggaattccatctgggaatttctttaaagtaaaacaggacatgttatgcaaacagttatgttttagttggaatgaggcatccatagagtaaacaactagtgaaatgataccttcctttcaaaccataatacattctaagttgtaaggattccacaaaatagcccatttggtaggaatattcaaacatgcagttttttcttctggtatcccagcaatctgctgtttttttcccctccattttataactctgacaccatcatagtcttgaagttttatttagtgctgtataattcatttctagcattctcatcaaaagactttttctcaaaaatcagccctagttcccttaattgacatagtcttaaactgttactgagattttttttttccatgactactatggagcagtagatacagcacacaacccatttcagaagtagtgatactaaataaacatacaagtgccctgaactgataattcttataaattatgtgcagacaaatgtctaagataaaacagggcatttgaaacaaatgcaaaatttgcaaggcctgaaaatgtagtagatctttagagttgttctagttggctggtactttgccttccagaatggagagctgaagttaattagtcccctctaacatgataactttggaataagtatatttttatttttagagaaaagctgtacataattatagaataagattacttctcatatttgaggtgcggatttttttgtttatatgtaaggatactgcagaagaatgaatgtattgacttaatttgtgggagtcttcttgattaattctggaaacttaaattattaaacaaaataaaataaggaaataaaattcatttagtttcagttgtaggaaatggaagccttgtttttttttaggcttccctaaactattatattgatctggcactgtatcctttctgacagtagggggaaacatacaggtactggttagaattaatatgtacccaaactagtaattgtatatccctgaaaagtaactattacactagtcatgcataaactgtgccctttatagattttacaagctgggtaactataaaatacctatttcatatacatctctgggtaaaggtaagatgaaaggcatttttttttaaagagagaaatagccaaactaagaaaactctaaagacatctgtaatgctatagcaaaatgcaaagtaaaataaaatcaataaagaactaaaaagagtactgcagaatatcacattgattagattcaggacaagactgaaaatgtctcccataaagcaaatggaatagtgaagatgagacagatagagaagagatggagagtcgacgtatgaatgttgtttcccggaaaatattctgttcattcccagctcaagtcatcatatcattgcacatgtcatcatatcatttcctcccaccccaacacgttcacccatttcatccccacgtatttttcagtgctgagtttaaatctcatttccttctcgaaactcccttctctgatggaggatgtctgatgtccaatttagaccagattaggtagggttcttacagaatttttttagcatcctttgctatactcagtacacctgaaagtgtctgttctatgtctcttttcttttccagactataaaatctgctgagaacagacatattgtggggacacacacacacacacacacacacacacacacacacacacaaatagaaagcacccagaatcactcatttttaatttagtgtgtcatgactcattctacctttcttttacaaggaggaaataataccaacgcaccatgaaccacaggatcttgcatcaacttactgaccaatgtttgtctgaagtggtagatattctgctggcaccacatgaactgatttagatggtacatttccaacgtaatagatattttacatagtaatgatcatcctcaattttagctataaaaatccctcagctggctatttgaaaaaaatatctgaagtttggtgtataaaaaatcaaatgaaattaaaattaagagtaagcattatttatccactggatcttttaattaagcttggctacaaaagtagtaaatatccatttcatttgctactacatcatttcatctatggatgaagatatatatatttgtttttatgttaatcatctaaactttagttaaacttctctaagagtatcaaaactaatatttaatacactaaaaattagtctttgaaacacaatattagaaaaaggctttgatatcaactgtaagttttatgttaaatatttttagtgactactaagataaagttgattattgagagggagtttaaagaaaacctagtttaccttcatacatgtttccttcatataaattattgtgttataatttaaaattttctaaatccatacatagcctaaattattgccagctgaacaaactttcaatgagtgaatttggcaatgactcttttgctgaagcacagattgtttagttattccaggtcaatcagtaagaactagaagtatcttacaacagttaaactactactccttaaacatgcctccacatttgcagataaggaaaatatttaaaattaaatagaggccaggtggggtggctcatgcctgtagccccagcactttgggaggctgaggccagaggattgcttgaacccaggagtttgagatcagcctggtaacaaaatgagacctcatctctacaaaaaaaaaaaaaaaaaaaaaaaaaaaaaaaaattagccaggcatggtgatggtgatgcacatctgtggtcccagctacttgggagactgaggtgtgatgactcttggagcccaggggacggaggttgcagtgagccatgatcaccccactgcactgcagcctgggcaacagaagaagacgtcttctctaataataataataataataataataataataataataataataaattaaatatttcaaaatttgataatataattgtaaacatttcatatgctttttcaaaaaccattttgggaatggttaaaaattatgaaacttaatttttcagctaccataaataacctaactagacataaacttcataattatcatttttctccctcaaccattttattttagtcctctattgttgttattaaacaaaaaatgacgacaagaaaatacaaaactgagtaaaaataaatgaggtgatattattcaatttcactttggcttttgaagttttctgattgtttttcaaaacataataatttagaagtcatcaaatgatcagacaaaaacaaatttttactttattactagatatgtcacttctctttgtctgctttctgacagcaaggtgcataagtcatcgttgaaaatgtaagcacttataaccatatggctgggtattatgtctatcctattgctcattgtatgccaggtattagctaatttctgcagacaaccaaagaaaacatgctgagggttcatgcaaccttttcgtttaagtaaaggtaaacttaaggaaacacacatattatacattacaaattcaaatccagcttctcattacaaaccagaaatcatttccatcaagataagtgcaacttcataagatgtatcatgcaatacataaaatagagtggtttttctttaaacatccacatattataatagctaaagataatcagatgttggagtgtctctcttggaacaatttgagaggattagttgtgttttctttagtctttggcaattccaaatgtatcagtgaacttttcaacattagagtatgtattatttatcctgtttttatctcttttcaaaattaaactattttatgcatctgcagcaaagttaaattaaaaatttttaataaaaaacatattatagctattttgctaaataattctttaaatgatgtttgagtgattatattaaatgtctttagaacactattatgaaataaaagattagtgtatgaaacaacatattaaatcaggaaatgacagaatttcaagtcaaaacagaccagaaattagatattctgagaaacaaaacactatcatgtgtatgcatccctgtatatgtctttcatttttttagaagcctataataacattctctaaataaaacaaagaggctatatctaaaccccaatagttctgaaatcttccagaagccaatgatacttggagatctaagagaaaagcccactacagtaaaatcttagatatgagtttatacaactactttgtaattgagggaattacctagaatgaagaaaccttttttaaactgagcgtctcaattattagcaaagtaaaacattaaagtagctataatagagtagtaggatatatttctgcttaaaacaaaaaaaatgacaaaatatgcatattaagactagagtgtcaactctaaaatagtactgctactgttcctttaattcaatacacatgtgctctaaggagtaagacactaaatccatcaacagggaccccattcatagtgcttcctgaaagataatacttacagttttaaagtttaatggagtttgaaaatgtcctttttaacttgttacaggcattctttgactattcagctctaataagccaagaaagcatttggttttaaaaatatttaccactgaaatatttcattcaattgcattgcatctaatcatatttaaaatttgtagctccagacatttaaaaatttaaaaatcagattaatttgcaaatatatttgactctcaacttaaaggaaaaaaccaaatgattaacaacaaatatatccagcagacttcgattaaattaatatcattgtaataataatatataattttatattattttgagcatatatgtacatgtatgtacactcataatggatttacagttcttggctaattcatgcaatatgagagaacttacatgtaattcatctaactcaattggaagtaatatttaaagataatttactataattattaatattttctatattataactttggaaaagttttgtgattattttcactttcaaatataaaacctgagggaaagctgcagtaacttatgcaagtatcttgtacagaaatattcacttatctcattttataatattattttccacaaataactattagaaaatcggaacaagaaatcatcctagtgagtgagaattaaaggactcaattattggattaattttcttcaataataagttttgataaagaatcatttcaaacctgcaaacattagttattgaacttgagtttattttggtagaagcaatagtaaatgtaagtctaactcaagatgtgagcactatttgtagcaaaaaatactcaagaaaaactgccattcatttaaagcttgtaatttatatttttaactttctaataatattctttgtatgtactacaaaggggaaatgaacatttcagactcctctataaaatctgtttagcaagtgaaactcatctaaagagttcctgtttggagtttttattgactcatccagtaacatgaacctttacaagtatagggtgacatggagaaaaatggtatggttaatatgagaacaatgcaaatcttgtctatttttaacaatttctttggggccattattgtgaatttactttttcttaatgtttttacacaaatcaaatgaaacactgcttttgaaagaatgtgtgccacattccattataaaaactccactcccatcttacccctgagagcctacacccagaagcatgaccgtctgccttcctggactgacaaatgcagaaaactattcagtgtgagtagaccataaaaagctaaagagattagaaaaatatctaaagcatacctttttacaaaaatattgtcttttaaggcattactatggtaacatttacaaaattcttaaaatcaagtgccaacaaaatagcaggatttaccatttcaagttcccacaaatgttttatgtgctagctgtgggagttaacagccataaagccaagaactatgcttttaagtagggttataaaggcctaaaaaggaatatgcacagagtactctgagatgagaaataaatgagttctaaggatgctttgaaaagagaaatgtcagagttgagattaaaagaccatacccactgcacatattaatgtctgttttccatatgtaaaaaaagctgaggggagaatgttttagagattaatttcatatttcaatgaatttaagttaatttctaagattttgcctttaattacacaaaattaactatttgtatcaatatttaagttggggtttcatcattttcactagtggagagtagtagatggaatactaatctagcagtacatgggatttggtgtcagaggcctacaattgaatctcagctgtcagaagctatgataataataacacttacatctcaaggtggttgtgagattaaattagataatgtatgaagaaacctgaaatagtgcttgacacaataacctaaaagcatactaacctgtattccttttttttacttcctttctcaaatcctgagtgtgtttttatcaagagaaaataaagagaaactatcccctgaaaataaaaatactgtagttatgagagaaatgtagatcctatatggacaaaacaaaaatagaatactatgacactaaaacaataagaatgcaagacaaaccttttgataattaaaaaatataactaaaataaagaattcaatatatagtttaaatattgataaagtttcccatcaagtaaaatcaaaagacagaagtagaaataggaagataaaaacaagaaaattaggccaggcgcggtggctcacgcctgtaatcacagcactttgggaggccgagacgggcggatcacgaggtcaggagatcgagaccatcccggctaaaacggtgaaacctcgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaacaagaaaattagaagaccaatccaagaatcccaatatttaaccagaaagagttttttaaaaaatggttgcatagcaattatcaaagtgtaatacaacaaattttcccaacacaaatctttttaatgaaagagcctacagaaagaatgtatagcaaagtaaattttaagcacattcgttaacactaagtcacttcaccagaaactgtaagaatgacaggaataaacagaaagaaaataccaaaagcttcagtggaacaggcatggaaacaagggcacattcaatagggaaggaatcagaatgcatttggacttctcaataatagctcagaatgctaaagtaaaataggcaatgccttaaaaattttgagggaaattatcttcaagctagaattttatagctagtcaattattccaatataaggattgactaaagtcagttccaggtttgcacagaaggaaaattgcacctctcgttttttttcatttttaaggaaggtacaggcaggaagaagtgttttagtatgagagggtaaaccaaaaaaagagaaacatatgtgatgtaagaaaaagttatcaaaaccaaaacacaggatgagagactggtacagcagggttaaggtcatctgtgccagatcagaggaggcagactggggttggaggggtctctggaaggagtccaaaacagaggaaatatctgagcatttagaaaaaccattcatggagattttacatagctgttcaagcccttaaggaaaaaaacagtgattaaaacataacgaaactaagcaaattttaaaacaaggcaatcctccctaggaaaaatgaagagttgtgtaagaaaggagcaacatttcaaagtacagtacactacttggttccacactgacattacagcactgctgacttaatcaaaattgatttggaattaatttggaattctcaacctctataaaagggagtcaataggtaaatttgtttggatatatccagaaacagctgaataagcctattatttggcaatatggagggtaaatatcaaaagatatagatgaaaggattagagattacttctaggggaggaaagacttggatttctggaaagcagaaggcagagagaaacaactgtcttcaaatatttgccctatagaggaggaatttgattgattcttacttcagagtgcagaatgagaattggaagcaaatgtttacttagttttcctaaaaagaaatgggctatattgtattatgtatggcctccaactttaggaagtttcactaggacacaattgaagctttatgcacttcaattgaaaattgtcttcaaagaatttatgttttgtgtagataagaagggataagaaagagaaaactgcaattttaaagatatgataaaaagagagggaaaaacatatcttaaaaatatttcaagaatcacaataatttaactctttagatatatacagtatttatgaactaatgaaaacatattgcattattgttgtttactcagatgagaaaaatgcaaattctacctgaattatggggcatcctttgacagaaagggattctgctatcctttagtcttcaaaattatcaaataagtgtcaaagttttatattgcctcttttactatgacatcaggtgtctaaatgaaacctttaagttttccccagacttttaaattttaccttttgataaaattggttttcaaaaagcatctgttgtttgtttgtttgtttgtttgtttgttttttcagacaaagtttcgctcttgttgcccaggctggagttcaatggcacgatctcggctcactgcaacgtgtgcctcccgagttcaagcgattctcctgcctcagcctcccaagtagctgggattacaggcgcccaccaccacgcccagataatttttgtatatttagtagagatagggtttcactatgttgaccaggctggtcttgaacttctgacctcaggtgatccacccacctcagcctcccaaagtgctgggattacaggcatgagtcaccacgcctggctcagcatctgctttttaataccataagctaaacatctttccaagtaatgtctcttttaaaaacttttctagaatttttctaagcatcaaaaataaataaaaatataaagaaacatttcctcaatctgtaagaaactgagttttatccatcatagttttctccacattttgactttaaaaataactatgtaaaattttcagagcctcagagtgacacagaaaactttagagagaacatttaataaaatacaaagaaatctcttaaggtacctcctcaatgtataccataatattaaatcacctactttaccatatatgaaaaaatggaataccttattaacacactagaaatttgaataaaatgatgaaattataaatgagaatgctaaactcaataacggcagaaaccagttccataaatgtttactgaataaagaaatgaaccgatgctatgtaggaaaaaaccacaggagcaaacttgtatatacagagttaatcaggcttacatatgctttctgtatttcttctcaaattatttttatactttttttacattacaaagcttcaaattgtctaacatttttgctccagaaatgtaagatctgatatactatcctacacttactcttcagtagagagaaaattcagttgcttgagcatttttatttaaagggtgaagttttacaaagttgcaatgtatatgcacaacaaagaccttttaaatatgcaatctactttatctgaatggcgcagagttgaatgatctttagtcccacaaaaataaccttgaaaggaaagctacatgtaatagatctctttttcaagatttctgttgttttgttctgactctaacgggtatcctgtagatcagcagagacaagaaagttctcctgatttcacctaagattgacaccttgccaattttagacgagaaatgctgacaaggagacaggatcccatttgagccactatccgtgagccagctccctgtcacagaagaaatgtccatgagtgagggaggcatcatgtctgattatcttccctatttctagatgtgaaaattctcctaaggcccacgaataaacaataaagaggttgcccttagatagattctctagttagcagaataggaaataatttttttttttttttttttttttttttgagacagagtctggctctgtcgcccaggctggagttcagtggtgccacctcactcactgcaagctccacctcccaggttcaagccattctcctgccgcagcctcccaaacagctgggactacaggcacgcaccactacccccagctaactttttgtattttagtagagatggggtttcaccatgttggccaagaaggtctcgatcttctgacctcgtgatctgcccgccttggcctcccaaagtgccgggattacaggcatgagccaccgtgcctggccggtaataatttttttattagtgtatcagtataaattttcttttattcttaccttctcctaaaaagaacagtcacatcatttacacattatcatttacacatgatcattcacacattttaattatcacactatatttaatgacatcccaaacagaatgattaatcattaatgatacaaaatgtcttctgattttttctatcaactattatagggtttgtgtatgatgggcaaaatctactataatagaagacatgaactttcctaaatttttcaatgtttacaccttgaaaaaagttacaggaaagaaatagaaatggttctactgtgagcaagtctttttctgacaattttaatgattataagaaagtagatcttgctttggtattttaggtatgttgttactcatatttcagagatattttaatttagagtaattcttactattaataagtatcaccttaaaagaaatatttgtctcaaaataatgtgacaatcatgtttaagtatttcaataatctatacttaatgattaaacatatcaaattgattttataaaactattttttcctgcaaatttaatttcattgcaagtttctactgattttgaatggattctaacttccagaggtagaattctttaccaaacatcaaactgatatttaaaacacctgaataagctaacaataatgaaacttgattgattgagaagaaaattcatttcttcccttttcagtccttcaggaatctttcccatcccatatcccaccacactcctaaacactttcctctgcactcataagattgtgtgtgcagaactaaccacatgtatattctttcgttttaacattttttaacctcctgtaataaaaactctcttatgtcctgatctaattgtatttttatcctccatatctattggtgtctaacacacagtaacttctaggtaaatatctactgaataaataaacttaatagaaattcataaagattataaattagggatttaacattttttaaaaggagaaatagtgcagggagactaatctttcttctcttaagtaaaccagcagagtaaagtagcaagttttctctcctaaaaagtttgcctttcaaataattttaaaataaatctttgctacacacacaagccatccattctctaaacagaacagtttgctgttctctccatatttgttcactttaatcctctcagaatctcccatctatctacttaatgcaaagaaatagaaactcgtttactgttgctacttctcagtagctattcctgggattggatgaccataaaagactgaaatgaaaaggtgatacatccttcaatacatatatttaacagggtacttatatccagaacaaaaaaatagctcccatatatcagtaagataatgcagaaaatccagtagaaaagtggacaaaagacttccataggtgcttcagaaaaatatgatatcccctgggaataaacaatttagccatcagagaaatgcaaactacaaccacaaagaaataccacgacacactcactagaattgctaaaatttaagagtctgataatatcaagtgttgacaaggatttggggcaactggaattctcatacagccactttagaaaactgtcatatagtatgtactaaaactaaactagtttacactagtttatactagatacactaagatcctgcaattcaactcctggctacctaaccaacagatatggatatacatgttcaccgaaagacatgtctgagaaatgctcatcacagcattgtttgtaggtcccacattaaaaacaatcccaaatgtttgtcaactgaaggataaatattaatacaaatcatattaattcatctattcatagaagtcatacaagttatatacaagtcatagaagttatatgtttatacaatacagtactaggattgcaatgggaaactacaattacacgcaacgtaaatgagtctcaagtacagtatcctaactgtcacaaattttctaagttccattcaaaaaagttcaaaggcaggcaaatgaatctattatgtttgatgtcagaaaagggttaccttttgggaagatagtaactgcaaggcgggatgtgggggaatttctgtggtgctgatgttattggtttgagcattgtctacataggcgtgttcactttggaaaattcattgaactggaccattatgatttgaagttttgctggatgtcttatttccataaaagtttgcttaaaaaaaaagcaactccagtccaaattgatgtctctcttatactagagtacaactttctcaagtagacttgtttcagattgtttgaaatattattagccttttctactatatttggatttctaactcgaggaaaaataatatatacttactggataagtgataacaataagcaaaatatattgagcctttatgtcacaggccctatttcaaccacttttcctattccattttatccttaaaaaataccctccttagtgagctactattttcattctaagaaaatgaaatgttagaaatgctaagtaacttggcaaaggtcactgaataaaacaggagtcaaactgaggcattctaataccacagctcttattcttacctacaagatctaggatagacttaatatttaatatttcaaggcttaggaataatatgtcttcaaactcttggtaaatgaaagttcacatttcttttggtaaagtcaagattatattctcttacatgagactatctaatacaaaatcttgttatgcatcatcagatgggcccttcacactgcaatgtgtaatcctagtgctctcagattgactttttcactcactgcccaaacttttactctcctcaagtccaaacttccctgatctcaaaattacccatcacagcttttctcaactttattctgttcagatgttgtcttatacctcttttactcccaccttcagatgccaccccacccttgggtcaaaaacagccccatcaatcactcctccactggcttattctactctacctacagacacttgagtgctctgggtgagtaatccacaaacatctgatgactagctgcacgaatggcccctaaatcatcctcggcttttggaacattccctccttgacttttcgtctctagtctgtcacttttcagtttactgatattttatgatgagaattgtccactaatcttctcaagacacagttttgacacccagtccaaaaaaaaaaatcaagtttttctatacctatagaatttttaaaatttcttaggcatgatcctcattggtcttcttgacatggccttaattcatatttctaactttatgcccaccccttgttctcacaaactagtttcacaaactggcttgtcattacaaacaagtcaaactgacctttttttttttttttttgagacggagtctcactctgtcgcccaggctggagtgcagtggagcaacctcggctcactgcaagctccgcctcccaggttcacaccattctccctcagcctcccgagtagctgggactacaggcgcccgccaccacgcccggctaatttttttggtatttttagtagagacggggtttcaccgtgttagccaggatggtctcgatctcctgacctcgtgatccgaccgcctcggcctcccaaagtgctgggattacaggcgtgagccaccgcgcccggccaaactgaactacttttttctggtctctatggttttgctataggtggtctcctacctggtacctcttttcccaatcaaaatcctatctacccatcaatccttagacatataccttctcccccataaatcctttcatgtttctccaattagatgcatattttctgacttcctatgacatccttttctggcttgttatagttatttgcatgtatatttaatttttcctagactgtgagtcctttgaggagagtatgccattcttatttatcttgtttcccacaattcttaacccagtgcctggtagatatgggatctcaataatcttgagtggaatggtaacatgcaattctggcagtgcagtggccatgattcccttcataactacttctaagacctctgggtttccctgagtcacagctgcaaaatatcaaaagctgtctaataggatcacttttcagttcagttaactgacacagaaggatttactatgtgacctaataactgaactatcaaaaactttgcaatatttcatttaattcttacaagtagatgtataacatataataatgtataagagttttaatacataaaaggccatgttacaacataatgtgataacaaagtaccttcctggatatgtcctaccactggttaggaattgggtaaattagtgtatgagcttaagtacaatctagggggtgaggattacaaccaggaagcggtcaatggtggctataaaaacaaattacgtaattccaatactgactccaatttataaggtttgagagatcttattgaacatatattcctcataagtatcagagtttctaagtcacagtctttcaaaaggatatattgctcagaggtggcaagggtgattcactggagtgcccaaaacattattttttaggacatatactcatatttgttttatctaacactccaggaaaataagcaagatttactacatggggctatatgtcagtctgacatacaacatttataactcattagatttcctgacagaagaaggagaccatcactctgtcatccactttcagtgtactcactgcagctcatacatgcacactgaggaagatatatgaactctatcatacgtataactcaaaatcatctgtagtgagatgaggagtgccaggaggaactgcaactacaactgctgctgctgctgctggtggttggtttatgttttagttttaagcacacagacttttgctggttaagtttaaaatcataatgatgaatgggctcataaagatgaattaccaatttttatattaccaaaaagaggcttgttccaaatttgctgaatttttttctatgagaaaaatgtgatacctaatatctagtctttaaggtgaagaaaacatttagcagtagttgagaaagcaactacttttagaaactcctactcaggagagaacattttgaaatgtttggaaacgtttctcctgctaggtgattttgcccagggcatttgtttttttgagacggagcctcattatgtcgccaggctggagtgcaatggcgctatcttggctcactgcaacctccgcctcccaggttcaagcgattctcctgcctcagcctcctgagtagctgggattacaggcacgcgccaccacgcccagctaatttttgtatttttagtagaggcagggtttcaccatgttggccaggatggtctcaatcttactgacctcgtgatctgcctgccccggcctcccaaagtgctgggattacaggcatgagccactgcacccaggctcgccaagggcatatttttaaaactttgaagcaaacatttcagaaacgatatgccaattgtatatttctaaaatgttgaaacaaaaatttctaatctgtttaaatggcttccgaatatttcaaagtttcactgagttttaaagcttcttgttaaaatattgaactacagcttcttttagtagtacttcaagaactgaataacctggaaaatagaaatttgtgaagcaaatttcaatctttttccaataattatttatactggatttgaagtcaattactggtatatatcaggagcattcagtgacaaaccttgttatttggaggtattttgtgaggtatatttttcagctaaagaagttattgaaaccacatattgaaataaaccatattttaaaactgctatagcacaatgttgaaacaaaatgttcaaaactaacgagtctactacttttaaaaaaattaaatggttagaacagttgtgagagaaaagttaccattcacaaaataaaaattatatttaacattaattattcaacttacccttttaaatttacacttgtatatcttctataaatcacataatcatatgttagtttatgtgtgcaatgtatgactatataatacatatatatgggcacattctcaaaatgttctactgagaatgatacgtatgatcaaaaaattaaaaatcaaatgacttaaaaatgtttattcctaacaaggaataaacataaaaacgttaatgtctgagtgatgtgataatgtagaaattaaagtatgattttctcaaactattggaaggtaacacacaaagtttctataacaaaaatttgggatatctaaatgtactaatattaagaatgcttatatatcttctataaacagcctcaatatacagcacatagatattgtagaacactgacaacaatttcttgagatgcttaaacattcctaaagcattatgcctgaaaaataggagaactgccatggaaacatggacactttcactttctttaacatggaaacatatagaaaaaaacatggcctataaccatttcatattgagagtttttagggttattttatactgtacattccaacttcactcaacattataacacacacacacaaacacacacacacacacacagtctcctcttttatgatctcaccaataattagagtatccacttaaatttttcccaggtcatacatttcaaatctgcagggcccaattttgtcttcaaaattattttctgaacatcatatctaggacaaactatacatccatctacattctcttctttggtgacatatgaaatccacatgtgcagaaaaggtagatgctgcaattatgcaaaatattattcttttatggtagggaattaggacactgcttatctcttgccaggttatgacagaatagcctactagtttaggctttgtagaaggaacaattgccgaattattttactgttaaatacaatcttcattactaattcttggattatctcaacctagtaagccccaaatattatgggtcttcagtatgataaatcacatggttgttactgaaatgtgttaggaatctcacccggcattctggccacctgtttattaattacattcattgctaaactgcaaacaccttgtccacagtgcctggtttatttttagtgaccattacgatgtctaatatgtagtagatactcatacttttggggagaatcaatgaatgtactttagaaagatacagtagaaaacataataaatggaaaaatactagttaaatacttaattgttatgagaagtgtattataaaatttatttttaaaatatatttctaacctgtttactatacttatgtgtctttttcaaatttaagaaaacaattactatgttttcactgaacactccactttacaaagtcaacataaagaagtggcagtttcttgaaactatttgcctacacattgcctggctcctgctggccttaggagcaacagaggcagtttcttcctgagtgcatttctcttaaatgggagctacagggggaggcagagcccaacaccctttgctcagacccttagtgctcttttcaaatggacaaatgtcagatttaccggtgtttgctgctactacatgctcatttcttcttcttcctcttcttcttcttctcctcctcctccttctttttttttttttttttttttttttgagatggggtctcggtctgtcacgcaggctggaatgcagtggcaccatctcggctcattgcaacttccacctcccaggttcaagcgattcttctgcctcagcctccagagtagctgggattacaggcgcatgccaccacgcccaggtaatttttgtatttttagtagagacgggggtttcaccatgttggccaggctggtctcgaactcctggcctcaagtgatccagccgcctcagcctcccaaagtgctgggattacaggcatgagccactatgcccggcttacatgatcatttctgacagtgcttctatttgttgcattccattatatcatataatagatttagtacagtatatatttttttctgcacaatgtttcagaaggacattttttttaagaagaaacacaaagtgaatgcgccagaatttagggttcaagtagcaagctttcatttacaaaaaaaaaaaaaaaactttctctttttttgtgtgaggaaaaacaatctttaaggcaaaaaggaaaaaaatatatattctcttccctactgttggatagtcatcattcccaaagcacactgaatacacactatttgtttaccaaatatgatttcattctatgtgaggaataaaaacattccaagaaaataaattacttctaaaatgaaacttagtgagaaaatttaagtaatatgaatttacttaaagagcatttgctagttgaattgtgttacacgtaatgtcccttactatatatgaatgagaaaagtaaaacttttactcaccttttaaagactaccttggtcataagcatatctatttttaacttattaaataaatttgcttacatcattaatttgtattcattgtttataatatataaagagaaaattataaaaatttcacagtatttaaaaattgactgctaacaaataagtcttatacttttaaatcccagtgttagtttctaacaagaatattatgtaaaaaatacagtagcttatacataaactaaatacaattatgaaaacatatactattcaacaattaaatgtttaataagagaaattaacagtttgttatttaagaaaaacaccaccgaaagaaaggaggcattccttatattaataatataagatctgttcagtgactcggaacattttaagtgcaaggagtaaaaatacaacatacatatgaatgacataaagcacaaagccacaatacccactaataaacgggttaaaatacaatcatttcacgctgactaatcaccaaaaatgtagccattaaattaacataggctaagatttatttattcctttttttattacagcacaagactttctacaacatgaagaaaatttaaatgtatcttaaagctttctaataatattttaaataattttacatttcacatttcatttgctttaaaatgaaaaatgtttctgagatttcatgtcactcactcatacacacacacatgcatgcatacacactcttaattttctacttagtcaacaggatctgttgaagttaaagttatccatgaaagaatattaatctaatatgctaataagctattctgaagtttgtctaatatgcaccaacactgaaagaggtaaaatgttatatttggtattgacaacagaacttcagatcccctaaacccatttaatataaaagtctaatttaacaaataaatatgcttcatataataaaagaaatccagtcactctaataatatgtaagtacttcatacatataaaaaagtaaatatgattgtaaaaattctatacaaacctttattgtgatttttaaaacttcaatacattcaacttatcaaaaaaataaaaatactacatttcttcatagtgcaaagagtgaattattcaatgaattccttttgggatatacatgtaataacactaaataattctgcacatctgtcttactatttggcaatctgtgattattgttttcttggtcatttgtttttgtgaggttgaaaagtcatctatacagaggactttaatgagcattcagatttttcacttgtgatataatttacatacaaaaaatagcataacaaaaatatattggaatatagtatagatacatttacataaacattgcatgaatatcacagtggatatgtagagaaggttgataaaccttaaaatgtaaaatatcaaaggatcaaaaacatctaaaactgacctggaatgaattatttgtaattttaatattctataaatctaagtacctttttatgttaaacttaaaagcattataatgtttattaaatagaacaggggtcagcaaacttttcccagaaaaagttagatagtaaatatttcaggctttgtgagttacagagtttctattgcaactaatcaatgctactgctgtagtgcaaaaccagccatagataacacgtaaacaaatgagcatgactgtgttccaatagaacttattttaaaaataggcaacaggccagatttggtacctggaccatagtttgctgacctctaaaacagagaatctgactcacaaacacttaattttaattgcttcaatatctaatataaagcatgagacctaagtaaatgtttaatgcttggtgaattgaagtcatgaatgggtagggaaaataaaacgtctatgctcagaaacaaatgccattacaattcaatctcattagcagttaggattctgctctcctaattgggaaaaaattccaagaaagtaatccacagtcttcttaagaactaggcttgcaaactaaaaccaataaaatgaaagaagatggaacagagacacagtaagcagaaagtggatttccaatctaagatagctaataaaaatatctttttatagtgagttcttatagtatttcaaatctccccaagtaaactgtaaactccatagggataagaaatatgtttcaattgtctctggatcacagtgcctaggatatagtagatggtcagtaacgacatttattaaatacatatgtgagtgctttccatggcaaaatatgtttttcattagttcccacaagatgatggtcctttgaggcagcaatttcactttaagatcctcctataaagttaaaatgttctgttgtttaatatcatcagtcacactttgactataaagatgaatttcagcctgaaccagagcttgacctactcttcaaataacatgacttgaaacttgggtttatatcttattataaagatgtttgggtagggcaaaacaaaacaagagcaggcatcaagggttggttataaaactggagttataactaattttcaaataaagaaccacatagctttataaatttaattacaaatagattataaactcaaatcagttcacttaatggcaatgtacttggtcattcttgatttaaaatatcaatggtaatcaaaatgcctatttcaatatagttatatattaattactcctcaaaaaaaagatatttgaaggctactaaataatcatgaacaaagtttatgagttttgtctatggctccaataaaaacccagaaaattaaaatattcccaaaccactaactccacaaagtgggagaaatgcataatctatagattattacataaattaaacttttgcatgacatatgtaaaaaactgtaaacaagttctgttatggaagtaaatttctctacttttataaacataatattttcacatttccaaacaaaataataagttggataatgacaaaaaacaagttttaaagaatactatttggtttttggagcagttatggatattaacagatgaaagccacacataattatatgcctaaacaagacacagccttaatttgccatttttacaagcacaacgtcaacattatatataaacataaataatataatagtcctgattaattgacagcaagccaaacataaaacggagaaaaatatttccattagaacagtagtatggttcaaagttcacatattaaaaaataaatatataaaaaaactattatatatgttacactacttgaaattaaatagattcctcttccaaactatcaaatttcaaaacacaaaccaagagggccaatgatatactttaaaaagaaactggagaagacaaagtgtatgcatcccacaatttataaagagaataaattaaagcaaaagagacaaaacaaaacaaaacaaaaaagaataagaatattatcataccatacatagcacagaatactatgcagccgtaataaggaatgatatcacgtcctttgcggggacatggatagaattggataccattatcctcagcaaactaatacaggaacagaaagccaaacactccatgttctcacttataagtggaagctgaatgatgagaacacatggccacatggtggggaacaacacactggggcctgttgggggaggagtgtggggggcagggagagcatcagaaagaatagctagctaatggatgccgtgcttaatagctaggtgatgggatcatctgtgcagcgaaccaccatggcacacatttacctatgcagcaaacctgcacatcttgcacatgtacccctgaatgtaaaataaaagtcgaagaaaagaaaaacaatgaactctccctcactcagactcaaactttaaagtatgacatgttaacagacaagagtgctatcataccgatgtccatggttcctgatgccatgacacatcagcagggcaagcatgcatatgacactgtattacgctaggtggcttgtttacaatttcacagttgtgatcttctaatatttggccattgggaaattgacatattacaagtcttgattttattcctcctccacatgtttgtgaacactaaaaacaagaataggaaaattcaaaactgtggttttaaagagaataatgtattgcttcattcaatgtttaaacataattagtaattatgtttattctagtaattttaacataattagtttactctagtaatgttactctagtaatggtagcgtttaagtttataattacttcataattatcaacatttccccctagacaaaaaaataaatcaaagtttcaattccacgactttaaaaattgaccagattttgaggattagtatcataatatatttcagtaagatatccaggacctataagataatgttggcaggttaagccagaatcaaaatttatttatctaagtcatgagcattaattacataatgtacaatatccaatcaacaggttactaagtaaccatgaaagctattaataataaggtacgtctaattttataaacatgaaatgttcagtatatataatataaaaacagcaaataacaaaacagctgtataatgtgaaccaatttctaaaactcatgcagaacaaaagcctggcaggaaatataccaaatcttgctaaaagtttgtatctctatttggacatataatttgaattttcaaaataagtgcatgtaaactcagaaatagaagtactttcgttttggaaaacagtaaaactgtatcttaaaaatgtgcttgatatgtattaacacctggtctgggtgtactttaaaaacatggtttcaaactcccaatgaacagaaattatgtgctaaaaatcattaagcaaaaacatttgactaagtcattcattttatttatccaaagctaatagaaatctttgcttcttatttattaccattccacattacgaaggaggttagtattaaaagtgactttaaaaaattatctttttatttccagttcctagagagtgccagtgcatgaagcaagtgctcaataactgacaactatctggcttaaagaaaaagatttgccaaatgcataacttagtaataggattaaacatgttttatattttattctagttttctatttttatatcaacctaattttctaagaaattaagagaataaaccaattttagaaagatactagtaattcaaagacatattgcctagcatattagagtctgctgaaaaatctagaatatgcattttttaaatcatgaatgagtgacctaaaccatgacagaacatctattaaaagaacttggtttaatcactcaattaaaataaattagtcgggagaatcacttgaggccaggagtttgagaccagcctggtcaacatggtgaaattcccatctttattaaaaatgaaaaaaatagccaggcatggtggcacacacctgtagtctcagctactcgggaggctgaggtgggaagatcgcttgagcccaggaggtggaggttgcagtgagtcgagatcacgacactgcattccagcctgggcaacagagtgagaccctgtctccaaaaacaaaaaaaacaaaaattctttttctacatagtatagtgaaatcagattattgaacagtataagatgctttttactttcagtcttcagagatgtaataatctcacaagtttagaaaatattatgacttacttctccccaatttccgtagttccactgtggacaaggccctggaccacattgctgtaactctggaggcttggaggctgcatcgcagtaactagcactttgtccattttcatcctggcagaccacagccctatgctgaagacctccagaacaactgctggagcactgacaagaataaaacacaaaatatgcacaaactgcggattccacataatgaatttacatggtaaaaaaaaaaaatcagcattgactcaatcaaaatcaaaccctacattagaatctccttcattggaatcacaatttgaattgagaaaatctatcaaaacacttgagttatactgggagcttcattagaatttgttgatgaaaaggtgggactttcaagtttgcattaggaaacaattttcatttctatcataagtgttaagtaaaaagaaattaaagtttttgagatctcactagaaaggaataaaagacagtattaaattacttaactttacactggtgtttttctttattttgtattatgaatgttatgtaaaatatgaactaaaactataccatttgtagtttgtcatgattttataccagcttattgtattgctatcataataattttgggatttaggtttattcataaacatttatagtcttaccccttaaagcattttcttttgtttttattacaatgaattctaatcagattgttttacagtacattcctctgtaatcataataacacattagtgcataattcaataagaactctagcatttgtaatgagcatcaaagacgcttaatctttttaatatttaaactattgatcttgaaataaatttagcatttaaagtactgatggcatcatatacatacctgttaaaaggatgtaatataacaaaattacagaattaatataactcaataaagatggcttactgatccccatggtccggttctccactggtttcctctgactgatggatggaccacctgattttcattatcttcaagtttttgagttaatggcaaattcgtgcttagataatagcttggctgcacaggggaactaggaaagtggctgtgtgcaggagggcaggctgccaggctacattcctgttccatcaaagggcgaacttcaggatcacagtaattctcatcaattggctgatggtagttcatgcataaaacttgtcgagttgtttttccatggccacaggaagctgaacactgatcaaaaatttagccaatggtaatatacaacattaatttatatttaatatcaaatatatttaaatttttcattttctttttttctcataagaatacttacgggtgaccaatcccctgcttgccactctccacaaggggtaaaacagtcccatatttcagcaggtcggggtaagtgggcacaatatgattcatctgctattctatcaagagcatcacgacagcttacatagcgggcttgagtacctcttccacaagatacggagcactttttaagaaatcaaattgtatccgggcattatacagtagtacctcacccatgtcccttttacatagctgttactcacatttctaaaacatccagtttcttgagaaattttaaattattatagataatattacctgacatcacttctgagtcaaataaagatggggtagtgaatattccaatcagtttagatcataaatttcacaaataatgtatagtaatttcaataatacataaatataatgatttaaaataatgcttagttatttgctaaaattaaagatacttaaaatattttaggtaagagaatcttatgatatcaataaaaataattttgatatataatatctactactaagtaacagatagatataattccataattaaaatattcagagaatatatgaagcttaaaaatacatattctacaagattttagcaacgtatactccacatacgttaaagctttcagtgtagaaaaacaacatgaaaatgtttgtagttcaaataaaagccgatacagcctaatactaaatctgattctcataacaacctgtgacgtaagtattattagtattcccattttgaagattagaaaatatactcagaaaacttcaatttcttgtccagagacacagagctcttgaaaggcaaaggacttagccattaattcctaattctaaaccctatacttctttgatgccatcaaaatacctgagaataaatgtatacattgtgaaatctctagcaaccattttgttgatgtctaaaagctaccataatagaaacactgtatctattaaagaaattcacttactggggtccaagaaccatgtcgccattgtgccatcttttttatgagaacagttggtaataaagcggtctcaagtttagaaataaatgagcaaggtgtaagtacacagctctgttcagaagaaaaatggttctcgtaaaacattaattaatgactgatttatacaaaatctaatacttcacttcttctgtatgtctcaagaaccgttccatactaaattagaaattggtaatatgaatgttttcattttcaaaagcactaactacagtatcgtcaagtgtcaatagtggataatgactgaatcctaaagtttggaccattctgtttgattgctgaaaaggaaaagagcttcagtcctttaaaaatactgctcagctaaaacattctgaacggacacaaaactctaccttaaaaaacacaatacactttaggagttcatgatatttataataatagatataaccttcttcttcagttcaaagaatggaaattcacaagttaaatgagtgagcccttagcagataaagagtaaaaaaaaaaaaaaaattcattgataaagctacaaagctggcaaaaccaagaacaacaaattctatttttttgcctctctctcacacatacacgtgtttaaggcatacaagtttaagtggaaaaaaataagtaaagaaataattttaacacatcaataatctttctgtctcataaatctttttgtttgtaaaccatgattctttttacctgtctgtcactggggcgactagcttcatggcattctgtgtcctctaacactgcactagctagctcattgacacatttaacatctcgcatctgatacccatgtccacatgtggttgtgcactgaaagaagaatatagatattaaaaaaacattgtttcccaaaagttacacaaacttctattttcttaatgaataccctgttaataatatacttttaataatctttttatcaatcctttatactagatttaagacttaaaaagagcaaattcaataaatatgcatatttattcaaattaagtaaataccaaatattgaagttaaccaaactgtacaacaattaatgtattctgaaaagttgtcatataaaaatataaatagaggcctgatattttagaaagcagtcaatatgatttaaggaaactaaatatttttcaaacaccacctagtgtatgcatgtcatttaatatactaagtaaattttaaagagacaaagaaggaacagcatataaagttaaagggaaaatgagagaaggcttcctgtcaactgtggcaacctctacagaataataagctactccatcctcatccagcctgatcattgctcatcctgcagactcctagctgcctgttcagcaaaacgtctaaacgatgcctatcctaaaaacaataaagatatcaatgcagacacagagatgaaaatatttataatctaaataaagctgataaaagcataaagtctgtagcattttggttaacaaaagggaatttaaaagcaaagctgaaatatttattacagaaaaattagcagtactatcaacatgttacacataaagattcacatttcagggttgctgttgttttttaataaaccaagccaaattccattgcatccactaagggaggagtaaatataacacaacttttgtgctattctgtaaagatagatcaaattagaaaaacccatatcatatactcacaggaccccatggtcctacttgccaggaagcacatgtatgaagttcacatggactcagagattcaggtttggtacttgaattacagaagccatcactcaagtgatctacattcagctgacaccatacctgccgctgctttgttcctttaccacatgtaacaaggcactgtaagaataaaactgatcattatttatttgcagcattagtcaacacaaatgccttaaactgatgcaatgatcaatttgcatatagaaatacagttgaaaaaccattcccaaatgcattttccctcactccaccagagatattcactgggtaaaatcagcctgcccctaacttctgctgcccaagtcccactgaaacatccatttatcctagaaacaaaggtgcaaaactaaccttagaataagtattcatcccaggctgctgtggaccctggcactttcttatgcaaagggttatagattaaatatcagttagtgttattactagtcagatactgtaaatagtataaagacaaactatcttgtatatttctttttttttttttgagacagattctcactctgtcacccatgctggagtgcagtggccaatctcagcttaccgcaatctctgctcattgatactccacgtcccagactcaagcaatcctcccacctcagcctcccgagtagctgggaccacaggtgtgtgtcaccacatccagctaaatttcactatgttgctcaggctggtcttgaacatctgagctcaagcaatccacccacctcagtttcccagagtgctggtattacaggcatgagacactgtgtgcctggcctgtcttataaatttctgacagctttgataatagttatttacaaaatgatgaaataaatttaagcacttttaaattttgtaaagtcttagattacaaagctttactaacacaatattttaatagttccaagcatcatgtgtttaatgtacctcgctccattcactagcagcccaactgggacaggaaaattcattgcaattctctctcgtcactcgggacagttcttggcattcattgtcagcaagacgatggccaaagttattcatacaataagattctcgagacctttcccctcctccacaactcctggaacactgattaaaaaaaaaaaagtggtaactaatggaaaaaaatcagattttcaacaaaattatacttcagagtaacataaatacgtaattagaaagaaaggggcaactttttttaagcaatcatttttattgtacctgagaccattctgaataatgccatcttgtgaagacacagttaccatggcatagttcttgggtaggaggtttaagctggtcaccacagtagtggtcatcaacttgaacagtctgtccttcatgaatggaatacttcatgcaatggatgtccaaggttctatatccttgaccacattgggatgaacattcacttttgccaataacatgccaccttgaaaaaagatgttactatacttaggaggtatattacataatttaaaaacagattcagagacactcatgcattcagtttttaaaatcctaaaagttgatagacaaaccaccaaaaaacaaaaccagtctgcagccaggaagccagcattatactactgacctcatgccagcacttggtggtagctttggaggtgcgtccaaggaaccccaagcttcctcaaaaacctctgaaaacaactggtttagattatgattacccaattacttagtggcagatttaagataataactgaacatatctgactgccaatcagatagtttatccctatgcaatcctctataagtatttcgattttatgaccagggaacgtctaggaatttgactacatcaataaaaataaagcatttaaaaagttaactagtttttgcaaagtacactacactttctcattcattcctgtaatctatatttagacatgtttccaggtaaaacatgtcttccacaagtaaaaatgttagttatagccaaattatcccaattgtagtctagcattcatcaatgtgagggcaccagtataacaaaacacagaattcacagaattcatttccgtccctaatagcatctcaagaatttcactgtgcttccttttactactatgtagtggatgcaacttatataggcagttctactactgtgcttctgctatgccttcaaccaacatcataaatatatagaaattctcatcaagtgaaagaggttctggccatacctgaatgttaaatggcacctgctacaatgctaaaaataaatgtataaatatgatagatggactcattgtataccatgtcactacaagaccaatcacgcacacacacacatgcacacacaaacacacacacacacacacacacacacacacacacacacaaaccaaataacaagaaatttaaattagaagtataaacttgctgtcatgatctaggatcaatttccctaaagtttaatggacaaaatactgatagaatgtcaaggaaatcaatcaatttgatttctccaaacttcagaagtttactggttcattaattccgtggaaagtaaagaatcatgctaaaaaatttattgtttcagatctttaaaccatccattttcagataacagtttacttgtatttattttacagacaaaattacaatctttttctacataaaatattgaggcctatatactggtattcagaaaatactatgaatgaaaattcaaatcaattatgtactgagttttaccataaaatagtgagcctgaaattttttcatggcatggcagatgatgagtaataattgcatgtccatgctgtgtcagtcactgtgttagacattttaatcttagctcacttattaatctggttatattacatattatttctcttttaccttagttcacagtctgtattgcaactttgagtaacaaatgatggaagtggcaagtggtcacattctttatcagacacaacactatgatcactcttatgtatgcaagttatgtttcttcgctgaagaccttggccaaagtcaaatgaaaataaaaaatgaaagaaaaattcacagttagatgttccataattatgtaattctgctaatagcttaaaggagccagctaagcaagtaaaaatttccaatgcaacatacaggatatactagtatattaatctaatgaggaatgacttttataataagtaagctgaatcctgaatgactgaaagtttgcttaatgaagagatgtacagaagatgggacaggcattggagtaaaatgaaattcactatagtgggatagagtggttgttggtgaataattgagtagctaaggacagcactgttgctatacagtacactatattactgtcatccatcagctacctcagctacctcccattttcccataagaggattgcacatctctattgctgcaatgttatagtaacttcctgtaggggaagaactctttcctgttgattggcatcaggctttttatcaaccgactgaaaaggaacgtgacctattccagtcccacccagctctctttcctttttccctctgcctccagaacatcatttcccagatacagctgatctttcagcctggaatcatggaaaaaaaaggcatagacaggcaataaaaagatcagtgtctgtcaccagttgtgggggaaggaaggaagaataaatagatgaagcaaagagatttgtagggcagtgaaactactatgtatgatattatattggtgaatacatgtcactatacgtttgtcaaaccatagaatttacaacacaaatagtaaactctaatgtaaactatggactttaattaataataatgcatcaaaattggctcatcaattgcacaaatgtgccacattaatgcaagatgttaataatagaggagtgtggaggagaatggcagagggaagaaagatgaatatgcaaactttctgtactttctactcaatttttcagtaaacctaaaacttctctaaaaaataaagtctaggccgggcgtgttggctcacacctgtaatctcagcactttgggaagctgaggcgggcggatcacgaggtcaggagatcaagaccatcctggctaacaaggtgaaaccccgtctctattaaaaatacagaaatcagccaggcgtggtggtgggtgcctgtagtcccagctactcgggaggctgagacaggagaatggtgggtgaacccaggaggcagagcttgcagtgagccgagatcgcaccactgcactccagcctgggcaacagagtgagactccatttctaaaaaaaaaaaaaaaacaaaaaaataaaaataaaaataaaataaaaaaagtctataaaaaaaaaaaacatggatacagataccaagttggagtagacccatagccaattagcagccaaaacatgacatgagcaataaataaacctttattgttccaagccattaagatttggtggtttgcatgcaggataactacagcaaaagcaaactaagagaagtggtcataactgaccagagtcatttgaactttatgctttctgcaatgaggagacagtaaagagtttaagcagtcagtgacatgaacaaatttctgttttatcaaagttcaactttgtgcttccagttaactaaacatgattatatacgttatctctgctcctttctcaatatcttttgaaatgactatgagaaattctgaaaacgcataaacgtaaaagaagaaaaaaaggaaaagaaaaaaaacagcaaggaaatgaaattttgaatatgaaaagtagatggaaataactatttaacagagccaaggaattggaacctaagcctgcaaagtgggaaagtaaataagcaacaaatcattcatgacatagaacccaagagaggcccaggaatggaaaacaccaggttcctctgacagggcgaatgtgtgaggggtaggcctgaaataataaagaattaattgaaaagtattttaaaagaatggttagaccactagcttcctagttgagaacagcactatccaatgaaaacagaatgtgaaccacatctggaactttatattttctagtagtcacgttaaaaaaaaaagttaaattaattttaataacctttatgtttagccccaaatatttaaaatatgatttgaacatatcaatataaaattattaataatatattttacgttcttttttcattctaagtcttccagatttagcatgcatttaacacttacagcacatttcaatagattagccacacatggctagcggctaccatattgcacagcatagctctagaaaaagtgaacttgagagcataagacacagctgagaaaagctgggaacacactctactgaaacaaggtggctaaataaaattccccacactgaatgatgtgatcccagcccattcagcgctcaatctcctgctggcaccatgccaacttctgttatcccgcagcaccctcatgacaatcagaagatgagagaattcctctcttgcaggaccgtttaactcaagaaaaaagatcaactgacaataacatttgagacttctctccaatgacatatgagagggctacttaatgaccaaattactctataatgaaacttctagttaacttgtctgacccacagagggctttcaatcagacttttagtacttttaaaatatgaacaaacagcgcaaggtcagtagacattctaggaaagcctctaacacacacaaaaaaggtaaaataaacaaaaacaaaatagacctaggaggaaacacatataagtgagggagcagaagaaaacttaaagactatgattaatacactcagagatatgatagaaggtattatattcataaaacaaaagcaagatgttatgagaagaaacattaagaaaacaatgaatttgagagaataaattagaaaagaaatatcagtttaggaatgtgaactagtttcccaaagataaaagagaaaagttaatgtgaggaagtcatctaagaacatgataaatttctcaagacaaagatttatgtttccaaattggaatggcatcttaattaccagaaaaatagatgaaaaaacaaccaaatcaaggcatattgtcctgaaatttcataccactagaattaaagagaggatccacaaaacttccagaatacaacatgtcatgtacaagcatgacaagcatgaaattggaaaacaagccagaaaacaagaacttcaaaattctaaagaaaaacattctctatttataccagctaaactattgatcgagcatgagaatatagttatgtcattttcagatatgaaaggtctcaaaaatattctcttctcaagaaaatactgagggatatgttccacccaatgaaagaagtaaatcaaaaagagggactgagaggatttagaaaacagggaatctaacacagaatactgaagagaattcccaggacaataatgaaggaaaatctcaaaatgacagtcattaaacaagcctaaaaaacaacatgaacaaattagagaaaagagggccacagtagccaaaggtaaagaaaaagtgaaagaaaaatcaaattgataaattctataatatgcttgacaatattaagacaaaatgtagagttctgataaaaagcttgaggactgataactttcagtacacagaaacaaacaaaagagggaatttaactttaactttagagaaactaaaaaaaatacacaaaaaaagggaatataatcagagttcactatatggtaaaagaaataatagttgcttttcccctgcacgcgattgtttaagagaactctcctgctttggactcccaaatcgtctcccaccatgtttttccaaacttccattttgaatcttgttattctctgtgtgttcactgcattttaaaatgttccttcattctcctgtttctgaaatttctccttctagctccttatatccacggtcacagatgagcttacccactcaagttggaatgctgatcccagctccccagattccaattatcttctaaaaggatattcaggacctttctgtcaaaataaatttttccttcttctatgttaaccaaagctctgtgttttctacctctattatccccgtctatcttgcatcatttccttgtatccctccactgagacactgctaaaataggaacatttgttcccatgaaatcattctgggaagcactgtccagatgccacaggaccaagactgtgccttttcctgaatagggcaccacagttcctttggcacctcgtcaggtcagatggtagactgttcttcacattctcaccacctttggtcaccgcctcttgctgcccactttctatgataagctcatctccacatggttcggagcttcctttgccctgacccactcctgccctaattcccaagctatttctctattcttcatgaaaacttttcttccattctatacaaaattctctatcttcagcttcagtctcctcaaaaactgctccctccaccttttctgaggtccacactgtgcgtatctatagtactgtatttaccattttattaatacattaacatatatattcatgcatctgtttcaagcactaaaataaaacatgaattcagaattgggatcttattaataatctgagcatattccctcaataaatatgtactgcattgaacataatattacacaattaaatattcataattacagactgcagactctagtctttccacttttttccctactataaattgtcctgctgttcccactctgctccttttcccactctatttctttccatttttcatgccatctatacaattatactttctcatggtcagggaaggaaaataaaagacaaaagaatgtttgatatctcaacaataaaagaggaagccaggttgttgagaaagactgtgtggagatgagtggaagaaaaggcagatatttcaccaggaagcaggatatatataagttagagaaactttctgtggctgtgaaaaagagaatgagaacgggaaagtaaaagaacagtaatagatagagaagggtgaaaagagtagcattaaatagtgctgttaagtataagaaacagaaagaattagtgaaaaaagtagaaaggaaaaaaagattgaaaacttttgtatgtctgtgggatatgtgtatggacagtggggaggattccataggcagccaagactcaaaagtacccaaaatgatgccagaatgcacagtcagtcttttctcccttattgaatgccagcgtaccttgacacattttggtacagccttcccatggtccataggggtcccatgtgaacatgtcactcctctcttccaaagggatattgaaggaataatgtacatcagggttgtataaattacccacacacaacacctcaataagaatataaaagaacatacaattaatacataaaaatatattcttgacatcattttatatttgataatgttaagcacttaaccagtagtttactaatataattaaatccaagtgttattactgatgactgagaatttacctgcaaaataagttctttctcttgtcgattagtactattaattctttcaactgcgttatttgatccactgtattcaataacagttcttgttccttgcacattgatttctttttttgacgtacttagaagaaaatttccattgaaaagaaaattcccttcagcgtcagataatgctgtaaaagaataaagcataactcatgaaatagtaacaccaatcaacaatacagaaaacacttgtttaacttttttttttttttttttttttgagacggagtcttgctgtatctcccaggctggagtacagtggcacaatattggctcactgtaaccttcgcctcgcctcttggattcaaacaattctcctgcctcagcctcccgagtagctgagattacaggcatgcgccaccacgcctggctaatttttgtatttttagtagagacggggttttgccatgttggccaggctggtctcgaactcctgacctcaggcaatctgcccgcttcggcctctcaagtgctaggattacaggcgtgagcaaccgcacctggccttgtttaacttttaaagttcaaatccttttttgaaattaaagaatgcaaaagtaaatttatgttgaggaaataaactttattttactgtaatgtgggattttaacaataagttaggtaacttcagcacatcagccaaagatattaaaataaattcactctatacttttctatctcagatggtcatcttctttcatgatgtatgtagcttcagaacaagcagtgggaaagcagaaagaagtcatgaccccagcagacagattagttcaatcatcctggtcatcaatggtagggaaagaaggagcagccagactgctgcatcattccatttatgcttatcttagaaaaaaggtacaaagctttaaaactctagggtcgggaggccgagacgggcggatcacgaggtcaggagatcgagatcatcctggctaacacagtgaaaccccgtctctagtaaaaatacaaaaaaattagccgggcgtactggcgggcgcctgtagtcccagctactccggaggctgaggcaggagaatggcgtgaacccgggaggcggagcttgcagtgagctgagatagcgccactgcactccagcatgggagattgagggagactccgtctccaaaaaaaaaaaacaaaaaaaaaactctagggtcaacattctagaaggccatgcaatgactatgccattctctatacaaacgtctagatcttctatagaaaagccctctatccctgttaacacatacgtgggtatctgcttttcagaataatactcctatttccttctctgttcatgtccccttcttgttctctctttttcccagtgacagacattaatatatacctatagaatatgtatatgtgtgtatatttatttatatactatatatatacaaatagagaagacaattatatagtatgtattagtaacattactttttaaatataaaattacatgtcacccaaaatcatgcgtagtaaaaagaaatcaatgtgggataaaaacaatggatttaagtttaagttgttgtgattaatgtctatgtaatcttggacaaacctcatgctcagtttcctaaactgcataatagaaataataaacatttctatttcagtcttttaatcaggatcaagtttgaaaaatgtttgtaagtgtgtgaattgtaaagtactgtgctatttatttttaattttcaagaggatgtgtaatacctaaaattttacactaagaaaacccccatattaatcaaatacttttttgcttgcttaagttatacttttcaatggaataataacctttccagaaaacatttgtttggcattccaggaaacctcaccgaaagcgcacaattatctatggctaacttcctaatataaatacaatacccctctgaaaaagcaatattgaagggattattgtaaaataaatttggtgtttctgtgtatatgtggactagtataactgtctttatgtattacgctgaattcagtgaggaacaaacaaagatctatatttagtctatgacatagacattcctctatttaagaatctgcgctttatcaaatgtggctaggtctatttaagggattattggttatgttaaatttaagggaaataaacaaaactttactggcttagaaaaaaagtctacaaatttcactacttttagttaccaaacgtcataaacataaatgttttaaaaattccttctattgacatcacatgtctattttactcacttcaatttagactttgatatttccgtttataattttctcacaaagtatattgatactttattggtgaacatttctttttttttttttttgagacagagttttgctcttgttgcccaggctggagtgcagtgacacaatttcagctcactgcaacctccgccccccagattccagcgattctcctgcctcagcctcccgagtagctgggattacaggcatgcgccaccatgtccggctaatttttgtatttttagtagacacggggttttgccatgttggtcaggctggtctcgaactcctgacctcagatgatccacctgcctcggcctcccaaagtgctgggattacaggcatgagccaccatgcacagccaacatttctaatttttaaagttgagaataacctgtgatccagtcccagaaagatatatttgtctacatttggaatctaagagatacctattaaattatttatctccaatatggtagcatatatctatgtaaatgtactgaagcaatatttttagcacaaggaaaagaatttcaactaaatgtaaaaggctaataaatcaaactatttatgtttgattttaataaatattttgcatcttgtattgaggtgaaactgatataacataaaattaaccatcattaaacgaacagttcaatggcatttagtatattcacgatgacgtacaaccatcacctctatctagttccaaaacctgttcaccccagaaggaaaccttgtactcattaagcagttgttccccttacatttggctttatagttccaaatgcaattcctgagataggctgttcattatagattcagattgccagttacataagttaattatttgagtcaatatttcacatcttattaatgtacagcagatgctttctcaatatcagctctgcaccattacctacctactccagcttggtgaattatagataactcgctattaagatatttcacaggcagaaggaaaaggtttttaaagcatcattttcatgtttgtgtctaaagtgaaattctttaagcctgaaagctaatttctaaaaataaataacataaattaagtttatactttagaaatagctaacagacaatatactgtgactacattcattaacatataaaaatgtgaaaccacagttctttttctgacttttttaaatacaagagcttttacaaaactgtatttaaatactttagctacatagtaaaaaaaaattaagaaaattatttaaaacatttaaccccaaagaattctacaattaatattagacaaaatgatagaagagaattttattctaaatacacatgcaactaattgaatataatttctggttatctaaaatacacgagaaaaaaactgaaaacaaattattgttcagaatttcattaagttttttttttttaagtaatacatttttgagtgcttaagaacatatgtatagggagcgctaagctcagtatgaaatgaaattgcatgcttgctaaagggactcctgttttccaagaattcacatcaactacagacttccatgaaattgcacataagccacatactggctgttgtttacgagaaatgtttaccaaggtaactgtcatctggttgtccagaatagctgtactgacgaatgtcaacgtttgttgctcctgcgggaatctttacaacaacattataacctgcaatataattttacatatgttaaatttcacaaaaagcagatggcccagaggttattactgctgaatggatgaaaaattcgaatagcatagtcagacttaattttgttgtgtctttacaaaattacacagtggttattctttttgagtcagtaccttacacaaattactgaggattgagaaaaagtggttgttgtcaagaaacagagtttaagattcttaacttttcctaatcttttcctacttctaatattcttaatatagaatggaatgaagctagtattttagctcctgagacccttagtacacatacccatttttaagctttgttaatgcttttatattttatactgggaaaaaaatagaagatttcaaatacaattcacaagtccaggagatattaaaataattggtcattgctatgatatattcacacagactcagtaaacagcaaaataatgaaatttttcaatttcattattgaaaaatcataaaaaaagaaaaagtttaaagctcaagttttagtttgtagtataagcaggaatctcttcatctattccccaaattttacattatttttacaagaatactaataaacttgttatgagaaaagtaaaaagtttactcaagtgaaatgaatgtaatatttccattttatgaagccaaattcagcgacattggcactgctcaaaagaggaaacattttatctaacatatattaagaaaaaacattttcatgaaaactaaaaacactcacattacatagttgtccaaatacgcaggtttttaaatatacaattagttatactctaaggatattattctaagtttttccttttccttatttattaggatttcctcctagttaactgcaccatgagtaaaaagtaatttttctcatacactacctttgataaatatggaattaacttaagaagacagttcaaaaagagcttaaatttacaaccctaatgtcagactatcttgcatgtgttttagagcagacttatttatatctaaggcatcacatttttagtgtaagacgataagaaatagtttcatgattcggtatacactatatgcctactggttgtaggttattgacctacaagaataattttaattaacctccttttcactataaaatattcttacccactacttttactatttatatctttactatttattatatttttttcaagaaagcaagcctaaggcattgcaaaggtgacaagatgaaggctaccaccagggggcagaaatgtgacaaatgctaatcagaccttgcaaatgagtttaacgcattgttctatttgcaaactgattaatgcacagtacaattttcacaagattacatatttgatcttaatttggttcatgtggctttatcctggaaaaaatatttttcagtaaatacagactgtaataagtatgtgccatgcattatagaagggaatcaaatgtgtgtagctcccaagaaataactagaaaaatcatatatcaaatcatctagtaaccgagatttgtaaatatcagagtataaaatgtactatgtttttcacatacataaaaacataaatattaagttttaaattatactgttttaatggaagtaagtaacaatttgaacacacatgaacacaatttaaagctgaacagtcagactgtaaaaaataggctaggtgtggtggttcatgcttgtaatttcaggactttgggaggccgagatggaaggatcccttgaggctaggagtttgagaccaacctagcaatacattgagacccatctctacacacacacacacacacacacaaattagatgggcatggtggtgaacacctgtagttctaggtactggggatgaggaggtggaaagattgctggagctcaagagttcacagctgcaatgagctatgattgtgccactgtactacagcctgggcaacagagtagcaccctgtctctaaataaataaatgaataaataaggttgtaagaaataaatttaatttgcaaagaaagttttaaagatctgctttaattatcataaaaacaaaaaaaaattgcccagaaaacattacaatggaaaatactttacatagtctcatgatattttggagaaaaattaaattatggccaatatgtgatccagatactgcctggaaaatcaaatgtgacaataattctgaaacatttaattcagaaaatatataagataatggtttcacccttcaccttcaatcaacattttctatgtactattaataagaaatgtaacagataggtcaagtcataccaaaaaaagaaagtgattcaagtaatgaaaatatttgaaagcaagtttcctgggaaaaatcacaaatatatacattttaggttatagggaaaaaaccatttcattaatgggaggattattcacatatcacacatcacagtcaaatagcactgaatttactctaagaaatgcacctaatacatttttaagaatcagatttgcctggggcaggtgaattcattaatcaaggatacatctggtctaatacagtatttaatttttttatatttaggaaatttttccttaacaatcattttggactaagggtatagagtagacaaaacagtaacaaagaattactgttacaccttctttacagactccattattatactaaataaaagcgaaatctagaaacaaatacacaacttaccataatgagaactgttgaagacacctgttattgtcttgcatgaagagttgtccccaccacacactccacatttgtctatcttggcactggagtttaacacgtgatcacaaccagctgccttcaagacacaattacaatcaatattataagaatgactaattatgaagaaaagagagaagatccaaatacatacaatcagatatgacaaaggggatttaccactgaccccacagaaatatagataactctcagaggctactatgaacacctctatgcacatgaactagaaaacctagaagaaatggataaactcctggacacaaacaccctcccaagactgaaggtggaagaaagagaatccctggacagaccaataatgagctctgaaatggaatcagtaataagtaggctaccatccaaaaaaagcccaggatcacacgattcccagctgaattctactagatgtacaaataagagctggtaccattcctactgaaactatttaaaaaattgaggaggagggactcctccctaactccttctatgaggtcagcatcatcctgataccaaaacctggcagagacacgacaaaaaaaaaagaaaattttaggccaatatccttgatgaatactgatacaaaaatcctcaacaaaatacttgcaaaccaaatccagcagcaaatcaaaaagcttatccaccgcaatcaagtagacttcatccccggggtgcaaatttggttcaacatatgcaaatcaacaaatgcaattcatcacataaacagaacaaaatacaaaaatcacatgattatctcaatagatgcagaaaatgctttcaataaaattcaacactccttcatgttaagagctcttcataaactaggcattgaaggaacatacctcaaaataatcagagcgatctatgacaaacccacaacagctattatactgaatggggaaaagcaggaagaatttcccttgaaaactggcagaagacaaggatgccctctcaccactcctatttaacatagtactgaaagtcctggccagaacaatcaggaaaaagaaaaaaagaaagggcatccaaatagaaaaagaggaagtcaaacaatccctgctggctgatgacatgattatatatctagaaaactccatagtctcggcccaaaagctccttaacctgacaaacaacttcagcaaatttgcaagatacaaaatcaatgtacaaaacttactaccattcctacacaccaatattaacaaacttgagacccaaataaggaacacaatccccttcacaatggccaccaaacgaataagatacctaggaatacagccaaccagggaggtgaaagatctctacaatgagaattataaaacactgctcaaagcaatagagatgacacaaacaaatgaaaaatactctatgcttatggataggaagaatcaatatcattaaaatggccatatttcccaaagcaatgtacacatccaatgccatttctataaaactaccattaatattctttatagaactagagaaaactattttaaaattcacatggaaccaaaaaaagagcctgaatagccaaagaaatcctaaccaaaaagaacaaagctgaaggtgtcatgctacccaacttcaaactatactacagggctacagtaaccaaaacagcatggaactggtacaaaaacagacacacagaccaatggaacagaatagaaagaccagaaataagtccatacagctacaaccatctgatcttaaacaaagctgatcaaaacaagcaatggaaaaaggactccctattcaataaatggtgctgggataaatggctaaccatatgcagaagactgaaaccggaacccttccttacatcttataaaaaaatcaactcatgatggattaaagacttcaatgtaaaaccccaaactataaaaaccctggaagacaacctaggccataccattctggacacaagaactggcaaagatttcatgatgaagacaccgaaagcaattgcaacagcaaaaactggaaaatgagatctagctaaatttaagagcttctgaacagcaaaagaaattatcaacagagtaaatagacaatctacagaatgggggaaaatatctgcaaactatacatctgacaaaggtctattatccagcatctataaggaacttaaataaatttacaagaaaaaaaaacaatcccattaaaaagtgagcaaagaacatgaacaaacaccttttaagagaagacatacatgcagccaacaagcctacaaaaaaagcgcaatatcactgatcattagagaaatgcaaatcaaaaccaaaataagatagcatctcacaccagtcagaatgactattattaaaaagtcaaaaaataaaagatgctggaaagattgcagaaaagagaacggttatacaccgttggtgggagtgtaaattggttcaaccactgtggaaagcagtgtggcgattccctaaagagctaaaaactgaactaccattcaactcagcaatcccattactggatatatacccaaaggaatataagttgttctaccataaagacacatgcaggtgtatgttcattgcagcactatttacaatagcaaagacatgaaatgaacctaagtgtccattaatggtagactggataaagaaaatgtgatacatatacacaaaggaatactatgcagccatagaaaagaataaaatgacgtcttttacaggaacatggatggagctggaggtcatcatccttagcaaaccaacacaggaacagaaagccaaatattacacgttctcacttgtaagtgtgagctaaatgatgagaacatatgggcacaaagaggggaacaacacacactggggcctgctgagggtggagggtaggaggcgcgagaggatcagaaaaagtaactattggatactaggcttagtatctggatgatgaaataatctgtacaacaaaaccctgttacacgagtttacctgtataaaaaacttgcatatatacccctgaacctaaaataaaagttaaaaaaaaagaatgaccaactataagcatggtgctttaaagtttacaaagttcttttcacaaatatcctttcaattaacaggagattcagtacaacagaattgtttcaaaatatatactcatctagttgtatgtaacattttcacatattcatttaaaaagccaagtttattaaagggtcatccacagacctcctgcatcaacatcacatggggtggtatttaaaaagacagtatcccagatcttctgaattataatacttggaaataaaacctaggaatctgcattgtaacactgacattgattccaatacccactgtcatttgaaaaccactcttaaaagaaatgtaattcaaagagactaaagtatgagtatgtaagtaacacattagaatactccaaaaagatgacttccatggttattattttaactcatgaccttagaactctgcaaatagtcttagcttcaaataagtatttaaaagtaaagttttctctaaaactaatacccagcataacagtgcttatttttaaaaatgaatgaataaatgaatgaatatacaagtagatggcttgttccagaaatttcaaaaaaacaaatgcagctcctctccatgaagaagctgtcctctgcatacattgcaataactctttccattgtttggaatggccttctaaatttagtgatcagcaaagaaaatttcttaagcctagtgaatttttttatacacaaggcagatattttcaaaatcaaaatgttaagcatatattttctgaaagtagcatgcctctatatgttcagataatcttcatcataacttttgcattgtcatatgactttatgctgctaatttaaagcacaacttttttcaggccactgaataaccttttcagtatttaaactgtttccgacttaaattattttaattctctttgaacatctcattagctctttgggtgaacagcctttatcactgagataaggtaaaaggtatttgttcatggggagatgaagttggccctatagagctccactttaactgaaggaataagttcataacttatacttatatttttaattattttttatcttttattttcaaactgacagataacattgtatgtttttatcatgtacaacataatgttttgaagaatatcaatacattaaggaatggttaaatctagctaattaacaaatgcataacctcacatagttatcatttttgtggtgacagcacataacatccactaaaaatagaactaccatatgatccagcaacctcactacttccaaaggaaatgaatttagtatatcaaagagatatctacactcccatgtttatcacagctctattcacaatagccaaaatatgaaatcaaactaagtgtccatcagtggatgcatggatttaaacaatctggtttatatacaaaatggtatattattcagccataaagaagaggaaaccttgccatttgtgacaacatggatgaacctggaggacactgggttaaatgaaataagccagacaccaaaaatcaaatactatatgatcccattcatatgtggaatctaaaaaagttgatctcatagaagtacacttactatattctttagaccacattcactatcttagttctcaaactcgccatccattctcaagactgccattgcaatgtttgtgctttaactcagcatctcatctgctctgacctacaaccctgttaaatggaccacctgcctccaatcttctaaacccagtattttgaagattccaatatgcaaatcgaatcacatctctcccttgacttcaaatgcttctatgtgtttccaaggagttaagaaaaaaaaaaagtgcatttgacaaccatctgctagtccctaactccaactctgctcccatacttcctcatcttcctaaaacctactcatttcaatacttagcacaagtcttatgcgctccataaaaggttctctgaatcctttacccacctccccataaaataagaaactcctttcaatatctccatgctaccttgcagatgacccatagcagtgcattctaattgtttacatgcctatttcccccacaaatctgtgaccatcttggaagtggggttctctgctccagtcttttatcctggtgacttgaacagtatctgacatctagtagctactcaatcaatgtttgttgaatgtacataaaaaataagtgacagagagctggaaagaggaagggagaatatcaatggtttcaacggacaaggaaaacattactgtagaagcttacacttaaagtagcaaaatctccttacaatccttttatcttattattttctatctttttaggaagctgacctcattcctattttgattatgagtacaatagaccacagaaagtcatcaaatttatcttaatgctttgttgaggcattcttgatgacagagaattcccagtaaccaggctaaccatacttctatagatagcatgataacaaaggttgctttgttggaatgcataagaacatatgctgaaatagtaaaagtaatatttggttatataaatcgaaaaaaaacattattcttaaagtcactttaaatctaatagaaacttatagtttacttaccatacactggccttgaacacagatgtcatgagtttcagttccacaaggagtaccatcttcaaccatatccttcaataggtagaaataattggttccagcaacctgacaatagagtttacaacgatcctttgtgccaactgtaaaaaagaaaaaggtcaaatttttaatgtataataataaagctatgtgttcttacgtctcagaaaaatttacatcaaagaaccagcataatttacttactgccactgtatcttggaagccacctcacattagagggaatgccactgatgtccaaatgtttaccattaaaatcagagcactgcttctctcgaaagtcttgtgtgccttttggacatgaatcagtattacatgatcgaaatttcatcctgcggcccacacagtaatttcctccgtttcttggcctagtcaaattcattacattttaaagcacatcagtacaacattatttgtgccacttacttctaaaagttccattcttttccaggatctagaaaaccagtgaagtcccactaacactttttaacagaagtatgtaacatgagttttacgcaattctatgcataatgaaccacaaaaatatccaccttaacgtggacagtgagcctagagggcagaaacgataccttattcttgactaggttaactagcaagaaaccaacaatggaagttttttcttaaacttccaaaaaagggtttgctcactttctggaaagaagaaaagacatgtggtgagccaaagacaataacaaaggcaggtgccatgttaaataaaaaggaaatgtatacacatctgtcatgtatatcttatttatcactcaattcaaggagttttatggtatcaatctatatccatgttattttgacttatgctggaaaataaaattttttgcagaatttttggaatataaagacttctagtataatttatcctaaaatttaaatgagccaagattttattcagagtaagtcacatttctgcattaaaaatgcttattaataatactttaagtaaagagtatcatattgcttaccaacttatatatcatatatacaacaaaaacattaatttaaaatcttaatgcaatatctaagcccttttaaatagtttgatgagggggagatatgctttagtacttattcagctaaagacaatgatgcgtctataacacaagaagcagagaaaataaagtatcacatgtcacaatgcacaaaacggtaaaaaattggtaaccaaactatatatgttatccagaagatccgaaacataagtgaaagtagccaggatgtttcattaggcatacagtaaatgtgaaaatgacattatataactgtgattcatatttatatctcaaaatttatactaaattaaaaaacaaaaaaatgaagaaaatggatctcagttcagattataaaatttaatctatttatgtttttttttttaaatgtctgaatctaccaaaatataaatcaatgtgacttaaagtgctccagaaattttctgaatctcagaaacttacggactgacctccagttttagaagtgagtgaaactgatgtttactttctggtgccttgagataatcttaatttatagtgacataaaaaagacatactcaggacgattacagcgcctggttgcactttcgattccgcctccacatgttcttgaacaagaactgtaaggttcccatggtccccattcaccatttacaggacgtgtttccgtttctttgtttacacatagcccatgacggcaatgctataaaaataataagcacaaaaagaaatgatgtgtgtctctaattagaacatcacaaaaattataatagcagcataaagatcaacagaagaacaaactaaacaatttgaagctagctgttattaattcagattacatttgaaatgattttatgaatatttcctacctactaagatctgtggaatagaaaaggagtgtaatatttcttctggctttaagatttagagtgtcattggggaggaaggaaaaattaaatagtaaaatggaatatggcgggtattttttgaatagaagaaaccaaataccaggttaatatggtatatttccatccttccatttttttactcaaagtatctatacactcttccactcttataaaaagctttctactttattctatccgaagtctcaaatgacaaccttgttcctttactttcatcaggaaaatggaaacttacagaagaatctacccacagtctctcaccacctgttctacccattcaacagcatctgcactcacattcagccttgctacctgttagcacacatggaaaattcactatcccagacaaagtcaatccccctgcttgtgtacttaatccatcccttctcactacaccaaacatcactccagcaattctctcatctcttctatatcatcatttcagtgatagctaatcaaagtatgaccatgcactcatgccagtctatgaattagtttccagactgagagacaataacacaacttgagagtaagcattaagaaatttttgtaagatttttacagagaaattttatgtctaagtaaataatttaaaaattggcttatgtttatttttaattgtggcaaaacatgcataacataaaatttaccatcttagccatatttaagcatatagttcaatagtgttaggtatactcattgttgtgcaaccaatctccagaacttttccatcttgcaaaactgaagccctatacccattaaatgacaactcccattttgtcctccctgctacctcctggtaaccaccattctactttctgtttctatgaatttgactactccagatagttcatacaattggaatcatatagtactagtcttcatgtgactggcttatttcacttagcataatatgcccaagcttcatccatgtgtcagaattttcttattaaaaatgaataatattccattgtatgttgtcttagtccattttgtgctgctatataagaatacccaagattggataatttataaataacagaaattcatttcccacaggtctgagatctgggaaatctaaggtcaaggtaccggcaggtttggtgtctgatgaggcctttctcttcttccaagatagcaccttgcacactgcatcctctgtagggagagaatgctggatcctcacagagcacaatgcagaaggaccgagacagctcaatcctgaaggcccttttataaggcattaaacccaccggtgagggaagagccattatgccctagtcttatcaaacaggccccatctcccaatactgttacactggcaattaaatttcaatatgagtttgggagggggcaaacattcaaaccataacatacgcatttaccacactttatttatcctttcatccatcaatggacactgggttgctttcatctttttttttttttttgagatggagtctcgctccgtcacccaggctagagtgcagtggcgtgatcacagcttaccgcaacctccgcctcccacattcatgtgattatcctacctcagcctcctgagtagctgggactacaggcgcacgccaccacaacccgctaatttttgtatttttagtagagacagggtttcaccatgttggccaggatggtctcaaactcctgctttcacctttagatattgtgaaaaatgctgctatgagtatgagtgtacaaatatatctttgaaatcttgctttcaattctttgggtatatatccagaagtagaatagctggagaatatgataattcgattaataattttgtgaggaatggccacactgtttcccatagaaaaatatggcttatattttggatgtcttttttgcatttcattttcctagtcaataatttttattactttgtacaaaagtatcagtttataaataatcagaaattttaaaaaagaacaaagacaatattttactacagataatttgcaaagtggtttcctagattatcactacagataattcacaaagtagttgcctagattattctcattaacatacaaacacagctgttatttctctcactttaagaaaacaatagcaacaacaaaacctttcttagatctcactgcccttaccagctactgctctgcttctccttgaaagagtcggccatgtacattctttaactccctgtctattctctcataaccccgccccatgaggaatatatcctattcctccatgaatctgctcaaattgttagaaatgcaaaatgcttgttcctcggtgctgcaaagaaatagcactcgaacataaatttaagtttctcagcaaggcaatttttcctttctgcaaaaagggtgctcctcacagatggaacaatggcaagagcacacctggacagggcaggggcaggagttcttactcctgacacagatagaccctactgctgtgtcattccctactggctagggttggactgcatagtctaagctaattccgattggctcttttaaaaagagcaggagtacaagccagagtggcggggtgagtagtttggtgggaaggatgggtaggaacaggtaactaaagatgacttaggtcagagcaggtaaccaggggaacagatatgaattactgattaggaatggcaggaaagttgtttactgaaactagagacaaggaggcaaaaagaaccaggaagttaaactttaaaatggagaatcaaagaataagagagctgaacatactgacatactgattctttgaagagaaacctggggttcactatatttaacaatgtgtaggacaccaatagccagttcttattctctgtcttccttgacttatcagcaatgtgtgcacaattaatcatgcttcttctttgacataatttttttctcttcatttccagggctctacacacttggttttcttcctttcttcaaaactaattgttctcattttcttctgttgttttttctttttctttgtgacaacttagtgttggaatgtttctccaggctcacatctagtttttttattcttttctgttaacagtcacttctagtccagatctctctcttaaattatcttcttctctgtgacaacttaatgttggaatgtctctccaggctcatatcttggttttttaattctttactattaagagttacttctagtccagatctctctcctaaactccagactcatatatatgcctgcttacttatgactatttactagaatgtctaataaacatttcaagcatagcatatccaaaactgaattcctgccttcccaactcaaaacctacttttaccaagttgatctaagttgttcagccaaaagcctagtcatcatttctcttcttcctctttgaacactccacatctgatacattagctagaataaatgttctagttccttttaaaatatatcaaaaattgacctttcattatctcactactactactctggtttgagcactagcatcccttacttctatcactgaaatagctaagtagatgtctgtttccactcttgtccccgacagtttagccttaacacagttgccaggatgatctctttttaaactaagtcaaatcaggtatgaatccattcaaatctttcattattttactttgagtaaatatgcagttctcacaatggcctgtgtgaaccccaaaaatttatgacaggtctcagttaatttagaaagtttattttgccaaggttgagggcatgcccatgacatagcctcaggaagtcctgatgacatgtgccaaaggtggtgggggcacagcttgtttttatacattttagggagacatgagacatcagtcaatacataagaagtacattagttctctccagaaaggtggagacagctcaaagcaagcccctccccaccccccaatggggacttctaggtcacaggtaggtgacagacagatggttgcattcttttgagtttctgataagtatttccaaaggaggcaatcagaatatccatctatctctgtgagcaaagtgatgacttgaatagactaggaagcaggtttgtcctgagacgttcccaagttgaagggtcccaagatatttttctttcacacctgcaatgccctacgaaatcttccttcagttacttcttataagtctctttctctcttcacttcactccagctaaaatgtcctccttgctcttctttgaatactccaggcatactccagacttaggagctcagctgttccctttgttggaaactcatttaccccagatatcctcatagctaaccctctcatctcctttaagacagctaatttggtaacttcatataatgtctgtcctgaccatcatattttaaattgcaatctgccctctcctactataaaacttctaatcagcttcctgctctatttttctggtgtgtggcaccaatcagtttgatggtactattatattaattatttgtaatattctagtctccctctagaacttgagctacataagggcagagatcttgttgagagacaggactagctggattacctaggctgactaagaatccctaagcctagctgggaaggtaactgcatccacctttaaatacagggcttgcaacttagctcacacccaaccaatcaggtagtaaagagagctcactaaaatgctaattaggcaaaaacaggaggtaaagaaatagccaatcatctatcacctgagagcacagcaggagggacaatgatccggatataaacccagacattcgagcctgcaatggctaccctctttgggtcccctccctttgtatgggagctctgttttcactctattaaatcttgcagctgcactcttctggtccatgtttgttacagctggagctgagctttcacttgccgcctaccactgctgtttgctgccatcgcggacctgctgctgacttccatccctccggatccaacagggtgtctgctgtgctcctgatccagcgagatgcccattgccgctccccacagggctaaaggcttgccattgttcctgcatggctaagtgcctgggttcatcctaatcaggctgaacactagtcaccgggttccatggttctcttccatgacccatggcttctaacagagctataacactcacagcatggcccaagattccattcctcggaatctgtgaggccaagaaccccaggtcagagaaaacgaggcttgccgccatcttggaagtggcctgccaccattttggaagtggcctgccaccatcttgggagctctgggagcaaggaccccctggtaatattgtctgttttgttaactcatgtatcctacagcaacagaagaaaatgagaaatagtgtacctaaaatagtgcctgacataataggcccttgttaaatctttgctgattgaatgaaacctacagccaagcttatagcagtaaaaatgctttgtgctctccattagaaaaagtcattcaatataagaaagccatattagaagtgaaaaaaaaatcataatgtactatgtgcgtgtgcattttgttagcatcttgcacaaaaaatttaagtaatccttactctttttaaaaaataatttgatagactagagcatgaaaaagttataacgttatactattcaccatgtagtaaaattaactcattatcagaagggttcaccatggcttcacacaaattgatttactaccaaaagtgttcagcacacacactcattagatagtcacaagataaacagaataaagaagaatgttaaggcaaaattatagaatatttgtttcaaatgtcccttcaataaaaggtttatttaatactgaatacagctaaatatataggggttcactgtgttttattaatttaaaaaagataatttatacctattataatccacatgatgctaccccaaataccacctttgctttcaatctgcattggctctaaagtaaatcttagcatctcatcacatttaccttgaatctcaataaatccatgcctatcctaccatctcattgggaaaatattcaaatggctaataagcatatgaaaaaatgcataagattgataataatcatggaaatacaagttaaaaccacaatgagattccattttatacctagtagaatggccaaattttttttaaagactaacagtatcaaaagtcggcaagaaatacagagtaattggaactttactccattgctggggggagtctaaaatggtgcacatacttcagaaaactgtttggcactgtcttatgatgttaaacatacactcaccctataatccagcaattctacaccaagagaaacacaaacgtatgtctacaagaagacttgtacagggatgttcatggcagctttattcataataaccaaacacaagaaatgattcaaatatctattgacaggagaattgataaattatagtacatctgtatagctgaattatactgtggtataaaggaatgaactgctaatgcacacaataatatggatgaagcttaaaaatattatgttgaacaaaagacgcctgtcccattccactccttcaaaaaagatgacgctgtatagttctacttacaagaacaagaaaaaaacgaatctctggaaataaaaatcagaataggagttttctctggaaggaaggagagttgcctagataagaggcacaactaaattatatatatatatatatatatatatttttttttttttttttttttttgagacgaagtctcactcttgtcccctagtagtgcaaaggcgtgatctcggctcactgcaacctccgcctcccaggttcaagcgattatactgaatcagtctcctgagtagctgggattacaggcgcctgtcaccacgcctggctaatttttgtatttttagtagagatggggttttgccttgttggcccggctggtcttgaactcttgatctcaggtgatccgcctgcctcggtctcccaaagtgctgggattacaggcatgagtcaccgtgcccagccacaactgaactttttaaagtgatagaaatgttctcatttttattgggatgttggctgtatgtgcatccacatttgttaaaatccatcaaattgtatacctaagatctatgcattatactcatatataccttaatttcaaaaaatcatgtttatgccctaactggatttagaatattaataaattagctataaatagtatatctcttaatatttgtaaatatatcaatcacacttttgccacgagcaatcaatcctgaaggttcatggcatacagtaacttgaaaagttgctaaggaacagaggaaggtgccagtcctggattttaatcaggtgaacatcttggagcacatcttcaaatgtgcccatatcagcagcccagcattcatacttcaaaaagattttttttcctctgctgagcctcaggtagtcactctcacaaataccacctcttactcaaaaagctatttactaatactagtcacaggaaccgagaaaaaaataaagtcctttaaataactcttatccaccaaacagaaacattatataaagattgaattttaaaattcaaagccagctgaactgaaaaagcccactagaactttcgtcctaaaattacaaaaaggttattagtgtgttagatgatttcaatgagtacttcagctgctacaaaacttgaagttccaaataatatattagtaaccaattaatttgtgatgtgagcaatattcacaggaaacacacaccttttgatgcaagtgattcaagagaaaagcaatagctattataaatatttcaaggaagcaagaagtggtaaaggcaaagttcagctactgaactgaccttatttttaagcagtttatcttttttggctaatgtgaaggtaacaaagaggcacaattagccaatccattgccaaggaagtgttccttttacactgagggagctcagagatgctgacagactaaacacttaatgtagtcaacactggccactgaggccatcctggagcacaaagtacactctgacttcatcctctcacaagacacttttcattatcatggtgagcgttattcaacatcatgttgacagctttagataagttcatgactgttggaataataaagacctagcatggtaggtggttgattttagcggtataatgtatcttgatacacttagaaacaataaaggtctaaagaagccacttaaaactttcaattgtattaacggaattttaagggagaaaacgtatgaaatgaaaacatccctgaatttggagaatttgccaaaatattaggactgttatatctgtcctcaattttaataataatgttataatatacatagataactatatatccatgtaattatttatatgctaactatacaaaactttaatattcatctgccatagcttagaaatagggtaaaattaaagatttaattcattgacaatgtactatatcaaacaaacatggcaataacattaattcgactagctgaagaaaagttgacagcaaataacaaacagagtgctaaaatgcagagcaatcacatccttggataatatcttcatacaagactcacccttcaagaaaacctaccattccaggaccgcagtctgttccatctgctggtggcacgtgttgagtgaaacagcctttgtgaagcttttctgtgcttgtgcaccacagatgcatgcatatattctcctgagtaacaaaaggcaggcaagccagtgtaaagataacaccacaacactggttcaattcagtattacacattgatttataaattgatctgttacctagttccatggtataagctgaaactaatcagcaaatttttttactaagttctagtcattaattttcttctaaatacataaaattgtgacattttctttaaaactttttaaaaaaattttattcatacattgaataggagttatgaattggagtggaaattttcaaaattatttgagatagttttctctctttacaagatatctttctaaagaactttttattgttaaatattattcataagaatttgccaaaagccgcttttgatacaatagtggaatgtatgaataatctgcattgaaataatgtataatgtatactgaagtttcctattttgtgaatataatgcatactttcaacttttgaacaaagggctctgaaggtttcgaaagaaacaaaagtccacagagagtcatacgagctatacccaatataattcctttctttttctgaatttaaattcaaagtttatttagtgtctaaatcagattggaaagaaatgtatcttttacaatgatattttaaggtaaatcttccccatttcacagtaaatgtttaaaggcttattgaaatttaaggttttaggaagaatagtcgctatatgaaataagttttgcctgtcctacattctctaattaattaattctttcaacattcaataagcatttattttgtggcatatactgtgcaacaaatcctaaactggaccctaggaatagatatagatatttattttaatgactgaataagtctacattccggaattggtccaatgatcctcacaacctagtagggagggaagcaattaggcaaaaatatatagggaataaggaaaactgaatgagtactctacatggaaaagtaaagcatggattcaccaaagcagtgacatttattctaaactaaatcctaaatttacccccatataaaagaaaatcataattatagatctaataaaagtgttaggatcaactatttcaatgacaaaggtatctcatctatgaaaaatcctcaaaatattataaaataatagctcaatgaaaaactaaacaatatgccccaaatttaattcttttgaattcaaatatatgtaaaggaaaatgtactctattagttagattcctggtgcctttaaaacaattcagattcaacacacctatattttctccttaacctcaaaataatatcatttgaaaataaatatttcaatgattttattttcaaattatataacttccctattttctaaatgagaatacttcataggaatttgagagttaacaaagataatttttaagtacccaaaacagtacctgacacataataagtagtcaataagttttaattttccttttcttaacctctttttgataaatactaaattatcagacttaaaagctatatttagttcaagagaataaacacattttgaaatatattctaagataactttatggcagttttcgaacaaaataaaggaattttcttttcttactatatggggacacatttgtgacccaggaccaaacgcaagctcacactgcttgtttccatcatatcgtgatccaggaagttctgaaggcagattatatatttcttcatctggtttgtcaagaagacattccccgtaaccagtactgtaacagtgacagaaaataaaatattgtgaatacacatggatgcattccagtatgattctttatcacattttttgtagttctttactttcaaagagaatatcagtatttattcataactttaaaaaccaactcacatcaatatcagtatagcaatgttcgtacacataaggatgacctcacagtttacaaaggatctttaatatgcatgtttgcacttaatccccacaaccatcttgaaggtggcaattttaaaaaatgataagcaataaacacaaattcatcagaacattatttatgaaacatacatccatatcacacttttggtctactttgctatccaatagtaatgcctcaagtgtaatgactaactgttaaaatgttggaaaaataagttttaaaatcacttgagaaagtatatttctagtcctaaacaacaacaacaacaacaaagaagcttcaaaaagttttatgctgtctccacctcaagaggtctttcaaggtgggagtatagcagagtcaagatcactggctttgggagcttacattttggttcccatcaattcctaagatgcatggccatggaaaaattttttaatctccctctctccctgaaccacagtctcctcatctgtaaattgagagtggtaatatcttttaacatgctatcagaatacatgatatgtttgaatgacttaggaaaaacatgagaaatatacatattactcctaatttaccatgcaatgtccggtatgcagaaagctctgtggaaatatacagctattccaattgggctaagagcaacaatttgtcccactgcaataattaaaataaatcttttttgaaaaattttactggctaaaaggaaaaatataaattttccaattaaatgaacatgtaagcttaaaaatttcctttgaagaaaatcaaaatattactcccttctaaaaagaaaagtgcaccattggtatttttacatgtcacatcagtatttttaaccattgaacaaagctatatacaattctgtacagatcagcaagtattaagttgtgcttttaagtcaagctcctatagaagtatgtactatcactgttggttataatttgaggatatatttataaatatatgttccaaagcatgattttatttttccccataggtttcataaagagggaattagaaaataactgatgataattgatgatttagaatacatccatagaagaagtgaagtagtgttacatttatacaaaaagattattgggaaggagctcaggcttgccttttggaaaagtttcagtgactgagaaagaaacaccatttggataaaagaaattgggaagcagagaaacctgaaggaaggtggagaaatgaggcaagaaaaacctggatctactacctctctgcagagctagaaagagctcctgaaagaatatgtaaagttagagacttggcatctctgtggctttagagaactaacagaataattcgtagtttgactttagctattctctgtccttcaggggcacctcaaacttgagccactcaaatttctctcaaaatattacctagtcacttcgaaaaaattcaaaaacacataaggaaactggaattcccattaagtctcccatcaaacatagttttcatcacaagaaagaatccagaataaaaaaataatagctaggtctaaactacaataaaaatatttattttaaagagtgaaattatatacatgtatatatatatatatgtacacatgaacacaactcttcttgttcttaaacatccatttgtacagtgaaagtaaacataaatttaaacaagaaaaagctaaacagaaattgaaccacctttaaaaatatcaatttcaaatcttataatcgaatacatgttcaattatttaacataaatttacttactctaggaattcagtaacatatttccgactacagtttgaccagctccaaggactcatgtgaaaacttaaagcaggggccattacatgatactttgtaactttcatttctttacatctaggattatcatcatgttgaacaccaagtctaaaaataaaaataaacacttaaaaggaatatcaaaagatgcttacgatattagtaatagatcctttatagtcacattataatacaatataaaatatagataaatctggttatatcataatttgaactccatctatccataaggccttaacagtgttcatgtttagaagtacctgatgactgagaaatattataggctggtgatctggcatctgaatctacacaatcaaaatatttggactctgttgcacctcatcacaatatggaccacagcattgacataaaagtgcctgcaggttcaacatggatatcccatgttgtggatagagaagtgtgtggatagagattaggtaaaggtaataccacactaaattctagaccattgactatggctacaatatcacaagaacttcgtgaatccccaattctcaccattctacagtatccatctattttatatgaaagaccctaaatactattttaggtccatacttcctaagtgatgcccaacagaactagaataataaaaacattcctaaagggcagtcacatcttcatgacttaattattaagtaattagcaggttggcagcagatcctatacaatttggggggaactcaagtataagctcaagtttagaaggaacactgaaaccacttaattcagatccttgcctgctaaaatttgtatttaaacaatcttttaaattaaacaacttacccatatactagagacacctaaagagtttctcaggaagaaaacaaatatctaagatagtactctctgcaaaaatcgtcttctactggttagtagccttgaaaaccagcacatagtgccacccagatgttgccgcaatacttctactgtcctcagatattctgttcatcctatcccccgacttcataaacaacttacaaaataaagtgtgtagcttgttgatgattatgagatataaccatgcaaaaagggaactgaagagatgatcgtttactaaaaattatctccatttgaaattattattccccttgaatgttctaatgatttctcaaggcatgactaggaaattaaatgtggtcaaactaacagaggcaactctagactcaggtccttattagcagataacaaagaaacaccaggagttctgaggggtacatttagaatcttttttcagaggatacatttgtaggggtttctgattttccatgggagctccaagggtatcatgagaaatcacggcctctattcttacaacacagaaccccagcatatttttcagtaatacaggaaaaggtaagagaatcccaaatttttatgagcaactatggaaaaagtgaatactttaaaaaaaatcttttagtaactaagaaattcccatgggcaatatcctctgttggggcacattactgagagcaagaaatgagttggtattacaaatatttgggggagtcccccagaaccaggagcccatgcaggccctcccataaaatggtagaggacagtacctggtcatatataggataacaagagacagaggccagaagtgcttgtcatgtatccaatacagtaaaggaaataaaagaactcccaagttctagttctttgcttagtctgttgatctgtgcagcctgtctgacctaacatagatcacaaaagagccagagttagcatttcagggaagaaaattacactaataacattttatgaagaaacaaaggtactaattactcaactgaagatagaatttcaggcattctgtgcaaagataaatagaatgcacattaaggaggtgacagaaggtacttacgtgtgcccaagctcatgggctatagtaaaagcagaaatgagtcctttttcttcattaataaagcagctttgtaaaggatcacatatggtacctaaatatgataaacctgaaaaatttcacatttgtatttcatcaaaatggaaaacactaccaaaatcataaagaacttaattttgaagcatttaaccattgatgttattacttagaaaagaatgcagaattggctgttaatattgaataaacgttttaaaaggtgaaaaagagaatggaatgatttatttgcagttgaaatcatctttgcaaattttgggaatctactgaagtaaataatccaaaatgtagagtgagcaaacaactttttaaatatttttaaaaaatttttaaaaagaaaagaatatttgcaggaagtatgaagtgttttaacacattagcgtgggtagcaggaaagagattaaatgtgttgattggtaatagaaaagctaataagagaaaaaaatggcacagaactctacaaatctatgaagtttctttacttttttaaggtttaaagcagtatacaaatattcaattatcacatgacatgagtaaaaaataagtggtcagaataatgtctggcatttaatatatgttaaataaaataaaacgagtttataatataagaattactgccgtcactgaataattttgtaacatttccgcaataggaaatgtattgcaaatcaggatatatttagttctatgtaaagaataacatgcaactcaaatgtgctgttgaaagatgaaggtatgaactggctggacaccaaagacagcaataattatcatatatgcagtcctctaaaaataatataggataagaaactcaaaataaatattcattacaacaatccatacttcaccaccaatcatgttagtttttcatttacttattttttagcttaacataatcccatgattttgctattattacccttcaatttggttgtaaatttatctgctttcctagaactcttcctttcacaaaaaaaagattttttcatagataatcagtttcttactgtaaagcttttgcatttagaaatgtcttaatatagaataaacagacttcattagctcctagtttagctcttccctgctatgtcatcttttattcttaggagttaaaaacttgaacatcttcctagcatttaaggtagatgtcctaacaactagaatgtttttgttgtgctttaagagaaatggaagttaaactgaggaatccaaataagctggggaaaagccaaaagatgaagaagttcattagccaatactttttaataaaaaggaaagatttgctctctttctgaccacaccatcaaaaggtcttgcttcggcaaggtccctccagaaaacgagctttttccttacaaggaagactaaaatcaagcaaggaaaaaaattaaaaagaacaaaaaaattatttctctgtagagaaattatttcctctgtagagtgtgagggaattactggtttccttaagattctacaattcatgcttgcatgttcagttgtttagtggatcatcatcttattatatgtttctcttttgtcaggataagtttaagggaaacgcatttctttcatggacatcctacagtaggatttattagtattttcaatttgccaaattacacaattccaatattttcatttttagcactatgcagatatttggaacacattattgagtccattaccaaccaaactttatgtttcatgcttaaaggtatatacattttaaactgaacattttagtcacataagagatttgtaaaaatatgtatcaaatatgattagagaccaagctcaaatattcccgtaagcaggcaacacctacaaaactcaaagtaaatggttaatattatggaaacatgccgctggttgatggtttgtgtctagactcattcaagctaattctgggttctctaaaagtttaaagatagaataaggcagcatgggcccaagcttgatacaggttccctgtgtttggaaatacaagaagctgcatacagccacccaatctagccatcctgaagaatgaaaatcattctgcaacatattttgcaaaacatggtcagggactgaggcaacaataaacgtaaatggagatataacagaaaatctagtaattactaccaacattttgtgtttattattaagaactctccttagtttgttattttcacatatttcagatgagaaaataaaatactaacatttgcattaatataagctgtgtggtcttctgcaaattattcatcctcatctataaaattagaataagagttgttcagatatagtatctcataggaagcattcaaataccttaactatcggggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgggtgcacgcaccgtgcgagagccgaagcagggcgaggcattgcctcacctgggaagcgcaaggggtcagggagttccctttccgagtcaaagaaaggggtgacggacgcacctggaaaatcgggtcgctcccacccgaatattgcgcttttcagaccggcttaaaacacggcgcaccacgggactatatcccacacctggctcggagggtcctacgcccacggagtctcgctgtttgctagcacagcagtctgagatcaaactgcaaggcggcagcgaggctgggggaggggcgcccgccattgcccaggcttgcttaggtaaacaaaggagccaggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacaggcagactgcctcctcaagtgggtccctgacccctgacccccgagcagcctaactgggaggcaccccccagcaggggcacactgacacctcacatggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggcttcagaaaatcaaattactctgagctacgggaggacattcaaaccaaaggcagagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagtgatggaagatgaaatgaatgaaatgaagtgagaagggaagtttacagaaaaaagaatgaaaagaaatgagcaaagcctccaagaaatatgggactatgtgaaaagaccaaatctacgtctgattggtgtacctgaaagtgatgcggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgtgaagggcagccagagagaaaagtcgggttaccctcaaagggaagcccatcagactaacagcggatctctcggcagaaaccctacaagccagaagagagtgggggccaatattcaacattcttaaagaaaagaattttcaagccagaatttcatatccagccaaactaagcttcataagtgaaggagaaataaaatactttacaaacaagcaaatgctgagagattttgtcaccaccaagcctgccctaaaagagctcctgaaggaagcgctaaacatggaaaggaacaaccggtaccagccactgcaaaatcatgccaaaatgtaaagaccatcgagactaggaagaaactgcatcaactaatgagcaaaatcaccagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttcaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccaaacattaataatgggagactttaacaccccactgtcaacattagacaaatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggaagctggttttttgaaaggatcaacaaaattgatagaccgctagcaagactaataaagaaaaaaagagagcagaatcaaatagacacaataaaaaatgataaaggggatatcaccactgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctaccaaaggtacaaggaggaactggtaccattccttgtgaaactattccaatcaatagaaaaagagggaatcctccctaactcattttatgaggccagcatcattctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcaagtaggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttggaaactggcacaagacagggatgccctctctcaccactcctattcaacatagtgttggaagttctggccagggcaatcaggcaggagaaggaaataaagggtattcaattaggaaaagaggaagtcaaattgtccctgtgtgcagacaacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagagtcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcatcacactacctgacttcaaaccatactacaaggctacagtaaccaaaaccgcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaacttgctagccatatgtagaaagctaaaactggatcccttccttacaccttatacaaaaatcaatttaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaaataaactaaagagcttctgcacagcaaaagaaactaccatcagagtgaacaggcaacctacaacatgggagaaaattttcacaacctactcatctgacaaagggctaatatccagaatctacaatgaactcaaacaaatttacaagaaaaaaacaaacaaccccatcaaaaagtgggcaaaggaaatgaacagacacttctcaaaagaagacatttatgcagccaaaaaacacatgaaaaaatgctcatcatcactggtcatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtacatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaatcatcattctcagtaaactatcacaagaacaaaaaaccaaacaccgtatattctcactcataggtgggaattgaacaatgagatcagctggacacatgaaggggaataccacactctggggactgtggtggggtgggtggaggggggagggatagcattgggagatatacctaaggctagatgacgagttagtgggtgcagcacaccagcatggcacatgtatacatatgtaactaacctgcacaatgtgcacatgtaccctaaaacttaaagtataaaaaaaaaaaaaaaagtgtcagacatgatacaagatgatttaaataaaagacctctaaataaaaaaaaaaaaaaaacaattaccttaactatcattataatcattactcttgacttaagggataataatgctttcatcatcacattatacgtttctaaatgtcattataatttatgtacacaggagtggcagaaagctataaaaccataattggggactagaagaccaacaatttctataggaatagtccagaatgtctagcattcaagcactaaaaaaatagtaagaaatgacagatactcagtaaaagttcatactacttaagtttaaagatgggacaacagggtatagataatgcaagaaatatattcagtagattcttattaagtgatctcataaaatactcttaacaaacccagagaatagtttgtagggaggaagaaattcagtctgttgtaaaaattagagcaacaagtgcctatttctacaagtgtggaagactggcatttccaaagaaccccttaacataaagaaactagatatttaataaaaactaggttttaatgaaagcctagctcacatgactagtgaggactatcaagtccaaacctcagtgatttagcacacatatgcactctctctctcttctttgtctctttctttctctctctctctctcaatacacaagcatgcaggcatatgtacacacatatacacacattcatacttttcaaattctaggcggtaagcaatgaataataaggatagatgctattctgagggcaaatactgataaaagtaatatggtccaaagagtaagagcttgctagaggaagcttcaaggtgcatgtggatgttgagttttcttcattaagccagggactcaagttatgaacaccctttggactccaacaagaaataaaaatctctagaagaaagcacacactttttgagctagcaatttttcaaccccatggcttaatattaaataaatataagctcaaaatcaaagaccatcaaacaaacaaataaataagagaacatacgtaaaagaagaaataagatgtatggctatcatgtatttcagatatgtgaattttcagatacgtaatataaaattattccacataagatgtttaagaaaatgaaattcaattaaaaacatgcacaaatattttttaaatgtaaacaaaacgaacaggtagatttttaataagaactaagtagtatcttttacattgaaaaatatatatattttaaaatgtaaaatgtgaaggatgggtgaaataccagattagacatagctaaagagagagccaaatatactaatttatattagtaaaatggaaattagagctgcttgaatgaagcacgaagagaaaaaaaatgaaagcacagacagcagaatgagaagatctaatacagatgtagtagaatcccacggtgaaaacagataaaataataggataaaatttgaaagaaaaaaatgaaaattttccaaaattgctggaagataaacagtagatataggactcatgacatagcccaagcaggataaataaaaagaaacatacctatattaggatgaagttttaatgaaactgctttatattcaagacaaagagaggatcttataaaagacagatcaccaaaaaatctacaactaaacccactacagatttctcaatagcaaaaggcaggcacaacacaatcatatattcaagatattgagagaaaataactgtcaacctagaattggtaactagaaaaatatattttgaaaataagagtatttgcctgttaaatcaggaaaaaactgaaacctatgagttattttagtaaattactgaattagaaagagtgggttgtgagaatccctgactttgcagctaactcagacagatgtgtaggtaccctgggcacctcatacttgcaactggtgcctgaagtaaggacggttttataggactgagcgcttaaacctgcggagtctggcacaaactcagggtagttaagtatcagaaatgaactgaattgtagagtatttagtgtctggagagttgaagaactggttgttgatgtggaaagaacccatacatttattatgagtgacaacagctcagacacaccaactctattttttctttaaaaagcattatcagagataaagagagtcactacacagttgtaaaaggttctattcactaaactatgtatctaataagttagccttaagctagacgaggtaactaattgtaaaattatatgaagaaagtgatagagatatacttcatgtttcaattagtaatgtaattagtaaataaatagttgatttgaactacacaattagcaaatttgatttaatagacaaatacagaactcaaagaatatacattcttttaaagtatacatggagtattttcttaaattggctacataatagatcataaaggaaatatcaagattgcaaagaatatcaatagatcacattctctaactgcaataaaattaagttgtaagtcaataaataaaaataacaagtctccacacattcataaatatttaaatgcatttttatgtaattcatgaagcagcaaataaatcatgatggaatttaaatatgatttacatacatttagaatttttaatgacatggaaaataccaataaaaacttatgggacacaaaaaagtgataccttaaagtaaattgatagtctcaaataataaaattagaaaagaagaaatcctggacattaatcagttaagcaatcaacttacaaatagaacagcaggagtaaattgaaaaacaaagctacaagaaagacaacaaagagcagacattcatgaaataaaaataagacacaaaaagcaaatagttggttcattaaaaagacaaataaacaatatttcagtgaattgacctattaaaaaagagaggcacaaacaatatcagaaataaattgagacacaactagagtgagaaagcttaaaacaataagaaaatgctatgaaaatcatttaagctaataaatgttactagtaaaagaaatagtcaaatatctagaaagaataacttttcaaatatatttaagaagacataaataaaatctgatttccactggagaaactccataaatggttaaccttccgcaaagtaaatcttctagacttggggaaaaaataatacaccttaactcattttataaggtgaatgaaaccttataatcaaaattagaaaactacactaaaagagaggaaaattacaggccatcttcactcctgaaaatatatgcatgaaattagcaagtagaatctagcagtgtgtggggggtaaagaaggaagagtcttgttcaaggctggtttactgttagaaaaatctatgctgcaataaacatggaagtgcaactgtttcttcatcatactgatttcagttcctttcgatatatacccaggagtgggattgctatatcatatggtagttctattttcagctttttgagaaatcttcatactattttccataatggctgtagtaatttactttacagtatacaacataagtatacatcaatgcataagtagataaagaaaatgtggtatatatacataatggaacacaattcagcctttaaagaagaagaacattctgtcatttgcaacagcatggatgaatctgtaggacattacgctcagtgaaataagccaggcatagaaagacaaatatcacatgatctcatttacatggaatctaaaaaagtcgaactctgataagtagagagaagaatggtggtttccacatgctgagggagtgtgggcagatattagaggtagggaatggggaagttcttagtcaaagggtacatagtttcagttagacaggagaaatacgtttttgagatctattgcacaggagggtgactatagttataataatgtattataataactaagaaagtatgtttcagatgtctcaccaaaaaaaagaataagataataggtttgttaattagcttgatttaatcattccacattgcctacgtatatcaaaacactacattttacccccaaaaatgtatataattatgatttgtcaactaaaaataatattaattttaaaattctatggaattcaccagattaacccatttatacaggaggttgcacattttttgtgtgtgaaaaatcagaccttggtgatgaccttgagcagtaggatataaataacttccacaagcttagcgttccaataatggaacactaggcctaaatgggttaagatgaaataatcatatgatcatttcactatctgcagaaaaaacacttaagaaaataaaacatgtatcattttttaaaagactcagaaaacaaggataataaatttatctgctaagaacctacagcaaatatttttcttaatggtgcaaccttaaagtattccttttaaaatccagaaacgtctcttcatcattctataagagatttttatcttgcagtaagacaagaaaagagttataaggattaaagaagaggaaatatattgccataattcacaaatataattattcacataacaatcaaaaagaatctacaagtgaaactatgagaattaattaaagtgatgaatcaggtggctgcatttaaaaatcaacaagccaaataatctgttgcatttctatggaccggcatcataaaacatttactttaacaatagaaaataaaagtcatttttttgttttattttttttctccaagatggctaactggaggtatttttggcatgcctctcccacccggaaagacaaaatagcgtgtggaactcacactgtgaacttttttccaagaagcaacacaggaacttaaccgaaaaatggaaagaaaccacagaccctttgaaggaagcaatgggcaacagcctacatcatgaaccagacggaaaatggagcctcccaagggtgaattggggagagcctgccaccgtgacacacactcccactgggaagccaggaaatccaggccatggggagaaggcgttaaccctacccagtgctgcagctgatttagtgagcagcggggaatatatgagaaggaacggcatcagtgtgtactcccagtctccagcagggatggaagaaagccatttctgatccattctcacaacgaacctcgcaaaagttggccagctaattcaggcagtggtcacaggttgagagaagctcccaaatgaggtttgcaatataatctcaagtgggaacgaacctcgttggccagaccagaggagcgagcctgaagtgtgttgtcaccacgggggcaggagctggacacctttgcttcatgggcagacaggaaagggtgtggcgtgaaagtcactccatctccatagggaaggcttatagtctggggaagtttcgagttctgaaacaagctgcctgaaacccagttagctgctgttagcagatcactgtgggtgtaagacttgccttgcaagagtgtgggagctgagtggggcttactgccacctcccagtgtagattcttttgtgtagcagaggcagctgtgctcctccccggaacattactccagcagccagggagctgccttctgcttcccactggggctgctgcttgtgcctacatgtggagagccagagcacagacttgcctgacccatccccaacctagctttacccctccacctgccctggtagcataacacaaaagacaaggacacttgggagttccatggctccacccattgcctgagacatcagagtacctcccctgggtaacataaggcaagcacaaattccactgctaccaccataactgctgtacttttgaaagcaccatctcctggctggtgtgcaactgaacagccagttacaacatctgtaggtcagataacagattgtatcttcttcctggctcaggaaggagaaaacctttgcacaacctcagctgtcaccactgcctgcatcagcctggctaaccaggagatcttgagtctgtccatgagccagtatatcactactacagctgacatttgagaaagccaacacactaaggctacttataatgaaagaaatctcagagtctacgtcactcctcttccacctccatcagagctggtactggtacctgctactgggaaactagaggacaggtcacatctctggattccttgcagacattccccagcaccaacctggggtgtggcagcctcactgggcagctagacccaaagaagcagcaagattcacggtagcctggctctcagggactgctaattctagggggaaggggagtgttccatattaaggaagcaccctgtgggacaaaagaaaccagactggaggccatgagcccctgaattttccacctgtggggagtttcagcagaggcataggtacagtactgagctcaagagtcaggcagccctggtgctcatgaagggtcttagagaagggtacttctccccctcaccatctgtggacagccttactggagtacttcagggtgacaacatccccacaggaggaacaccctccaggtccaggcttgcacaagaggtagagtcacaacccctctctaaatggaacatcagcattcctaaaaatgaaatgaggtgtttgtctgatctgaataaccagaacattgggttgggaatgtgactgggtggtggatcgctttcctgctggcttggaaggagagtcacggtggctccttctcttccccttgaaaagtcctcagtgcagcttccccagcctgctctgtcaaggctgagatgtctgcccaacactggggtattgcatttactcacctgctttagccgcagccagtttttacccatgggtaccgcttactggcctgaagcatgaactattcaatccagtgaataaagtaattgggataaaacactttttaaagtgcacaccatggggcaacaagataagtgtcatgagacctcttccattccagccacacaggagacagtgaacccatagacccaccacatcactacgactaccagcatctgagaaacccattgcatgaagattttctataatcaaggaactcatactgagtccaccactgaaagcagccagaaccaaagctaggtgacaataaactataaacattaaaagcacatcctcaagggggaaaaatgaaattcttaaaaaaacccagttgaatcaaaaataaatacaaaaataattagaagacatagtctacccaaatgagaaggaaccagaaaaataattctggcaatattaaaaacagggttctgtgacatccccaaaagattatactaactctccagaagtgggtgtaagccaaaatgaaatctttgaaataccagataaagaatccaaaaggttgattattaagtaactcaaggagatacaatagagaggtgaaaaacaaataggatttttaaagaattcaggatataaattaaaaatgttctaaagagatattttaaataaaaaaacaatcagaacttctggaaatgaaagacacatttacgaaactagaaaatgcagtgcaaattttaacaatagactagaaggagtctaacaacagactagaagagataatttcagagctcaaagacaagactttcaaattaacccaatcagacaatttttttaaaaaagaatgaaaagaaatgaacaaagtctccaagaaatatgagattatgtaaaatggccaaacctaggaattataggtgttcctaagagagaagaaaaatcaaaaagtttgtaaaatctatttgagggaataactgaggaaaacttctctggccttgctagagatttagacattcagatacattcagacattcagaagctcaaagaactcctgagaaaatcattgcaaaaaggatatcaccaaggcttacagtcatcaggctatctaaagtcaacatgtaggaaagaacctcagggccagacggattcactactgaattcgatcagacattcaaacaagaattagtatcaattctactaaaactgttccaaaagatggaggagggaatcctccttaactaattttataaagccagtatttccctgataccagtcaagaaaggacgtagccaaaaaaaaaaaaaaaaagcaacaacaacaacaacaaaaccactactgaacaatatccctgatgaatataggtagaaaaatcctcaacaaaatactagcaaactgaagagtgcatcgaaaacataattcaccatgatcaaagaagtttaattctaagaatgcagggatggttcaacataaacaagtcaataaatgtgattcatcacataaacaattaaaaacaagaactatatgatcatatcaatagattcagaaaaagaacttgataaaatccaacatccctttatgataaaaatcctcaaactaggcatagaaagaacatatctcaaaataataaaagccatatatgacaaacccacagccactatcatattgaacagggaaaagctgaaagcattctccctgagaagtggaacaagacaaagatgcccactttcactacttctattcaacatattactagaagtcttagccagagcaatcaggcaagagaaagaaataaagggcatccaaattggaaaagtggaagtcaaactatctctgttcactgattatatgattgtatacctagaccatcttacagactcctccaaaagactcctagatctgataaatgaattcagtaaagtcttaggttcccaaatcaacatacacaaatcagtatcactgctatacaccaaaaacaatcaagcagagaatcaaatcaagaactcaatcccttttacaacagctgcaaaaaataaaataaaatacctaggaatacacttaaccaaggaggtggaaaatcgcaacaaggagaactataaaacactgctgaaagaaaacatagatgaataataaatgaaacaaacagaaatacatcccatgcttgtggactggaaaaatcaatatcattgaaaatgaccatattgccaaaaaatctacacattcaatgcatttctatcaaaatatcaatatcatttttcaaagaattataaaacaacaattataaaattcatatagaaccaaacaggaacccagtagctaaggcaatcctaagcaaaaagaataaacctggaagcaacacatacccaacttcaaactatactacaaggctatagtaaccaaaacggtatggtactggtataaaagcagacacatagatcaatggaacagaatagaagacccacaaataaagccaaatacttacaactaactgatttttgacaaagcatacaaaaatataaattggggaaagaataccctatttaataaatggtggtgggaaagttggatagccacatgtagaagaatgaaactgtatccctatatttcaccttatacaaaaatcaactcaagatggattaaatacttaaatctaagacttgaaaccataaaaattctagaagaaaacctaggaaaaactcttctggacattggcctaggcaaagaatttatgactaagaccccaaaagcaaatgcaacaaaaacaaaaataaataaatggaatctgattaaattcaaaagcttctgcacagcaaaagaaataatcatcagagtaaaaagacaatgcagagtgggagaaaatatttgcaaacgatgcatgtgacaaaggactaatatccagaatctacaagatactcaaacaaatcggcaagaaaacaaataatcccattaaaaagtgagcaaaggacatgaacagacatttctcaaaggagatgtacaattggccaacaaacatatgaaaaaatgctcatcattactaatcatcaggaaaatgcaaattaaaactacaatgagataccatcttaccacaaccagaaaggccattattataaagtcaaacaacaacagatattggcatagatgtggtaaaaaagaaatgcaagtacactgctgataacaatgtaagttagtataacctctgtggaaaatagtatgaagatttctcaaagaactaaaaatagatctaccatttgatccagtaatcccactactgggtatttacccaaaggaacagaagtcactatatcaaaaagacacctgcacacatatgctatctcagcacaattcacaactgcaaaaatacctaactatccatcaactgatgagtgggcaaagaaaatgtggtatgtatacaccatggattactactcagacacacacacaaaaacaatgaaataatgtcctttgtagcaatttggatggaactggaggcattactctaagtgaagttactcaagaatcaaaaaccaaatactgcatgttctcacttataagtgaaaactaagctatgggtatgcaaaggcatacagagtggcacaatggacactggaagctcggaagagggaagagtgggagggtgggaggggggtgaggagtgaaaaactacctattaggtacaatgtacactactcaagtgatgggtgcacgaaaatcttaagacttcaccactatataattaatccatgtaaccaaaaaccacttgtatccatgaaactattgaaataaaaaaattaataaattaaaaaattaaagtctagcaacagttgtacatgacacattgaaagaaaataatttattattgaatgacattttaaaagtcttacctaaacagacagataaatgttttgagaacttgacatgctgattctaaaacttccacagatgaacaaaagtccaaaaatagccaaaatattcttgaagaaaagaagctggtggtatataccccactgattaatatttattatagaactataaaaatgaaaatattatggaactgatgcatggataaatagcaaatatggtcccataaaatggtggcatgatgttgcagactcaagtgcataccgaaattttatatatgacatttcagattctaagaaaaagagaggaattattcaatgtatagtttggggaattgattattcaaataaaaaaggattatgaatgtaatttcacagtgaacttcaaagcagttgtttattttgagggttagaagaagagtttttttgtttttgtgttgttgtttttaaatcaggtacaactgattttttagagtggttcaatttggggagttgagcgagggaagaaaagatgttaaaaagtaatgtttagatgaaaacaaaaggtatggatgtggttatagagttcaggtttaacagggaaaatttttggctttttttaaacttatgtgttatatggttaaccatcgaggggtatgacaagttattccagcttttccaaatattaattatattggttttaagaagtctccataatcacaggtggcattttcccttcatctgtgggagtagatgatgcaacccacacagtgacttcgaacttctttgatagaatttccactgccttgttgaatttctcactgtatcgcatgtcttgccaagtgtgaaataatgagtttatgaaaacttcaaaactacacatcattttgcatgaataatacccattcgagctaaggagactgacatgttttgtagcatttccgggtaaatgaaaattttattggcattcaccatttactagctttgtacaatattataaaggtagaagcaaaacagcagcacattgtgcttggcttataaggattgctttagcaccattacgttaaataaacaatgtgcatagtgtattgtaagtgcctactcttgcaaatttacaatacttaaatatacttaacattctaatgtattaaaagtataaagaaaaaactaaacagacatttatagcaatactatgaaatctccaataattgttttgactgttgcctttggctctttagtgcaacttttctacattgtaattactatattgtgttgctttgtgtttcctatttgttatacataacttcagagttaagtaccagtacaccaagtactgcaattacctttcagttattgtacgtgcaatgtaacagcttacagttttggtgcttaataatattcctttttttctttaataaaggatatttatttgaattttttaaaggaataaaactaaatgtctacctaatatgatgtcaaaaaaaattaccccaatggattagagatttaaatgttaaaggacaaattttaaaatatttacaagaaaacaggataatatgtttagaccttgagttacacaatggtttcttaaagaagaaacaaaaaagctaactctaaaagaataggtttataaattcagctacattttatattttcacacataaaagaatgaaaacaaaccaacaaactgctaaaagatgtttgtaatatgtataaaccacaaaggatttggtgtcaggaagttatcaagaatacctgaaaagcagtaagaaagcaacaaataccacaccacaaatatgggcaatgtttctttcattgatttcattccttacagaaaaagaaatacaaatatatgaaaagatgcttgaattcattagcaatcagtgaaaagaaaattctaatggtaataaaatatattacatttagactaaaaaaaagaaatctgaagatacccagtatttataaagatataatcaaaaggaatgtttattgataaatgtaaaaattggtataacccctttagaaaataatttgttatatcttataaatgtgaatattagctcacttaatggcacaggcatcttaatcctagggatataccctagctcttccagtgaagttcatgacacaaaaaagtagaatcagcccaaatacacactaatatgatatagatatataaactgtagatgaaatatataacagtgaaaatgcatgaactttgactacagaattcaaaaataagcaaaagtgatttttgtttaggaacacatatatatgtaataaaagcaaatagtttttgtttaggaacatacatatgtaataaaactatttttcaagagacagaaggaattggtaaatacaaaattcatgctattggctacctcatggggaaaagtagagtgatggaaaatgactgagcatagaccaagcaatagtagtggcaaagttctaacctaaatctaatggtgaattcatggctattcattttattatttccctttaaattggcatataggtgattacgtattatttctcatgcacagcatttgatattgagtaatttgcaaataaatgttagttcttatcattttgtaaaatttacagcagcagaatgaaataagtgacaagtgtaataatttatcaagataattaatcaaaattactaaaatgtaaaataaatggaaaatagcctaaacattattgtaaataattcaataaacaattacataagctaaacttaattgacaaaataacttacctaacatgttacatttctctttagatgaacaaatgtcttcccttaaaataaaagatttattttgaagcatttttggaaaatatttttgcaacaagccaaaataaaaataaagaagctttaactatgacatgactactaccacaaactaacttctaaaatctagttcacattaacctctcaaaaagtctaaacctagagtaatgcaccatttgtccacatcaataagcaatacgtactataaaatcagtgttgtaaatagttgaatcattaaccaagttcaatgaaaaactttctattttaaatgtctctgcttttacttacacagtatatgtaatatagtttaccctcatgatgattcaatgtcatcatcagcttcagttatcattctctcatgcaaaataatggtgttctcagatgttacgaagttgataaattttttttgcttctgcattacttagtccatggccattcaatttgacagttctcgtgtctcctttcttatcacctctttctcatagccctttcttcctcccatatttaatctgctatctccaatctctcctgcttggcttttaactacaatccaaggaagaaccatggactatatataacataatactatgtataaaattaaatcaattctactttagttttgaaaagagattaaagtacagtcatgcactgcataacatgtttcagtcaacaatggactgcatatatgacatcggtcctataagattataataccatatttatactacaccttttctatgtttagataggtttagatacacaaatgtttaccattgtgttacaaatgtctgtagcattcagtacagtaacatactgtacaggtttgtagcctagggccagtaggctataccatattgccttggtgtgtagtagactacaccatccaggtttgcataagtacactctattatgtttgcataaagactaaatcgcctaatgatgcatttcttggaatgtgtccccgtcattaagcaacacataattgtacatgaactacatgttagctatattacattggctgaagtttttcatttcaggattctagaaagctgagatttcttttgagtttgatgcctaaataaaggatttctttggttagtcaaccaaatatcaaacctaggatttatatattctggtagtatcactgttgctgaaagaaaggtgtaaattaacaatgtatagcattgcttgtaaaatgaataataattttataacagcagaagctgtttttcatataaataagtaggtttgagaacaaccctagcaaaggtagcctggtaattaaggcaggcattaagcatcaaaacgaggaacagataaacagatttttaaaaggaaagggagtccaaaaagtggacaaacgaaagaagaacaaagttgctcttctttccaagcaactgaaataccaagaagggaatgaacaaaacctgctctcagttccataactatgttaatttcttaattctctcattctgtcactaatatcgtaaggaaattgtcttgtttagatcaaaccattactcagcaacctgacattgctaatttcctagagaactaactagtattctggtttgaaagaatagaagaatgcttttattcgatagtttcttttgtaatacaaattcttatagaacacttctgtgtattattaacaaagaattaagaagaagtggccgggcgcggtggctcacgcctgtaatcccaacactttgggaggccgaggtgggtggatcacgaggtcaggagatcgagaccatcctggctaacacggtgaaaccccgtctctactaaaaatacaaaaaattagccgggcgtggtggcgggcgcctgtagtcccagctacttgggaggctgaggcaggagaatggcgtgaacccaggaggcggagcttgcagtgagccgagatcgcgccactgcactccaccctgggcgacagagcgagactctgtctcaaaaaaaaaagaaaaagaaaaagaaaaacaaaaacaaaacaaaaaaaagaattaagaagaagtatcagtcatgcaggagggaagagtaaaggattgtatgggaagggttatttctataatcatacctagtgataagaacagcagtgtcatggtgggaagggtgaacatcatcaaggtcattctgagtttgttgccatgaacaaaagttctttaatgtggtagcaccatcaaaattaatgactggtccttcctatgcaaaataagcaatgcaatactatgtcaaaatattaacgtcctcttttccttccaagtttatcagcatctgcacaatttatcaaatagcattctcacaggtgaatgaaggagtgacagcatctcttcttcatatattaactataacgtattttagcaatatctaaaacattatgatcaaaactgaatctaattagatcttcttaatacaaccatccaatatttaggaaaaaaacttttaaaaacgactatattctaaatcctctgacattaggattataaaaatgaatactaaggttttcaatattttatttttgaattgtttattcacttttgttacttcctttactcagttaaacactgttgtcattctattttatttccatcacaacaaataagggtaatctcattccttctcaaatcaagtcttttaaaattttaaaaatatctcatttctaataagagttccataatctctacgtattgtcactaaaaacttactacaactaaggttactaattttagacctgtttcttacctcctcacggtgaatcataactaattttaccactactatgtgtatcaaatttccaatacttggatctttgtagattgttgcaacctgcatgtaaaaaaaatgtaggattagttgtttaaaatgaatatttcttctcaaaagtaagttgaaatagtcacagagtatcaattctctaattgcactgcacgtaggaatcttggaatctcttagagtgctttaacaaatcctcatgttcagaccacatcccttaccaaataaatcagaatctgcaggattgagactcaggcatcttaaagattctcaaaatttgagtatcttaaaccttgctactgagactgatccatggatcagcagcatccacataacctagagctgatatgaaacacagaatctcaggccccaccctggattaatgattcagagtctgcactttaacaagatgtcaagtgatctgaacacatgttagagtttggaactgctgttatggatgattcagcaagaaattcacttcattctgtggcataatccacaatttacatgactacaatattccataaaaatatgtaagttttacctattcttttctgatagttcacctaatctttcggccacagttgcatatttccaactccaaatatggttattatttttaaagtttagcatcaccagaatccatagaggcagatccatctagaatcatataaacagccctagaagaggtcatgagtcacaacctggtcctcaattttccaggattggagaatgttaggcactctgaatgggctctgcatgggctcatttatgattcatgatcaaagtgccatcccattcgctaattcatattctcttcttgtagccattatagaggttgccactgcagtaggggtgtcttccatggccaatgcctctgcctggtacttaattagaggcatatcccactctggatctgggctacctgtgcaatgaaatctgcttctaaaccctagatcaccttcttgttggccactgcctaagtcaaggcagcaattgctccagggtgtgctacttccctcagttgtttaataaagaaatgttcagtatctactcattgctttgttggctagagaagcagatatagataagaggacaaaggccctgaccttatgaagcttacagtttgttagaagtatcactaccggagccctcactctatcaaagctgcttcaccacaacatataacatgactgctaccaatgtctcttgtgccaaaaggactactaccagaactagagccaaaagcatctttagagctgctgacactgtagggtcagcatgagcataaatacataatccagcatctttactactgttatagctgtgcagcctcaaatatttacaggtttgtcatctgtacctatagtgatgactttggctctggtggtagcatgttttggcaagagtggaggtagccccagtggggttgacagtaagttaagactgggatggtcagctgattggtgatttcaagcaggtctgttagcaatgcagtatttctcactttaaaataggagctgtgaatttacagttgaatttatatattcattttacaggcaatgttttaaaatacatctaccatggagaaaaaaaaagcacacctgtaattatgattttggagttactttgatcctgtgagtttaaaagtggatgcttttctaagtcaaattacaaggtaaaagacaaacctcaaaggtatttataaaagctctttttcccctataaatgaaaaacagctgtgaagacttctgtgtctcagaataatatgcatatccagtggtccacagaaaaaagagcatatgcactatgaggtgtctacatggctaactactatatccattgtcccaagtattttgactatgaatgaaaatctggatgttataatatcagctataaaatatataatcacaaaaatatttccagtttcggaaggaaacagatgctgcacctttatttaaaagtgacaaatctgcaagctagaatttggaaaaaaattcccaatattctgatagtataattaaaatatattactacagcaaaatatccttgaatgtaacactaaggaaaagataatgcaaacaattgttatgcaaggtggatagtggctataaaacatagttatttaagggaaacagacacaggttccaattctaagagccatttgataaaacctacttctaggctactataaggattaaatgagatggtctgcaaatagtatttagattagagccaggatcatagggatcaatcacagtggctattgttcttattgctacttataaagctttttcagaagaaaaggcataatacagatatagatatacataatgctagttctagtacatgtgtttcaagttaattatcacagtatgtctaaattggaagcaaagtatccaaaagcatgattgctttattatctcttttagtacttactgaatatctattgcccatcaaaccctgtgttgcttactaaatatacagagccaaacaaggcataatctctgcccttaactcacagtcctctgggggtaaaagatacaaaaacagatggtttgatttaaataatttttacttcccccaaagaaagtgatattttgcttttacactaaaatagtatatttcattaaataattaaggatgtcatcatgctcattttttctaattgtatctcttattgttttactgacctttataatttaagtgctcatataggatatacgtatacctttaactatatttagatgtttaaaggtgatgttattgaacaactctattcaataaagctaaattgtgattcaagcaatgaatagccacaaggcccatttggtactcagagaatttttgaagcagtatgtacaatgcacttctctccttcctaaaactaccaccccaaattagattgccttgatgataggatactacgtttgctataaataataaatgagtaaatattaaatgatacataaaatatttattcaatgtttattgtgtgccagatgtgttcaagtttaaatgtattaattcatttaattatcacaacaaatcttatgagataggaactattatagtgtccattttacagataagaacagtaagatacagagaagttaactaagacactgaaagttaggcagctggtagcaaacagaacccaattttcattctgtacagtctggctttagagcactgactactttatctgatctttattcagcattctgaaccaattagttcttggtacaaaacatttgaagacatttcaaaaccctgctgcaacacatcccccggccactggtattgtcctgttatagtcacttgcccgtggcctcagagaagccctaggcagtcagcagacctggtctttagttccagctctaaacaagtagctacaagctagttgttcaaccctggaaaatgagttgattttttttgtcttaatgtctttaatatccatgttgaggcactgggtacccttgggtcacaatgtccttgcatattggattaatattaaccaggtgctgttgggaagagttgtgaaagacatttgttttaaagaacaaaatcattccacagtttgagaaatgagctaaaataattagatatcttcatggaatcttgaataggctaacacacatacacacacacacatacacatattaaatctatgagacagagatattatatacagcatttcatgcaactatatgaccgtagtccttagccccccgaccatggagcgtatcataggactaatattccattccatagactacactttaggaaacaccagaccagatttctaacgtatcatcctattctaaaagccttgtaatattttcaatatattaccttaatcactacattttagagtgctatgtattcgaatttttattgatctacttaaaatgtatttaatctttcattccttaaatgttagtttccttcacttaagtagttctgacttgtttataggtttcataaaatagtaaatattattctttcatggatatttaatgaaaggtgaagaagaaatggtatgaattgtattgttgaaatctttaagaaaattctaggcaaaatatacttcatacaaagcatgaaacaaattgctatcaccattaacttaccaaccattttgaaaataatttctagatagagctttagcaaacattcacatatggtatgttcataggccaccttcattaagaagtacaaagtcatctataaaaaactgattttgacaaacaaattttgtttacaaagatcattactctttacttctttggaaagatcttttcatttttaaattgaaaatgatgaaattctacatacatacaaagcgaatatgtgcaaataattaagaatatgcagagcactaaattgaagggaaaagtaatataaatggttatacctgaagtatgaaagcatatcattagtttttattttaatatagttaaaaatcttccccatcctaataacgtcagtaaaagcaactaacaagattgaaagtaatggtataaaatcaatgtaatgcaaatgagggtttttagttgatatatgcctctaataatagtaaccataatttaatgaaagggttaattcttgaggattacatgatgctccttaaacttacattattaaatctgcaacaggatgaatattatagagtcaaacccttacaaacacaatgaagtgtggaagtctttaatacttagtaaatatttaaggtctattaaataacaaattgagtatcaaaataaatatactgaagaaaaaactgctctagtttacatacatttttagtagcttaataatgcatatatatatgccattttaacctggtgttgtcacccaaattccctatgaataaaggttttagaataacagctgagtatctctgctcatttaacacaaacactatttcactagatatattagtgtgttcttctccactaattttaatgttaattccagaaacctttaagtaagaagggtctctagcctattctaacaacattaagtgcaactaaaaagtgaatcaagtcacattctttatttcaatatcactgcactcaggtatttcgttaaattgttgaaagcaaagaaaaagtttaagaagacagcacaattgtttacttcgtgcaggatgagtaaggatagataatccaagttgtgtatataatccatttgctcaatcctgaaagcattcccctatttccccctttatatttggagctcaacagacaaaaattattttttcatcactttgaacttgtctttatcatataccaagcctatgtcacattgtcttgaccttttcctaaattaccgtgacagaatatcaccaataatccatgtgtatgtttgaataaatgcagttagtgccttctaaaaactggaaaaagtatgcaaaacctgaacagctccttcctaaactagaaatatctgtggacacttatgtgcaaatagcatttctcttacccctttaaagcggtttttgaaatggtcttaacaagtaacaataaaacaagttggactggatttgatcgctacacagtgtgatcaacagtcccagtttgctcaggactgaagggtttccaaggacatgagactcaataccaaaactgatcaagttccaggtaaaacagggagagtttgtcaccctttctcttaagttccctttcacctttaatatttttgcaaccataaatatagttgtgatcactgttttttaaccaataaaacaacaatttatgtacagaaccatagggtctactaattttcctatgtcctcacttgaacattctttcagtgagagagaagaaaagcactaaacccaggtagcttagaagtcatctgaaattgggcttcttaggaagaaagaaagcatatacaaaaactcaaagtatctcaaaagggagacttaccctccttaatttttcctcctaccccacttatatttggaatgcacaccttttcctcaactttgctgcatctatctccctaagaacaaaagcttaacacaaaccagatgactgcgtctataaaaattctgtcttcaacagaaacctgctctctttctactaggcctaaaaatccagaaaatgataagcacatgcattggtctgttgtttcaagcaatctcagatgcagatttgctttccatgaagtcaaaaggtctgtctccattcccttcaattaactctggctttaaaccttccatggagaactttagttatctcaaagtatgtcacaatatcttctaacagtgatgatactgattttttttttttttttttttttagatggagtcttgctctgtcaccaggctgcagtgcagtggcacgatctcggctgggaaccgagattcccagtggcaacctctgattcccaggttcaagcaattctcctgcctcagcctcccgagtagctgggattataggcacacgccaccatgcccagctaatttttgtgttttcagtagagacagggtttcaccatgttggccaggatggtctctatctcttgacctcatgatccacccaccttggcctcccaaagtgctgggattacaggcgtgagccatggcgcctggccaatactgatttttatgtaaaatatagataacaaaacctttctgagggtggtgatgtcaccaagaatgcatgaaactattccaaaattggtcctgtgtttattcctttattccttctagtcagtatgcccaaagcactgacaatagttatctgtcatttaccatgttttaaaatctatcaaatctagtattttccttcagtatctctcccacccaactttctttccttattgcttttttttttttgagagagagtctcagtctgtcggccagactggagtgcagtggcatgatcgcggctcactgcaacctccatctcctgggctcaagcgattctccagcctcagcctcccaagtagctgggattacaggcatgtgccaccacgcctggctaatttttgtatttttagtagagacatggtttcactatgttggccagactggtctcgaactcctgacctcaggtaatctgcatgcctcggcctctcaaagtggtgcgattacaggcgtgagccactacgccgagccccaactttcttaatgaatgtcatctcctttaaccattttctattgcaaagtatatcccattgttccatataattgatacaatcttgtacatatcaactgacatcctccacaccatagttttcattagaatcccttcataatttagagtttgccataccaacatttagataattattcatctaggtaatatatgtaggtaattttacttcaaattcagaatttaaaaaaagtaattaggataaatttctatctatacttctgttgtcattttaaaaaattcaattgaagtaaacaaaataagggtaaattttacacaatttcaaaaaatcattttatatatttgtttttatttatcacaatgcactgaattctgaaaaaatattacttttattaatactttaaccatgtctccattcattctttcagtaactatttattgagtacccacactgtatcatatactgtgtttaggcaacgtagactatggtataacaataagaatttaaggtaaaatgtcatattttagaaaaatgattgtctcttatgatcttcatgtcacaatgaactgggatctagctaagggaaatttacaatatcctatagatatgcccttgctaagtcttttcaaccaagtgggcctgaattccctatatgtgaatagaagtacttccagcaatgagatatgttccaaatacactgaatctataaataggtggctatgtaattcttttttttttttttttttttgagtcatagtttcactcttgttgcgcaggctggagtgcaatggcacgatctcggctcactgcaacctctgcctcccgggttcaagcgattctcctgccacagcctcccgagtagctgggattataggcattcaccaccacgcctggctaattttttgtatttttagtagagatgatgtttcactatgttggctaggctggtcttgaacttccgacctcaggtgatcctcccgcctcagcctcccaaagtgctgggattacaagtgtgagctaccacacctggccagtaattcatcaactaaactagcatgaaaagggctacccttagtgattactctaaaataacaggcctaattcaggaatgtcccagggtggtggagggggatacgcgcgcgcgcgcgcgcgcgcacacacacacacacacacacatgtaaggatgaagcgtgatgccacttacacaggattgacacccttcactagctctagaattcagttctgtgggtactagcactaccactgcttgacaaagatagtaacatcagatcaaggacccttagagttatcgtgaccttatattccaaatttgttaggactgttgcattagtaataatctatccctttaacgccataaatacatgtataacttaaaatattaagcgtccaaatttctgatttggagaatatagccataataaaaatagtatcttctcccctctgtgcagaaatagggtaaggttttaaaattcagtttcaaagagcaaaaagatcaatgcaactaggatagtcctgtcactagagggcagaagccattcatgtgagaaagtaaagaataattcaagcattttctataagaggttttggggatttttaaatgttttagaaaggtgtccaagtaacagaataggatacttgctataactctatctaaactaaacttcaatgaaatcttatttttggcttaaacctagatacaaaattacatctaaagagtttggaaaaaaaatttaattcgacatgaaaaaatttcattaagctaaacattttaggaaatataaaagtcatattaagtttacttacaattgacattagagtcagtatatagttttgcaaattcgatccatgagcagaaaccactttagcatcagctgtaaccataatttcaatgtatcttggatatgatataagacgttttttcctggaatgtcttctttcatctttcaatggtacattttttgatgtgtgtcctaaaactctttctttcattacattaagatcttcattcatgttgctgtaggtatgaaagggtaaactggtttcctttatttgactttctagggagaaaaaaagaatataatgcagagccattaaattggatgtgacgaaaaatatcgcaaaaaatagaacagccaaaaatatttaatacttacatatctgttcccaacatgaaaataaaagaacaaagagaaattgttatttaaaatagtattgtacagcattatcatgaagattgctttttatagtaataaaaagtttgcaaaagttcacattttcttagattttaccaacaagaaattttatctaagtcatatttgaaaaggaaggtatgacgattcaaaagcatttattaactaccaagtagaaaataaaaatatccaggacttcttatgtttttctcagcatgtaaattaggttttcaagtcaacaatgacatttaatctcattacagagtagtaccattttgtagggtgaaacttcataaaatatagaaaaaaacaaactttctttatactacatgcgaaaagcaccaagaacaacagaaaattaagcaaaataacaatatgtgggtgaatctattgaatccagaaaggcaaatgttcctataaattttttagtacttgattatataaaatacctgatttattatgtttgcttatatataaatactgcatgaaaaataattgaacattaaagattattacagtgaagtaatatgcatttaagtcctacgcacttacagaaacttacacatttatgcctgtgcgtttaaatcttaattaattgccctaatggaaaaaaaaattcataggctgcacaggtgcttgtcctatttctctccccttcattttgttcctctcctttcctctttacttcttccttttttcttggctaatttttctgacaattgtttggtggtggtattttcaatagaaaagcggaccaaaggagtcaagtgagaagaaataaaggtcctggatagtttagaaaccaagtaatcaataccaaaataatcaataaccaagacatggctgtattataagaattagatataaatataaaaacatatttcattattattaaaataattcattttaagtacgaatgtaatcctatggctgtaagaaagaaacagaacactttagacattaagtttccacagatgaattttttttaattaatataaaaaattttattcgtcttattcttttttttctatttaatttttattttaggttcaggcgtacatgtgcaggtttgttctgcaggtaaactcgtgtcatgggagtttggtgcacagattatttcgttacccaggtactaagtatgttaccccatatttgtttttttctgatcctctccctcctcccaccatccaccctcaagtaggcccaggtgtcttttacttggtgtgtctatgtattcttgttatctagctcccacatacaagtgagaacatgcagtatttggttttctgttcctgcattagtttgctaaggataatggcctctagctccattcatgttgttgaaagaacatgatcttattctttttatgactacataatattccatagtatatatgtaccaccattttctttatctagtctgtcaccgatgggcatttaggttggttccatgtctttgttactttaaatagtgctgcagtgaacatacacatgcatgtgtctttatagaacaatttatattcctttgggtatatgcccaataatggggttgctgggatgaatgccaattctgtttttagttctttgaggaattgccacactgctttccacagtggctgagctaatttacactcccaccagcagtgtgtaaacattcccctttctccacaacctcatcagcatctattattttttttattttttagcaatagccattctgactgatgtgagatggtatctcatcatggttctgatgtgcatttctctaacgattagtgatgttgggcatttcttcatatgtttgttggctacctgtatgtcttcttttgaaaagtgtctatgaacttctttttctaattcctaaaaacatctagcttttaatattgttatgttcctaggttttaaaatttatctcagtggaaaattctggaaatttgacaaattgtgcagtcctaaaactttttcttgccattttctcctgaagtgacttggtcactaaaatatccatgaccaattactggaccctagaggagatcccagatatacctgatatatagaaatctcaatcaaggaaaagataaatatttatgctttgatttatttgttaatttaaaggaaatattgcatgtctaatccatatcaggaaacatttaggtattgaggagcaaatagcacctcataaagcttacactctagttgaaagaggcaaaaaataaattaacaacatagtaaagataaaatttcaggtatctttaggtgcttcaataccaattcaaccaagagacaaaaaaaaatatgattctacctaccagaatgactaaaattacaaagagcaataatacctactggtacaatcactttgaaaaccaatctggcaaattttaaattagacatgcatctaccctatgacattgcagttccacccctaggtatttatctaagagaaggaaaatatacattcacaagaaaactggtataagttcatagcaaaacaaatatatagactgatgaactgcaatagagaccccagatataaacccttgtgtatatgatcaaatgatttttgacaagagtgccaagaccactcaatatagaaagactaactcaaaatgagttacaaatctaaaagacccaagatattaaaactcctagaagaaaacatagagaaagtgtttcataacattggatttggcagtgatttattggatatggcatcaaaagcacaggcaacaaaagcaaaaatagacaaatgggactacatcaaacttaaaaaattattgttcaaaggacacaatcaacaaagcaaaaaagcagcctatggattaggagaaaatatttacaaactatatatctgataaggaattaatatctagaatataaaaaaattcctgcaactcaacaacaggaaaacaaacaacctgattaaaaatgagtaaagacttgcataaacactttcccaaatacattatacaaattatcaacacacatatgaaaagatgctcagcacaattaatcattaaagaaatgcaaatcaaaaccacaatatcacttcacacccataagaatggctactattaaacacacacaaaacagagagaaagagagaataacaaatgttgacaagtatgtggagaaattggaaaccttatgcactgttggtagtgttgtaaaatggtataaccactacggaaaacaatatggatgttccttaagaaataaaaatagaactaccatatgatccagcaatcctactggggtaaatatccaaaaacaatgaaagcagggtcttgaagagctatttgtacacccaggttcattgcagtattatttacaatagctaagaagtagaagcaacccaaatgtccattgacaaaggaatgaataaacaaaatgtagtatacacatacaatgaaatattattcagtatataaaaggaaagaaggcatgtgtggtggcatgcacctgtagttccagccactctggaggctgaggtgggaggatcacttgagcctccaagtttgaagctacagtgagctatgatataccactgcactccagcttgggtaagaatgagattccacctctaaaacaaacaaacaaaaacaacaacaacaacaacaacaaaggaaggacatgctgtgacatatgacaacatgaatgaaccttgaagttatcatgctaagtcaaataagccagtttttttttttaaatcctgtatgatattacttaaatgagatacttaaaatagtaaaattcactgaaacaaaaagtatactggtggttaccaggggatagagaaagggaaaatggggagttgtgaatgtatatagtctcagtttgcaagatgaaaaagtcctggagatctgttgcataacaatgtgaatatacttaacactactgaagtgcacacgtaaaaagggttaagatggcaaacctcatgttacctttttttttttttctttttgaggcagagtctcgcctcaggctggatggagtgcagtggcgcgatctcggctcactgcaacctccgcttctcggcttcaagcaattctcctgcctcggcctcctgagtagctgggataacaggcgtgcgccaccatgcccagctaatttttgtatttttagtagagataggatttcaccatgttggtcaggctggtctcgatatcgtgaccttgtgatctgcccgcctcagcctcccaaagtgttgggattacaggcgtgagccaccgtgcctggccacctttttttttttttttttaccacaattaaaaaatgtttcaaagaatgtttatagcacttttattcataatagtaaaacctaaaaacaacccaaatgtctgtccacaggagaaaactagaaaggacaagaactaagtttcacaaagggtagaacagtggttgtcaggagctggggagtgagggaaacgaggagaggctggtcagacatacaaacttctagttataagatgaataatgtctgggaattgaatgtacagcatagtgactataattaataatactgtcttatttaatggaaatttgctaagagaatagcttttatgtgttttcaccacacacatacaaattggtaactctgtgaggtgatgatgtgttaatttgattgtggtaatcattttgcatgtatacatatatcaatcatcatgatgtataccttgaatatatacagtttttatcaatgaattatacatcaataaagctggggtgggggaagtgataatgaacaaagcttcagcaagagatgctttccttgtccatacgtggcatcctattctgggaaaggctgactatgctagctgatgtagcagcactggatatgatttgcaatgtgggactacaagcggccctcatctaagaagagaaaagccttctccacactcctcaaaagaaagcatccctcttgtcaagtaatttaccacttgtctctagcagaagaacaaatcccatcttatcttctactgcctgttaatatcgcactgcctgcagaatctcccaaagtctgtctggcctaagtgctaagaaattatatatctcaatggctaacaataataagtaaaaaacaacacaattcaattaagaaagcactatggtttgaagaaatcaggctgacagagactaaactagaatagatggtttctgtgcaaactaaaataatgaaagactgccacattattcataatcctaaatgcccatcgatgacagaatggataaagaaaacgtggtatatatacaccatggaattctatgcagccataaaaaggaacgaggtatcttttggaggacatggatgaagctggaggccattatccttaacaatctaatgcaggaatggaaaaccaaatactgcatgttctcacttacaagtggaagctaaatgatgagaactcaagttcacaaagagtggaacaacagacactagggcctacttgagagtggagggtgagaggagggagaggagcagaaaaaaaataattattgggtactgggcttagtacctgggtgatgaaataatctgttcgacaaacccctgtgacacaggtttacctacataacaaactggcacatgtaccccaaacctaaaataaaagctaaaaaataaaataaaatgatgaaagaaacagtttctgtctgaaatgagaacactgaaggagatgataattagatcacagaaaaaaagtctgcaataaaaaagcataaatttttaaagaatattattatcattatcattgaaacatttaataacaccaaataagataggtgctattgttaatctcattttacagatgaggaatctacaacatacagagcttaagaaactcacacagttgctaagtaatggaggtagaaataaaaacaaataaaaggaacaaaactaaacagatcatttaccatgataaaactgaatgggttgaatttgtccaccaaaaaacagaaactttatagaaatgagttaatgaacaaaatctagccatatgttaactaatcagtagcatggctgggattcaaatcctggggacctggttcagagtgttttcttaattaaaatttttttattattaaaaaatattttgtaggtacatagcaggtatatatatttatggggtacatgagatattttgatagaggcatatagtacataataacatcagggtaaatggggtataaatcatctcaagcatttctcctttccttgtgttgcaaataatccaattatactcttttagttattttgaaatgtacaataaattattgctgactgtagtcaccttgttgtactagactttattcattctatctaactaggtattaagcccagcatgcattagctagttttcctgaagttctccctcccccaaccctgacaggccccagtgtgtgtttttcccctccctgtgtccatgtgttctcattgttcaactcccacttataaatattgagaacataagttgtttggttttctcttcctgagttagtttgctgaggataatggcttccaactgtacctatgttcctgcaaaggacatgatctcgttcctttttatggctgcatagtagtccatggtgtatatgtaccatattttctctttccagtctatcattgattggcatttgttgattccatgtctttgctattggaaatagtgccgcgatgaatatatgtgtgcatttatctttataatagaatgacacagggactctgcttgacaatgacgtttaaaaacaaaaggaaagagaaccaaaatttaacaacaaattttggttgttgttattgatattgttatcaatataaatattgataatgttatcaatacagatctcaggggtttaatttcatcagcaatggaatcaaccataagagaacattctatacaactctttggcaaagtaattgaacaatttagaagagatctataatttcttacttgaacacacaacagtgttaataaatgttgtcactgtaagtaaggaaagtgagaaaattaaatccaacatagtttttaaaatatagttaaaaactaaaataaaaatatatgtcatatatgggtataataacatcacgtaagaagaagaaagcaaggagatgacaaacatggaattaagaatgctggttgcttcaggtaaggggaggcaagtgaacaaaatgggtgacggaagtgaaattatgtggttgcatttgggttgttatccaggtcttatatattgtattgggtcatatattcatcaatatgtgttatattattaataagttcttagtaaatagtaatataccaaactgactgctataaaagcaatatgctggctctcatcactatcatataaaattgttttggtaatactagctaaagcaataagaaaataaaatgaaataaacagtatgaatattaggaagaaaattttttcattgttctgattttattttgtagatgaaagccttgcataactgaaaatcccaggagactaaataagaaaccaattaagacaataatcctcaatagagaagtagttgaataatgtaatgttaggcagttgttaaatgaatgaattaggtctataaattttgatatggaaggatgtccagaatgcatttttaagtaaaaatataaatggtgtgtgtagtttaatcccagttttgtaaaaacaaactcttccaaatatacaagtactcataaaatttgtataatgagcctaaaaggtatacaccccaaacatttaacagtaagtgagacagaagacagagacagtaaaactattacatgctttctttaacatctcggtgccctttaaattattacaatgagcttattttattactgtaattttaaatttaaattattatttttaaaaacagcatatattactattttcttggctaaatatctaatctcattactttttttttttgtatttatacctaagtggtgttacaaatgttgatacaattccttacctttccaaataccctacataaatggccactattcaaagcacattggccagttcaattacatcatttctatgtaatacatccctttctatttaggtcccattgagtcaaatgttaaaatactgtgttgtcttttattaataacaagcgtattaagacccaaaactaatttagaccaaaccaaaatacaaaatcacgcacaccatgcaacaatgataatctgcccactagagcataaaacacttgaaaattacaaacattgaatatctcttataacagcatggtgtattctagaatgcaaggaggatgttaaaataataataagaatataaactactagaaaattactgttaaataataatataattagaatcccataattctacttggatgtcctactggcacctcatatttaaacatgcaaagctgaattcatcattttcttctcccatacaaagtttatctttctattaatgtgagaaatagtctcccgatacctataactgatattcaaaactgaacattaccattgggctcctcctatccctccttcaccctttgtatctagtcaccaagtttggccatttctccttcaaaatgctccttgtattgcttctcctgcagagtccttgcctccaaactcattcaggtccttctcacctcagaacattattagaataatgaatacaaaattagacacggagtctcccaaatgttcccgctgtcttcaatctcttgtccctcccattcatccttcatttatgtccaaaaagattcatttttagaaacattccttttatctcatccctatttaggatgagatataatggatcctcactgcccataagataaaatctaagcctctccctactagcccacccctaaacacagtcaccaccaccaagctataaattccctaaagactgagaacactgttgggcaatatgttctgccttttataagtgctcagtaaatgttcgtggaaagaaagaaaaaggattaggttgaagaaaggcaggataatggaggagagagatagaaagaagaaaggtagtgagagagggaaatgaaagaaaagaatatattgaagagcaagacaaaagagtttatcaggccagatcttcagggtaggaacaataattgtgatgtacaataggaacaattcaaagacagatatgtgctctttgatttgcctaaaattaagtacaatgttaattctgatgtctgtacacaggctagaattgatataatgctctatatttgaccagataaggaaacacattttacacttcttcactaacatgcaacaatccattttttaaatgaggacataaaagtgaaataatacttgttctagacttaacatctcaaacaacttgctgaatgtgcaacagatcaaatacctgggtgacccttgagataaagtgtgaccatatcagatgtattgtgaaatctcacattttcttatgatttaaattgttttctggatctattatatgccctatgttgccacactattgagttttcttattaatactattatcaataacaataaagatataatactgagtgcttattacatatcaggtactcgtacacttcacatatgttatctcatttagcattaacaaaaaccctatgaggtaagtactattattatcgtcattttatatatgaggataatttttatatgatgataataataatcataattttatataagataatattttattatatataaggaaagtgaggaacaagaaggttaaactgcctattgtaatataactaataaaataaaataccctcattttatatatgaggataataattttatatttatatatgaggatattattattattatatctaagaaaagtgaggaacaggaaggttaaactgcctattgtaatataactaataaaatataaacctgaaatatatttattttaaaaattagtagtgtttcataacataaaagtgtatgaaaatctacagtcctctgtgatttctcaatattattagaaatttcaaccagtactttagaattatggcttgcagcttatcaaatattttatagtacttttttcaaagagtttcacgagttaataattggggccccaactactaataataaatttgcagaaggttatgaacttgccagtggccagctgaaacttgaaacaaatcattacaccatcagtcttccttgcatcccctgaatcacttactattattgtgtacattttaaaacatagagacatgtgacacagattaggtgaaatttcaacagccaccaactgaataaatggcatagcaaatatatgaattcagatttctcagtatcaattattacagctgaactccacatcacatgactcttctaaaggttgaatgtggtaatatatgaagactgttgagaatgtagtaaccagggtcatgttggtaaatgttgattcctagaagactaaaagactagctactcatgttcacaaaaatatgcattacagaggtcctccttgcattgtagaagcatagaactgagacaagatttggatataaaggcttttggctctacttagaataaaaacctgagacaaatctgatactgtcctttcatctagtgaacttgaaggaaaaaagaaggcactagaaacccccaaattacccccattaatcctacagatatcaaaacattctacctcctcccactatgtgtactaacaagacaatggagcacactggtcaagcgtcacagagtaaatattttttattcttccacattctcaagaaaccaacccataggacttgttctaaagtataagacacacttcccttaaaagctgcatggaagattcctgcatacattgggaactgaaaacaggcacatgttcattcacgaactcaaagccttttaagatttttttaatggaaaggaacatgcacacctgctgtctctttacagcttttggcatcttaacgtctacacttgaagagcattaaaacaaagggatctagaactagaaataccattttgacccagccattctattactgggtatatacccaaaggattataaaacatgctgctataaaaacacatgtacacgtatgtttattgcggcactattcacagtagcaaagacttggaaccaacccaaatgtccaacaatgatagactggattaagaaaatatggcacatatacaccatggaatactatgcagccataaaaaatgatgagttcgtgtcctttgtaggaacatgaatgaagctggaaaccatcattctcagcaaactattgcaaggacaaaaaaacaaacaccgcatgttctcactcataggtaggaattgaacaatgagaacacatagacacaggaaggggaacatcacacccccaggcctgttgcgggtgaggggaggggggagggatagcattaggagatatacctaatgttaaatgacgagttaatgggtgcagcacaccaacatggcacatgtatacatatgtaactaacctgcaggttgtgcacaggtaccctaaaacttaaagtataattttaaaaaaaagagagaataaactctaaaaaaaaaaaaaaaaaaaaaaaagtgagggatcatttgtgtagccctctgcattttctttcactatattgaccaggctggtcttgaaatcctgggctcaagcaatcttcccacctctgcctcccaaagctctgggattaaaggcatgagcccccatgcctggcctcaccttttgcattttaagaaatgcttttccggccaggcaggatggctcacgcctgtaatcccagcactttgggaggccgaggcaggcagatcatgaggtcagaagatcgagaccatcctggccaacatgggaaaccccatctatactaaaatttcaaaaatcagttgggtgtagtggcgcgtgcctgtaatcccagttactcgggaggctgaggcaggagaacagcttgaaccagggaggcagaggttgcagtgagccaagatctcgctactgcactctaggccggtgacagagtgagactctatctcaaaaaaaaaaaaaaaaaaaaaaaaaaaaaaaaaaaaaaagcattccacatcttcaaatgcaatttgccagaaattctaagtgaagaagtcggactaagatgaaccaatggatcctaatgtcagatttagatggattattatatgtatagcattgtgatattccaaactcttcctctattatttcttgaaaagatgtgcttttgaaaatcttatatcagtgaattaaatatatactctagcatttgaacatgtaaatgaaatgtatcattttgttctttaaagaaaaaccatgtgttcagaattcatgctgaatatcgatatctactgagtgactcttgcaaatgtgtgaggctgctgaaattagaacatggcataacgctattaaaattcacagtaatacatgattctactacattaatcttatcttcctattttcagatgagccttcatggcactccatttccaagccatgtccactgactatgatttaacagcagacaacaaataactcccttttgtttttcaaacttttatacaggttgtttctgagctagatcaaccacaatctctaactatctgctccatgtgcataaaatcattctagaaataccattgagataattttaagtactaagaattctaaaatactttccaaaatacaaaggtaattcaaagtaaccatttataatttttaacttctctatttactccatcaattcaagtattgatataatactattttcaacaccattttcaaataatttgatgaaatattagtatgagcttttccttttgttattaactctgtaatttatgatgaatatttgtttaaaaagtcataattcagatatctaagatgtaagctaagtttacactttaactcaattctaatgctactattgccaatttttttattaatctacatttactcctcctggctctgtaatttctgaaagagcttttgactgaaaacaacagcattctcatatgaaatgttcatctaaccttttatatttccttaaaagattttgtaaaataagaaatatttaagatattttccaaagtaaatctagtgttaaaaaacttagagatgtaattaaaagattgtcactaaatgaatattaaatgttagaaacaaaaattctatgtgatatattaatagtacttaatatgttgattatggaatcagttttattcacatggcttttgtcagctgttactaagttcactatttttagatgttgacaaaagtaggaaaaaatcaaactttaaaattgtttatagatagaacacttattttcaaacaggtattttattttatgctacatcccagaatttaataattcaccatttttcaaatgaatgtttagtcgatcttatttaacaccaagaaaaatctagtatctggatacaactgaatacatgcaaaagaaattgcagactgacaggtcagagtgggtagggagcatctcccccaccccaccgccccaccgccttcagttttctggctctcattcaagggagaaaacattagtcctgaggtccagtagtctgagatgctcgccacatgaaacactatatttgtttcctgtcctggtgatggctccaactcactccaacatatgacctttacaaattactgaacacatgctagggccagccaaaaccatgaaccatcctccttttgcagttttcccttgcatttgtactctgtgaatgcagcccagtcagacgtgtcaatgtctttaaaaatagggctgcttctgaatggtgcaattctgaatcagattctaattgcaaataattagaattactgcttccttttcataagcaaagcatcatgtggctaagcagctctctactagagccaaagattcaaattgacttcactaagcatttacaattaagtggttggtagaccaaaggaaaactataaaaggagctacagggctgattagtgatctactattttagatagaaaaagttgtatatcttgctctctacaaatctatttgttttcacttatcttctttacctggtgagtaaatctaaatgagtatcaactgtataaaacaaaaatgatgtccttacagagcttatatcgtatggtccattattttaatcattcccttcaataggccctcatcatccttgctcttcttctatccaacacaagaaaattacaaactatgcacgttgtgcacatgtaccctaaaatttaaagtataattaaaaaaaagaaaattacaaactaaattttttactcttgaacatagatgcaaaaattctaaagataacattatcaaaccaagactggcaaaaatataaggtagacatgacatttgagaatcaatcacattcatcacattaacttaataaaaggaaatatgtatatttatatatctatataatcatcttggtacatgcagggaaaaagctggataaaattcaacatccattcataataaagattcttagtaaactagaaatttaggagaatttccttaatcagataaagggtacctaagaaaaaccgacaacaaacattatatgtattagaaaaggttgaaagctttcattctaaaacttgaaatgaggcaaggatttttgttattgctatttctaaggacagttctagaaaaactagccaacgtaacaaaacaagaaaaataaataaaatattgaaagattggaaaggaagaaataaactgtctacatgattaccaaggtaccgaatccaaaagaatcaacaaataaaccactagaggacataaatttagcaaggttgctgaatatagggccaatattttaaaatgcttgcatttttatatagaataaacaaaacagttagaaaataaaatttttaaatgatatcatttacaatactgtcaaaagaaaacccaccaaatgcccaagaagaaaactaacgaaagatgtgaagacctccacaaagaaatctattaaatattatttggtaaattaaagaataaattgacgatataacgtattcatgggttagaaaacacaatattataaagatgtgatttcaccaccacactgatctgttgactcaatgaagtacaatagatatctctttttttcttttgggaaacaagatgattctaaactctgtatgtaaaatttaaagggtcaagaatggctaagaaaatcttgaagaagaatgaagtcaaaggcttcctccaacatatcaagacttataacagagctataatatctctaaaacagtatgacattggcacaaatagaccaatggaagagaaatcaatgtccaaaacagatctacaatatagatacttcttgaataaatgttatatatgctaagtttttaaaattcctttgaaatatctcaattatcttttacaagataaggttttactaacattgctattgataattttatttttcactgtttttgggttttcataaaggaataagtcaaagtttcaaattattgataaatcaagttcttattttcaaaaaggcatttaatttcgttttacttaatgctatatcccaaagttcaatatatcaccttttttcttaatgaagattttcaccacaataggattagtctccaacaaggaagaactaaagacaattcatctaactcttaactctcctttatgatacctaagttttataagttttacttatgcaaatattctcaagcacattccaattagcttgttaaggtcaccaatcacctactttgcaaaatccagtaatcaattctaaatcttcaagtgctttgaattcttgataccatttagccaactaatcagtcctaccttcttgtaaatctttcctcaagtggtttttgggcaaacattcctcagtcttcttagaatgtccttgacctctacctttcaatcttcctagttgatttctcctcatctccccaactgccaagtattggcatgccccatagttcagtctttggatttttattttttctgtctctctatctagtctattccccagacaatctcattcagccttatatctttaaaaatcattggtattctgattcctaaattcttatctcaagcctaaacccctctactgatgttccagttcacttactctattgcctacttctctccctttggatttctaacaggcacctcaaactcaaaatgcctaaaacctagttgttaatattccctcctgaacttgtatttcccacagacttcctcatcttagtaaacgagaactccatccttccactggctcaggaaaaaaaaaaaaaaaaaaagaataatctgacaactctcttactctcagccctcacctacaacttacctgtcagcttgaccatcaaaataaacgcaatacctggacacctctcgctttcttcatagttaccaccctgattcagcacctcaccacttcttaacacaattattgcagtatactgcagtacctcctaattgattttcttgcttttgcttgttcccctagtttttttcccacataatctgagtgatctctttaaaatgtggactgattatgtcattactatgctccatatctgacagtagcttccactgttagagtttagccagattcagtactgtgacttaaaatgtcctaaatgtagaggtggattcaccatgaacctaaaaaaagcttaaacttttggtctctaaaaattatgtattcataattttctattaaagagcactgcaactgtttaatcttcaggattccacaacctggagccacccataactacatgatctggcctcccactaccattatttctactaatttcttgctgatttcctacaaccctctttcctccctcactgcacttgtacaggatagtcctgcaacagtgaggaaggtattcagtaaatattttatgaataaatgaacaaataaaaaaaaacccatgctggggcaaggttgacacctcatcttgcagagttcttatgtggaacaagaacaggagtctcctcttagcaatcaacttttttcttcacttattcaatgtccaactccactctcatattctaacgtggagcatgaaaaacttgtatgcatcttaccactgcactcttctggctttccttctcatttcttctcccggcacacctaccccatggtaagaaacttttcatttattcactctatgctatattttctcttttcagctgaatgctacacattgattccttcagagttagtactcaatatacaaaagagagagataacgaattcagaaatttatcttatttgctgttgtacaatcagattttgaaagttacaaccttaatatcaccttggtctttctacctgcagcctctccacctcccaaataaaaaatctgaagagtggtcatcaaataatcccaatttgctagaatatacacaaaattattaaatgccatggcaaaaaagaaatgatttaacaaaaaactgggcagttttgcactatttctagttcttgttcttttaccacagcctgtattatatttgctaatacctcagttaaaatttttttaaatgtgaaaaaataaattaggcacaaaaaaggcttcttttggaggatgtaggtgaagagagaggtaaaagagagagaatggcttcaggcttaactgtactgaatctaagatatcactggtacatccaagaaaacatgcacatcaggcagtttatagacctgagttttaatctaaaaacaagcgcttaagttaaagttttaacatcatgtatcatttaaatttgtagttaaaattaagaaagtagaaaaaaatacataatctaaattaaaacatagtctaaaatggtggtccaggaagagcactttaaaaaatgcttaacttaggagatgggaaaccagtaacaaccaagaagggaagtgggaggaaagaaagaaagaaaagaagcaaagttaaaagcaaagtgtgccagttaagccaaagacataagaaaattcagttaggataagctgatggatagtgtgacatgttcctcaaaactgtaacagtaagaccaagaaagattaatgcttttagcaagtagaaggtcataagtgatctttgaaagagtagttccagtaaacatgttggaaaggagaatatctctatagtcatctctacatagatttagaagcttaagctgactctttaaaacaccattaacaagttatagtacacaataatgggcatggtcgtggccatatttataatcctctgtccctacattaattaatggcaccttcttctctgctcacacatttataaaatgttataaatagtaggggcttcagaaatcaagtaagagattgcaaatgaaattcagctctcatgtttctttttgtttttttccactttaaaaaaagaatctagattttcatcttcttcgtaaagtacaaaagatctggtaatactggtctcacattcccaaagcatcttttgcaagaagcatgtatattccagtggccaatggacagctcagttccttcatgatacctcaccttactcctttctggtaaatgcctgatccctttagctgtaaggttaaaaagttaataagttaaaaactcgtaagcttgccaattagttgaataggaaactgattaaattcattagctattcattatctacttttggtaagacctagagaagtttaggtctcaaagccagttagcagcgcagccagaactcgcttactgagcaaactctggcctctgctgaaactaaaaaccctggacttcctccagaccaatgctgattaaattattacatttaaaggaatgggaaataatctgtacataattttatttaaaaggcagttctcatgtattcgcaaaaatattttccaaatagattactcacaaaaaaaatataaacgtctcttcaaagttgagaaaaatgttttcaggaaattctcttcaatttacttctttatgtgcacttttccttgtttgacacttaaatcctttgttgataagatggcttttttctttaattcagtctccccaccttcggcctcttatcattcaaagccaaaattacatatttttttagaagctgccacagcaactaatacaaatattttttaaagcaaattatataatatctgttttaaaacatttttgataatatctctgctttaaatttttttttgtttccccaatgcctatggggtaagcaacaaaatccttaaagttctttcataactggtctctgtgcgccttgcctgcctccccagactacacacacacccgcaccttactctcctgatatagtaaatgggttactcttttccacacacatcaggacttagaagatacaaatgtcacattccctcttggctggagagccctgttctaaccaatctttatacgttctgtaacattaggtactcaaagactataagaataaataaatttagaaaatttctaggaaaaacagagaaatttaaagctggctgacatcatcttaatacccagctgtattagttcgttctcacgctgctatgaagaaatacctgaggctgggtaatttataaaggaaagaggtttaattgactcagtgcaccatggctggggaggcctcaggaaacttacaatcatggcagaaggtgaagtgaggaagcaaggcacgttaatcacaaggcggcaggaaggagaagtgcaaacaggaaatgccagacacttagaaaaccatcagttctcatgagacccactcattatcatgagaacagcataagggaagccacttccatgatccaattacccccacctggtcccacccttgacacatagggattatggggattacagtccaaggtgagatttgggtggggacacagagccaaagcatgtcaccatctaaagacatttcattttcacttccatccagtcatctgtttattgctctacaaatcctttgcatcctaacccatgacactgagatgagagggacagagtgggtgacagaggaagtggagcgaaactaatgaggtctcctgaggaacacagactggttgtgatctgcccttagagacaagccatagcagaactacacttcacagaattcagaggctttgtttcattcctgtgaatctttttagggtccttcctcacttgggtttctttattttgtatagttttgtttgatggtggtgtttgtgggggtttttgttggtgtttgttcatctcatgggtttttaattgcttgctttaccatttccacaggattttatttagaatatatctgatatctatttgagagcctgacatccacagtggctaggtttaccaaacgtaagttggatgaccttgaggcacacagtgaactttgaccttggaaacaatttaattcaaggctgaaaccaccatgaattgtaatattttagggtcataatgaattaaaactatcaacagaaatactgtatcagaaaaagatatcacttttccttttccatttaatcacttcatcttatgtgctaaatctgtaggcccacctatttaaaggattctctggggaacctcctgaaggttcatccattagaatatataagacctttggtccccaaaatgtgcaagggggagagactgcctccaggaaatacacccccaccaggaaacctgggaatccaggtcacagggcaaggccttaaccatatccagagctggaactgatttaaggaaaggaatataaaagtaggagagggagtggtaagagtcttgcatgcattcccagtctccgtgcagaacggcggaagccattccttattttgtctcacaggggacctcatggaagttctgccaattaactcaggtagtggtcataagttgaaaaaagctcccaaatgaattttgtgatataacctcaagtggggaagaactcccttggccagaaccaggtgggggtggggggcaagtggaaagagtgcaggagttgggtaccccagctgtgcaggcaacctgggagggatgtggcttgaaagctgctgttgggttctgagcttagatggcctaaaatttagcttgctgctgctagcagaaaaattgtgactttgagatctaccttgccaagtgcacaggagctgggtggggcttactgctgcctgttactccctactccctgggtgaatacttctgtgcagtagaggaagctatgctctcctctagaacatgagaccatctccccagtgaccagagacctaccccttgacccccagaggggttgttccttgccgcacactcagagagtcagagcaaggacttgcctgacccagcccccagctggctttgtccatgccccagcacccccctcccccaaccaccctggtagcttaacacaaaggacagacactttgggggagctttatggccccatacatcacccaagaaaccagagtacctcccctgggtaacataaggcaagcacaaatcccaccactgctactgtagctggtgctcttcttcaagcaccacctcctggctagaggccaattgacacagtccattacggcatctccaagtaaacattgtgcccaggaaggagttaacttacacatgactgcagcaatcacaatattctgcattaccttggctaatcaggaggtcctgagcctgtccaaacttgttcaaacactgagcacattgctacaaccagcatctgagaaagctatcgctctctataatcaaggaactcatacagtcttcacccctgaaagcaacgagagcctaattacactacagtaaactgtaaacattaaagtcacacccttaagatggaaaaaaagaaattaaaaaacacaaatcaaaaataaattcaagaataattagaagaaatattctacccaaatgagaaggaaccagaaaaataattctggtaatatgacaaaacaaggctctataaaacatgcaaaagaacacactaacggtccagcaatggatccagatcaagatgaaatctttgaaatgccagataaagaattcaaaatgttaactatttagttactcaagaagaagaaaggtgaaaagtaaaaactaacataaagaaatttaaaaaacaattcagagcatgaatggaaaaaattttaaagagatagatatcaaagaaaaatcaatcagaacttctagaaatgaaagatatacttagggaaatacaaaatgcagtggaaactttcaacagcagactagaacaattacaatgaagcatttcagagctcagagacaaggctttcaaattaatctaatcagacaaaaatgaagcaaaaaataattaagagaaatgaacacagcttctaagattatgtaaaacaatccaagtctgggattaggtaaaatagccaaacctaagaataaatggtgtttatgagtgggaagagaaagcaaaaacttttgaaattttgtttaagaaaataattgaggaaaacttcccaggccttactagagatttagatgtcaaaatacaagaagctcaaagcactcctgggagacttattgcaaaaaggtcatcatcagtgcatatagtcatcaggctgtctaaagtaaacataaaagaaagaattctaagagctatgagacaaaagcatctgggaacctataaaggaaatcctatcagactaacagtagacttctcagcagaaaccttgcaagcaagaagggattttgggttttagctttagcctccttagacaggacaactgtcagttaacaattttgtatccaacaataaatttcataaatgaagaggaaataaaatcattttcagacaaacaaatgctgaaggaatttgttactaccagaccatccctataagaaatgctgaaaggagttctaaatcttgaaacaaaagcttaatatgcaccaaaatagaatctcttgaaagcataatacagggcctatgaaacaattacacaacgaaaaaagtatctaggtaacaattaacatgatgaatggaacagtatctcacatctcaatattatgactgaaagtaaatggcctacattctccacttaaaagatacagatgggcagaatggatttttaaaaatcacaaaccaaatatctactgtcttcaagagactcacctaacacaaggattcatataaactcaaggtaaagaggtggaaaaatacattgaatgcaaatggaaaccaaaagtgagcagtagtcagtcttatatcagataaaacagactttaaagcagcaacagtataaaaagaaaaaaagtcaaagaaggtaattatataatgataaaaggatcaatctaacaagaagaaattacaaccgtaaattaaatgcacctaacactggagctcccagactcataaaacaattactactagacctgagaaatgagatagacagcaacgtaataataatgggggaattcaatactccactgacagcactagacaaatcatcaagacagcaaggcaacatagaaacactaggcttaacgtacactctagaacaaaggaacgtaagatatatgtacagaatattctaccccaaaactgcagaatacacattcttctcatcagcacatggaacattttctaagatagaccatatggtaggccacaaaacaaatctcaatacatttttaaaaataggaatgatatcggccaggcgcgcagtggctcacgcctgtaatccagcactacgggaggccgaggtgggtggatcacgaggtcaggagatggagaccatcctggctaacacagtgaaaccccgtctgtactaaaaatacaaaaagaaattagccaggcgtggtggcgggcacctgtaatcccagctactcgggaggctgaggcaggagaatggtgtgaacccggaaggcggagcttgtggtgagccgagatcgtgccactgcactccagcctgagtgacagagcaatactccgtctcaaaaaaaaaataggaatcatatcaaatatcttctcagaccacagtgaagtaaaacaagaaatcaactccaaaaggaacccctaaactacacaaatacatggaaattaaacaatctgctcctgaatgatttttaggttaacaatgaaatcaagatggaaattcataaactatttaaaatgaatgataatagtgacacaagttatcaaaatctttgggacagggcaaaagtagtgctaagaggaatgtttattgcactaaatttgtacatcaaaaagtctgagagatcacaagttaacaatctaatatacacctcaaggaactagagaaataagaacaaactaaatccaaagctagtagaagaaaataaataacaaagttcagagcaaaaccgaatgaaattgaaaccacaaaaacaatacaaaaaaaaatcaatgaaacaaaaacctggttctttgaaaagataaacaaaattaatagaccattagtgagattatccaagaaaagaagagagaagaatcaaataagctcaattagaaatgaaactaaggacattacaactgatgccacagaaatacaaagatcattcaatattactatgaatacctgtatgcacacaaactagaaagcccagagaaaacagataaattcctggaaccatacaaccatcgtagagtaaatcaggaagaaatagaaaccctacacagaccaataacatgcagtaaaactgaatcagtaattttaacaattgcaaacaacgacaagcccagggccagatagattcacagttgaattctaccacacgtctattcacagaagaattggtaccaatcctaataaaacaatttcaaaaattgagaaacagggaatcctccataaatatcctatgaagtcagcatcactctgataccaaaaccaggaaatgacataacaaaaaaagaaaacacagaccaatatccctgataaaaatgaaacaaaaatcctcaacaaagtactggctaaccaaatccaaaaagacatcaaaaagataatacaccataatcaagagtgtttcatccaaggatccagggatggtttaacatacacaagtcaataaaggtaatatatcacataaacagaattagaaacaaaaaccatatgatctcaacagatgtagaaaaagcacttgaaaaaaatccagcatctctttatgctaaaatccctcaacaaactaggcatagaaggaacatacctcaaaataataaaagccatatttaacacacttacagcaaacatcacactgaatggggaaaagttgaaagcattccccctgagaactggaacaaggcaaggaggcccacttttaccacttctactcaatataatactggaaatcctaggcagaacaatcaggcaagagaaagaaataaagggcatccaaattggaaaagaggaagtccaactatctctgtttaccaatgatatgattgtatacctagaaaagactaaacagtactccaaaagactcctagatttaataaacaaattcagtaaagtctcaggttataaaatcaacataaacaaaccagtagcactgctatacaccaaaaacaatcaagctgagagccaaatcaagaactcaatcccttttacaatagctgcaaaaaataaaataaaatacttagaaatacacttaaccaaggaggtgaaagatctcaacaagaactacaaaacactgctgaaagaaagcataaatgaataacaaacaaacagaaatacatcccatgctcatggattggaaaatatcctgaaaaatgaccacattgccaaaaattcattttcaaagaattaggaaaaaaatcctaaaattcatatggaactaaaaaggagaccaacagccaaggcaatcctaagcaaaaaaaaaaaaaaaaaaaaaaaaaacacaaatccggaagcaatatatacccaacttccaattatactacaaggctatagtaaccaaaacagtatggtactggcataaaagtaggcacatagaccaatggaacagaatagagaacctacaaataaagccaaatacttacaactaactgatctttgacaaagcatactacataaattggaaaacgggtgccctgtttaataaatagtgggagagttagatagtcacctgtagaagaatgaaaatggatccctatctctccccttgtacaaaaatcaactcaagatggattaaagtcttaaatctaagacctgaaaccataaaaatcctagaagaaaccctagggaaaactcttctggacattggcctaggcaaagaatttatgactaagacccaaaaagcaaacacgacaaaaacaaaaataaatggaacttgaataatccaaaagcttctgcacagcaaaagaaataatcatcagagtaaacagacagcccagagaattggagaatatatttgcaaactatgcatctgacaaaagactggtatccaaaatctacaagaaactaaaataaatcagcaagaaaaaaagcaaataattccattaaaaagtgggcaaagtccatgaatagacagttctcaaaagaagatatacaaatggccaaacatatgaaaaagtgctcaacatcactaatcatcaggaaaatgcaaattaaaaccacattgggatactaccttgctcctgtaagaatggccattattaaaaagtcaaaaaacaatagatattggcatggatgtagtgaaaggggaatgctgatacacttctgatgggaatataaattagtacaacctccatggaaacctgtatggagattccttaaagaactaaaagtagatccaccgattgatccagctaatatgatgactgggcatctacccaatggaaaagaaatcattatatgaaagagacacatgcacacatatgtttattgcagtcaaattcacagttgcaaagatatgaaaccaacctacgtgcctgctaaccaacaagtggataaagaaaatgtggtacatatacaccatggaatactactcagccacaaaaaggcatgaaataatgtcctttgcagcaagttggatggagctgggggccatcattctaagggaagtaatttcaggaatgaaaaaccaaataccatacgttctcacttataagtgggagctacgctatgagtatgcaaaggcataccgagtgatataatggactttggagactcagaagcgggagggtaggaggggggtgcggaataaaaatctacatatgaggtgcaaggtacactacttgggtgacaagtgcactaaaatatcagaattcaccactatataattcatctatgtaaccaaaaaccactagtactccaaaagctattaaaacttttaagaagaatatataaaaccttcaagtatttctaaacaacatgtgaactgagggaggaaaaaaataccttagataattttaattgcatttgcaatgctccacttttactaaaatatgagtatttgttagctaatttttaggtcattaattaattgcctttattagtgattaaaaatgtgtatgctgattgtacctaaaattggaggcaatttaagacttgaaaaggatactaccttttacattttgttagataaatattgtagaaaaaatgtattttatgattaaaagaaaatgaaattacgtagctttctatttgctttttatttgtagctttctagtaaatctttagtataaaactgtttaacaaaaaaaaagcctagctttccttgaattatattcttgcttgtgaatgcaaaaccttccaaattatttgaaacatttatgtattcagaatattactttgtggttttcttcttaagaagctaaacaattcattaaacaagctgctcttgaatagtagatcagaacaagcataagctgccttctgtagaattctattgtggaactgtacccatttgtgttttctttgaagccataaaaatgaaacccttatgctcatattaaaagcataagaaaggcatctattatgtcaatagatttaaaacacggccttagacacagtgagaaccactctaaaggttaagaagttcattcccaaggaaaaccatcaaaggcctacatatcattatatctcaaaacagatggcatcacagtgtttggaactatagtttacggacacctacgatctcaaataaatccttgctaatcccacccttttgtctagattttgtactttgatggtaactgcaggtgccttttctccatcatatcgttgcatgtcattctatgaatcatgaagatacatgtaccttatatggacacaactcttaataaatacaacttttatacaatatgtaagtattttaccagccacagatatactctttgtagaaatctatgcttcttagattctaatctattataaatcttcagtagtctaaattttatagaaaaaaatgatgaaaatatacctctctcatagattggtgaaactataatattgatttaaaaatcactttgtaaaacaatgtggaattatctagtatctaggtatatatcctggagaaactctcaaaaacaggagatggggacaagaatatttacagcagcattgcctctaacaccaaaaaactgcaaacagcccaaaagatcaacaggaaaattgatatatgaactgtgttaccctcaaacaatgaaatgttgtacaacaatgaaaataaatgaactgttcctacatgcaccaaaatagatgaaccccagaaacaatactaagcaaaaaagataaatcacagaaaactatataaaatatgtttccaatttatataaagttaaaaccatgcaaaattgagcaatgtgtttttactgttacttaggttcaggaatttttttttcatctaaaatcctgctgaaaaaaattaaataatactaatgtgactaacagattaaagtaaaatttttctatgattatttgctaccaatctcatatactgaaaaacttttgggattcaaatttagcttattacaaaaaaagttatctacagacagaaaaatctctcatgcatccatacaggtgaaaagattgtttaaaagatcatgtccttcaatatttaagaaatatcatatgaccttatttatatgtggaatctaaaagagttgaactcatagatgtaaagagtggaatggtggttaccagaggctacagttgcaggcgggaaggaaagatgttgttcaaagggcataaaatttcagttacatacaaggaataggctactgtactgtacatggtgactatagttaataacaatgcagtgtattcttgaaaactgctaagagtagattttaagtgttctcaccacaaaaaaaagaaaaataagtacatgagctaatgcatttgttaattagtttgattaagccattccacaatgtatgcatacttcaaagcaacatgtcatacatgctaaacatacacaatttttatttctgaatttaaaaaattaattaaaaataaataaaatattgaagggaaatatataaattataacctataaaaaaagatttaaatagtatcactatttagctgaaaagagttctatttcacagtttacctgacacactgcaatacttcagagtctgcagaaaagagttatttaagtcttgtctgtatataagatgtggcttgttgtgaccatcttcatattcattcccatctgccttcattataggttctaagaaatattcaccgttctgtcctttaaatgttcccgtctgaaaataaaggaaacaaaaatgaatttttcctaacagtcgccaagaagaaaaaacacatagtaccacaggttaaatgagcagacagaagcaaaacagcaaggagtctgttcactaagagccatcaactgagcataaaaagtttcccttccctgggtcacttttctctctccactcctatacataaagtcatgaagactggatagtgttccaacaggccaagctaagtgacgggcattccaggtgcaaagaacagcatagataaaagcatcaaaatggaaaaagtgtttagaatagtctataaataataaagcctgtgcttttgatctgtgggaaaatagatactttttttttttaatgtttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggctccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaactcaagatgggttaaaggtttaaacgttagacctaaaaccatagaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgagcagacacttctcaaaagaaaatagatactttaatacattagtgttgaaaatatgtcagtacaatcagtatgcaaagcaatttggcaatatttaacacattaacaatgtatttgccctttaacacagcaattccccttctgagaatttatcctatatataccatacatttgcatgtgtgaaataatatacttacaaggttattaaccataacattgtttttaatagcaaaatattggaactacttcaaaagtccattgatagagtctgtttacataaactttagcacaactatgtgatggcatcccttgaggttataaacaaacaaacaaaaagagaaaacattctgtgtagtgatatagaaagaactccaatgcatatcattacaccaaaacaaaaaaaactactaaacagaatgtatacttcactactattgcataataaaggaagaaaccctaaaactaaatatttctatttgcctggttactactgaaaaaactctagaaggattattaggaacagtgccgatagaagtgggtgaaactgggtgcatgtaggatggactaggtatggcatcgtgcttccaacatgctgtccctctacctaaaatgtttccctgcttcccacccttcacctctacctctgcatcatcacactcagtctggctggcttcatctcatccttcaagtctcagctcaaataacaaccacccagaaagtttttccttgaccagttttctaggtaactacatacccatccctactcctaaaaacacattacatctgcttgatttctttagcacatttatcatatgttgcatttatatgtttgtttgctatttaaaactattcttccccactagacagaagtcttcaaataagcagtgacctatccctgaatttctactgctgaagagactatctgagatctaggcacatgtggtaagcagtaggtatttgttaaaccgtgaaagctattatttcctacctttgcaagctcagtttatgttaagcaaaagtagggcataaatttgaaaacttaggctagacctagaatataaagactcttgcttgcagggatttttgtcagaggagtccataaacttgggtgagaaaaaaaattacatccttattatcattaacctaattataattaacctataaactccttcatgaaagaaatgctaaatttgaaagtaggctacaaattccagtaaggttgtcaacagaaagcacagatatgttcatcacatgatgatgtttgaaatatctaaaaatattgtttatgcttatcaacacttcaaaattaaggtagctattagtctgccattagatcatattatttaaggtgctaataaaagatacataactttttttaatatcttgataactatatttcaatataaatgctttattttgtatttttattaatattttaggtgcattgagattctaagaagggttcatttaatcattaaagaattcaaataaaagtgggagtggagagcagagtcaaagcaataactttgaaagactgaacaattgtacaactaaagaaagactagtgaagggaaatgtttagccatcaaggtatgaaacaacaaggacttgcactctgttggaaagaagcccttaaatggtcaatttatgtagatagatccctctctcgagtcaggtgaggctaagtcatccaagggaggcatttataatattaatagctaataccaatatagagatcagacattattcatttatatatattcattcctatacatattttatataaatatataattcttttccacctaataataattatttaaagtaaattatatcattatccccactttacaggtgagacaaatgaggaaaagagaggttaagtcacttgtccaaggctcatacctagtaagtggcggtatcaagatatgaacccaaatactttggcttcacaattcatgccttaattcattacactgtgttcattatcacataccaattttgataaactctatgaactagtcaataaatatttaatgggcacctactatgtgccaagaaccgttctaggggctaacgatacagagataaatgtgacaaaatccctgccttcaaagaatttatactcctatggaaaaaggcaaccaataaataaaaatataatagaatatgcaataagtgcaataaaaaataaaataaggagagagagaataaaagagggtgagagtggggaggcactctggaggggacagcaaagctgaggctagagtaatcaggaggtagccgtggaaaattctgggaggacattccacatagaagggaatattccaaacggtgactgaaaggcctagagatgaaaaagtcttggcaggtaaagtgacagagagaacagtgaggctgcagctgtgccagctaggagatacagagtagcagatgacatcagacaggcagaagcctggttgcactaattacgcttcacagaaaaaagcactcctcacacctcagaatcacacaaatatatttacctacatttaaaactttgcacttttccacatggaaaggcatgtttctgtgaagacccaattcagaaacaaattactgaattgcaggtagtatgataaacatagttttagtgaatgagacttcatttccatttcttaatcacaaatatcttaatatagagatactttgaaatcattgttttaaattccactgcaaataaaaagcatattttattttatttttcattcatttatttattatttatgtatgtatttatttattgttaccaaggccggagtgcagtggcatgatctcagctcactgcaacctccacctcccaggctcaagcaatccccccacctcagcctcccataactggcggaattttgaaggttttttttttgtatttttggtagagatggggtttcactatgttgcccaggctggtcccgaactcctgagttcaagtggtccacccacctcagcctcccaaagtgctgggattacaggcatgagccaccacacccggcccttacttttatttttaatgtttgtgggtacatagtaggtgtatatatttatggagtacatgagatatggtgatacaggcatacaatgtgaaataagcacatcatggggaatgggatatccacctcctgaagcatttatcttttgataaatgctttttgagttacaaaaaatccaattacattctttaagttattttaaaatatacaattaaattattattgactatagtcacctgttgtactagcaaataggtcttactcattctaattttttatactcattaaccatccccacctctccccaccccacacaccctctctctatccttcccagcctctgaaccatcccttctactctctatgtccatgagttcaactgttttgggttttagatcctacaaataacatgcagtgtacatctttatgtgcctggcttatttcatttaacataatgatctctaattccatccccattgttagaaatgactagatctcattcttttttatggctgaatagtactccattgagtatatgtaccacattctctttatctattcatctgttgatggacacttaggttgcttccaaatcttggctattgtgaacactgctgcaacaaacagtgggagtacagatatctcttcaatatcctgatttcctttcatttgggtgtatacccagcagtgggattgctggatcatatggtagctctacttttagttttctgaggaccctccaaactcttctccataatggttgcactaatttacattcccaccacaatgtacaagtgttccctttttgacacattctgaccagcatttgttattgcctgttttttggatataagccattttcactggggtgagatgatatctcactgtagttttgacttgcatttctctgatgatcaatgatgttgagcatcttttcacatgcctgtttgccatttgtgtgtcttcttttaagaaagtctattcaaatcttttgcccattttttgatcaaattattcaatgtttttcctataaagttgtttgaactccttatatattctggttattaatcctttcccaaatgggtagttgcaaatattttctcccactctgtgggttgtctcttcactttgttgattgtatcctttgctgtgcagaagctttttaacttgatgtgatctcatttgtccatttttgctttggttgcctgtgcttgtggggtattgctcaaaaaatttttgcccagcccaatgtcctgaacattttccctagtgttttcttgtagtagtttaatagtttgaagtaacatatattttaaatcactattttaaccgaacatttaaagccatttaaatgatcatggcaattgtagccataaagttctctttccactgatatttattattacattgaaatctccttaaaggtaagaacatatttactattttcagagttccaacatctaaaacattgcctgaaacacagcaggcactctgtagacagctgcagaaatgaacatttttgtaacaaacctggtgaagtacctggttttttctcatcctatatccttgggtaaataattctttaatttttttatgaacattctttttttttttttttttgagatggagtctcactctatcacacagactggagtgcagtggcgtgatcttagctcactgcaacctccaccacccgggttcaagcaattctcctgcctcagcctcccaagtagctgggattacaggcacctgccaccgcgcccaggtaatttttgtatttttagtagagatggggtttcaccatcttggccaggctggtcttgaactcctgacctcgtgatccacccgccttggcctcccaaagtgctgggattacaggtgtgagccaccacgcccaggctttaatgaacattcttaagttatggtactcttgagacatgtctaggatatagttatatgacggttttctttcaatgctgaaaagtaaaatgtttagacacccttatatagtgtgctaatgtgttaggattacacgtttttaaatagttcaaaaattaatgaaattccatcagactactgactataaagcactgaaattatagtctataaaataaaaggcaaagctataaatataagaattcttatctatttcttggatacttttctagggctgataccctaccatatttcactaattctaccagtgtctattttctaaagataactacaaatcacttactttcaacaaacaccaatactctagcattctctgccttcctagaaaactaattttacccatacttataagaagtaaaaaagacattgttttgcaacctgagtacatggatccatggaaaatccttttctgccttttttaaaaagcatgctgaagaggggaaatgtgatactatcttgacaaaatatactaatagacataaggcagcttgtttactcaactaactgtacctacaaagctactttaaatagcatcacactatcttcaagcaaaattaaaagtacttatattaaccatagatttttttttttttttgagacagagtctcactctatcgccaggctggagtgcagtggcacgatctcagctcactgcaacctccacctcccgggttcaagtgattctcctgccttagcctcccaagtagctgggactacaggcgcttgccaccatgcccagctaattttttgtatttttagtagagacggggtttcaccatgttggccaggctagtctcgatctcctgatccgcctcagcctcccaaagtgctgggattacaggcgttagccaccatgcccggccaaccacagaattcttttaagctccttttggctcaaactctgactaggaggtactattttaatatgccaataaaactgcacatgggtccaatctgtgttcccatgtaagaagaaaatacagttctatccagaaaccatcggtacctccttttaagttgtgctagaacactccagcctttaaaaaatgttgtctttataacttaaatgaaagcttgtatgtttggaaacactaagttaaaaaataatggcaaatatttgtcctcaaactgaggataaatacttgtcctttttatttattaatggaagacttagaagtattttgcccccactgatttttctataacctatcccattgcagtggactttttgttcaaataattaaaatattagagctttgcctaaaggctcctaaggaagcactttaaatttttttttaacttggaaagaacccagcaaggaattagcagacttaaaaaaaaaacaggtggttcatagaattgtacttagatcatgccatatttttagcaacatgactatctgcagatgggccctgcaatttgattcatgataaatgccaatcaaattcctaacactttctttcaatgactattaaaaacagcaaaactagttttcacttgggtaggagtttcttgattacttgatgatcttctatttgccaagctgttttgaaaggcagttaagtgactataaaactggctccaatttattatcataggccaaaatttttatatgtttagaagattctataaaattgtttttccaaaatgttcttatttcagtatcatggcattcatccatatatttttttcaaaatacatagcaaatacatgtacttttgctacaaccaataaggtactctcagatttcattaaagggtgataacaagtacaaaatacaaaccctttgaactcttttcccaaatcatttatagttatcacattaaacactgtcaactggagaacattcggaaataaggtactgctgaagtgttgactaaaatacttagtttttccatcttcaatcataaatcatatcataagaatcagtatgatgatatataagaagaaagcctaggtatgagttctgggtttgtactcatagactcttatgtaaattactttatatctttgaccttcagttccattgtctgtaaaacaaaattgaaataattgtatctacccaatttcctaggaaggttaatgtgtgtttaagtgatattaataataggagcttcaataattgttttgaaattgaatgtattttgaagcaagatgaaaaattctccactaacaacacaaatgtgacagccactctttttaccactggcagagtataaatgttatataatcgaagaccacaaatatgaactctgagattaatttttatttggggataagtaaaaatgtaaaaagttttctctctctgacagtttctccttataacaccattaatcatgcctaggaaatagtgtattatacagaaacacacattgaataaatgaatgaatcaatgatataaagaaaacacaagaattaactccagatgcataaaacagaaaattcatagtaagggttttgttttgttttgttttttaaggttagttgttcttctcttctcttctctagcagcattatttaccttccccattctgagacaattccagatctctagtataaaaatgaaacaataaaagggaaataaatacgttgctggtaccttacctttttaaaagggactgctctcctgccaagtcctggcctattcaaatcaagaaaataaaacaaagactggactcatctacccaagattatgtatccaaaagacacaagttcaaatagtgtgccccagcagccttcataacatggagcaaattctgtaatatttctcattcttgtgggcactgaggtgttataaagtcatatgaactaattaaaaagaggaaagaattgtcaaagaaatggccacgttcttgtggggtctgcgtagtggtcctcagatggcctctcccaaactgtctccaaaatatccgtgaaaatatgaaatcaaaaatcataacaatgagaaatttaaaataataagaaatcattaaaaactattttgtaggtctataatggaaacatactcatgatatattgtcaaaatattctgaagcaatattactttaaaacaaacacaaaaatacatataatatctagagggacatatgccatacatatgccagaccacctgtaatatttgtagcatatattttcctagtttatttttaaaattttttacaattattttgacatggaactcttcaattatcatttgggccaatctattgtttttttttcatgtgttatttcttgtatttttccctatctaaaaattacaatatactgtcattttcttttactttagtacagttggaattttatttggtttaccagtaaagtgagaattcaaaatttagtttttccctataataagttcttggcattaaaagatttaaaataaatgccttttaggctttggcaactgtcacagaaaactaacttgaagcaattatcaaaacttgatctgttgtcagaagccaactaagttttagagggattatactgtcaaagaaaacactagcctggactgaaaaagcctttgatggagttcattgtaaaataacctacaggctttcagaattaccccagcattcttgaagctcccccaagacaacatcctcctgagaccccattttagatgtggccatggaggaagatggacaagaaagttccagaaggtagaaccaaggatctgggcaattgaagtccaaggatcccagccaaaaccaagggctgggcacttggctcatgcccgtaatcccaacactttgggaggctgaggcaggaatgctgcttgaggccaggagttcaagaccagtctggtcaacataggggaacaccatctctactgaaaattttaaaaaagaaaaaaaaactggtcaggtgtgggggggtgtgcctgtagttcccagccacttggaaggctgaatcagaagtatttgagcccaagagttcaaggctacagtgaattattatcatgccattgcactccatcctgggcaacagagcaaggtcttgtctcaaagaaaaaaaagaaagaaaagtaatcaaggagctcccctccttccacagtagtgagtctccacaattcctcttcaggagccaaaaactgctaaatatcagtgactactaggtgtctcctattcttctttctgtagcaagttggggttagggttgcagtcatgctggtcatgctgtatacttggctggtagctgaagataatttatctttttaattcatatttttccaagctacaaagagccacatcttgactttatggagaagactgcgttatccagagatcctggacattgagccagagtcagtgcccctgtgggaactttgagttttctccttatagacaagatgagtatgtttgatgcgtgatctgtttggtgaacagaagagcagcctgtaataaagactattggtgatcaccaatatgggtgttctttctttttcctaggaaaaatcaacgcccctcattttccagtcttttttacatctaggtagaaccaggcaactagttctcctcaatagaatatacataaaattggtttgcgtcacctttgggctgagaaagtcaagatccagtataccttctccatgctcttactatagttataaattatatagctcataaacatatttgtaattaataaacaatatttttccaatagaaaacacataactgtaccaccaaaacctaatagtggctgttaggtaataaatgactgataaatatttgctgaaaaaaaatgaacaatgtgtttcttcctttgcatattagtaagagttggacagcttaaatatatttcatagaaaacagtaattacaataattgcaacagaaataaagccacaaaaaacaaggatgtgatgtaagctcaaatgaatgaactaataaatagaacacaattaacttaggtatcatcggaagagatttagtaaatacagaatttcttaaatgtgcccaagcactttaactaaaattggtaaagtaattttcctgcatcgaatgactgaggtaaagatgagctagctaaatatttggcatatataaataaaagttagctgcttatcttactcataatgtgttgctcaacatgtgttgagcaattctatatattaggtgctaaaagaaatatgactatcatttctaccttctaattctataaatgaaatagaaatgcagacacctagctttaatttaatatgtaatgagagtacacgtgcataaaacgtcaactggtacaacaaggacgccctggtcaattttgccaagagaagatcaggggaaaaggaaggcagctcaaaatggatcaggaaggatagttaggaggttgagggaaaggacattctatacagagagaagagcaaatataaattcaagcaattatgaagattagagtaaatctgtgatagaatcaaacaagtgtctccagaataattacctttcttgccacttctgtcattgccttttttggttaacagccacaagatcattcagtcatttaaaccagagtcattaaaactttttggtctccttcaccaatgctccagaattctaaggggtctcctgcaaggctgctccacttcagcactacggacagcttgataattctttgtgtagggggctgtgctgtgcattgtgggatattgctggcctgtacccatgctctgccagtagcatgctcgcctcaatgcacctacagttgcaacaacaaaaattgtctccagacattgccaaatgtcttctgggggacaaaactgctcccagtaaggaagcactgatctgcagtagcatacggtccataggtacccactcttctccttccccactgcaacattactttaaatagcctctcttccttacccgcagtagggtaatagactacaacactggtcttctcagtgactcactgcctcccctgtaccctgcacaatggtgcataagaggagatgtgcctcctaatacattgaacaaacctaccacatactgttcaaattctcactcctttacaatgcatttcaggaccttaacaatctgattccttggtcttaaactctcactaccaaatctaccctgtttttcagctgcacagtccacgagaagtccttgaattttcatatccatttttattcattcctcaaagtccagttgagaagtcttgcccagcagaggtctcacaactctcttaatcactccttccttaattatgtcattcctcaaagtttacacagcactttttatgttgtctactttagcaagggcactttgaaatccatcacagtgtttgcaccctggccatagctcccaaggacttctccttgtcagtaactgagtatggtagggatatcatggcagacctgttctcgagagccatagactcttgttctggccaagtctggctcaaggacagctttgctcaaccttgcttggactgcccagcagcctaggatgctactacccaacattctcatcctttttttttcctatgtaagcctttttttcttacataagctcttacacagctctccaagctctctccttagtttctctaacacagacacttcccctaactaaaatcttatctttgcatctgtctcttgaaagacctggactaacacacactagaatgttaaaagaacagcataagaaattttccatactgctgtttgactagtattgcagcaagtacatgaatagccaaaagaggttcttattagttttctcaataagaaaaaatatgaatacagaatggcatgtgtaataatccaaggctatattagtcctgggaaaatagaaagtttggaaaataataaaactaaaattttgccagaatacacaaaaaacagtaaaaacactattgatagtttctatattcttatttcctgtctgaacaagaagttactagagcaactcaataatcagtcatcagagaggtaatgcttgacatgttgcagaatggttcatgtgagaaacttcaaaagtacacacagccatgacaagctctactccatgtataagtcagatgcaatgtctggtttcatgacatctggaaactgtttccttcaaccagaaagactgcattgcctcaaatcccaccaagaaatagagaagttaactgtctaggcagttgagttaatccccgaggaccttgggaagacttgaacaccctaggtaatatgagaaaagggctaccagaagcatgaggaattgtcagaaacagcctgtgtaaagtttgtcaattccatcctgacaagtatatgccaacttattaaatactgatctctaaatacgttggcaagagtatttaacaacattatgagatgataaataatatgaccataaaaaagaagtttagagttggatatagggatattaagtcctggtaactatacatgttatgagatagcctatcaatggattaaaaacatagagtttgattagccattacattacttatagataattttatgattcagttccatttttatactttttatagatcttggaaatgtataaataaatctctattcagaaatgtttgaattatgggatgaataaatacttacacttatggaaaataaaaattatagagaagaaaagattagaaaagcaagaattatatacatgttaaacaaagaaaatttctgccagactcttagactcttctggttcttgggctcaaaatacttaggaaaaaaactaaacaatactagttatggttcagagaaaaacataaataccaaaacttctaaaagtgggggaaatttaaccatatagaaattaaaagaaagtattagttcacatgtttggggttaattcaaaactaacaactaaacggaatcaataaatacattggggtgtcaactttaacaaatggttatacagagatattttgaaaatattaatttgatttgtttttcattctttttctctaaaagccacattcgctgccaccagcgaagggaatgagagagtctacctcagttgggaagatggaaaggcaaaaggtcaattaaatgagatgtgaaaatggaactcagtagatactggagggggagggggaaaggcaatggaggcaaagaaaacagatgctaagatgtatgtacattaacttctccactggggggttaaaatcccagaaacagaaggcatattgcattgttcaaagggactgcccaaagaggtgttccagggtgctgactatgtgggactcaaggaaggaaccctctgaaagggttccctacacacatcaaatttagaggtgtagaagagttcgacaaagagaggaactgaatccctcttgactctcaaatgccatagagggcttgaggcctttagaggggtctgcaagaagagcaatagcatcaccaaaccagtttacctggagaaggtgatgcagcaggactttgtatttgaaggctgcacaatgaatcactgagacaagaaatcaaatggatattatagccagaattcagagggatatacagcactagtgagagcccagaggaggatgagtcaagaccagtgagctctcattgaactaggagaaaaaaggccataagttctcaggcccagaaatcagctgctgttaacagaaaagtacaatgaaactatggcacaaagaacatcaccagaaacttgaggaactgaaggacggtacaatttcctcacccctctcccaaacaatacaaagacctcataacacgttataaccctgtatatagtcagtttctatcaatggtcaatgaattcttgaatccaccaatatatgaaacaacactcattagcagaaaaagaaatgaaattggatgctcatttcaatatactcaggaaaaacatttaataaactacaacatccattcatgattaaaagcaaaactaaagtaaagcaaaaagcgactagaaaaagaagagaacatctctaaattaataagactagctctgagaatccttcagcaaactgcaaccttaatgtttaatggactgagaggccaaagtcagatatcaagtacacaaggtgacaaagataaactaggaagcaagtaggagcagggccatcaggttagcattattgaattcccaagctttgtatcaacattgatctgcaaacaattcatctggtccaggtttcggatactacagtttacctagatacaaagactaaaggctgatctgagactaaaaaggggaatctggtataattacaaatggattctaaaatctaccaggttctattatttgatgaaactattaatccaaagaaatttaatcgtagagtcagtgtagaaataaatatatataatcataaataggtagctaatatccgttttagtgctaatataaaaaaagcaaaatttttaaaaagtcactaatctcatcagtaatttagacttacaattgattatgatcacactactgaaaaaaatgtagatcttgatacctctagttatttccaatgttactggaaaatttctgtctctacaatgattgaagtatgcaactaagccttatgcaaatacagagaaattatgtaaaataaagctaagttatggaggtatgaaaagaaacgtttaaatgttttatcaactacttctgataatatcaataaattatcaaaagcaaagtacataaatgggattatttacttgccattcaaagtatgactcctataggtgatttttcctcttcaaaaatttagtaaaagaacattcagaacaaatcattttatttgtttgtaatttctagtaatccctcaattaaattaaataattttgttctgaatgttttattataaaatttatataacataaatgattgatttcattttttattaatgagtacattgctaaagaagataaacattgctgattaacttacacataatatattgtataatacattatccacataaatgaggaaataataaatcttcacacgtaacattataaaaatattaatattaatttttagatatgttaataaaatgaactaggttataaaacaaaaaaagtatgatgatgacttgggcaactgtatccaaaatgacacagtgactagagagttatgactcaaaaatctttaactgctttctgaattcaaaaagaggatattgatcataaatatatatacctactatgtacccacaaaaattaaaaattttaaaaaaggatactgaataataatttaactacatcaacattatgaatcaaaatgagcagaaacagcattccctataatgccttcccatctggaatgcttttccatgagaaaacataatgaccatgacaaatttgtggtagcaagtctaggattttccagacaaactaaacattattttagaaaggttttagaaggagaattttttatcctttgaagtataggtggctatgtaaatattagagtgtgattctgccattgtgatgttgcaaatattttacatggaagaaagaaaggaaatggttctagccatttcatgtaaaaaacaactcaagataatcacttgaaaaagagctcacatccaggaagacatcttaaatcagttaagctaaaggagtattacatttgaactgcagagaaatgttatcaattttttatttaatcaaagaataaacagtgttgatgttctaaaaatatctttgaacaccttccagaagtatcttttgtaaaagtatgtatctgctaaacaaaagctagatacttaggaactgtagaatcctgtaaccaaattcctagttcttgttttttcttgaatatgtatttgtcagaggagttactgatggagtgagcctatatatgttttaaaacaactgtccttaccctggggttccatgaacttggatggaaaaaaggtacatctttattttcactaacctctgatactgagcatttccttcaagtatgaaggtaggtgaaaccacagacactgtggctttatcaccaataaaatgatacttttatatcacattatggttggtgtagctatgtgtcaactgattaccaccacaaaaatataacagacataaccaatagatctctgtaggtagactgttttcaagtatgatgcattttaaacagattcaacctcttccctactctacttcacaggccatccccataccatcaacaaaatgaacttttcctattctgaccttgccagtgggagccatttcattttatgtatattcattctcctttccttctatcaaattccagaaacaaacttatctaagtaaatccgggggattctgcctcaataggaccacgaaagggtacatctgagtcaaacagcctgccctccattcggaaaacacactccattgtaacagtggtcccacaggccactccctgatcaccactccagggatgatgaaagagcatctttcatcagcgttgcacagagggtcggttttgcccagcaggcagagacctgctcatcctgccaccagagccttccgaaggagttgcctctggcttggtgttaatccttcttgtagcccaacctgaactccagggtcatcagccaccaactcgaaaacccaaggccccgttcgctgaatgtagcccttgcctggatcccaagaaaatgccaagggacccgaggacactcaccaggcctccgcataagctgacgacggccttgtaatcctcctgtgagttgacctggccgcggtagaagcagtggcgcaggtccgagggccctgcgtcgctctcccaggccccgcgctccggggttcccaagtgcacctcggtgtagccggcggccagaaaggatgcatcggcggtcaggttcagctggaagagctgcccgtaggcagtgaagcgatagtgggttcggaacggcatgggttccagcgcctcggagctgcgtttctgccggctgaagtggtggctctgagggaacacttctccaaactcattgacccgctcggggatcactacttcgtaggaggtcagtgtcctcaccagggcttctgcaacaacagcgacaggaccagtgagctcccacgcgttcctcattgtccaactctaaacttcttccaccaaacgtccccgctaaaggtcccaggtcccagtacagccaggggcaagacaaatgcacacatgctgatgcgcacgcacacacacacacgtgcactgggacggttagtgctctgctttcccacacccccaacttgccctaccctccccaagcaaagaccctaccactaatggccctaagcaacccacttccttccccagtacctcctaacctccccgcagcccccaactcgttccctccgggtgcaagcgaccccctgccccttgcgcccccgccgtgtggtcctgggagtgcgatgcgtcttaggcgcgcgcgattcctcgaaacccggcgcagtcgcgacctctccggctgactggtccgggagtcccgggagctccagcagggccagcgttccccaacgggctgagccgctcgtccccgcgacctgcatgtcccactcgggccccgcgcccccacttagccgctgaaggcgtctcgcggtgactttaccttgcctggggtggaagtcaacttcccaagacctggtgatgaagagcgagagatggtagagcagcccagtcagccacttggccacccacat

SEQ ID NO: 2381 - DNA, 984384 bp, Homo sapiens
ggacgctcctcccggagagtagtgagacccctggtgcggggcgattggcggcgggagcgatgagtggcagccgcacggcccaacgggagctgtgcgtgggccgcggggcggggccagggcgggtgcgcggcggcggcggggtggctgggccggcggcggcggcggtacgaggcgcgcgctcggggtcccggtcgcgaggaggaggaggatgtggcgcgcggaggggaaatggctgccgaaaacaagccggaaggtaagagccggagcgcgaggggctggggggcggcgcggcgggcggcgggacccggccccgccggacatcccgggcatcggcggcgccgggcgggagcgcgggggcgcggcgggcgggcgggcgggcgacccggccggggagggggccggcggggtgggggggcggagcgcggccgagtcctgaggtgactcgcggggccggcggagcgcggcgccccacaccccacccccgggggcgggctggggccggagggggcggggggctcgcggggcggggaccgggcccagcgaggaggaggagccggcggagggccggcgcctcccccacccggaccgggcatccccgccgctcccgagcccgctgcgcggcccccgcacccccggcgctgggtccacggtgggggccgcggggcggaaagtttatccgcctcgggtcctcctggccccgcgccccactgctccgggccggtccccgtcgggcggcagcggccggcgctcagccctcgccggccccctgctctccggcgggcagggccagatgtactctctccggcaccctcttcagccccgtggacacctccctgagcgggcggggggtccccgagcttctccccgccagggggaccccgtcctgccgagcgtccctcggccgaagggcctcgtgtgacccctcccccttcgcttcccgggaagggaagggggcctgcgcagcatccccgcccctcgcagtcgttcacatcctactcttgcccttgcaccctcacagccaggagggtggggtctccgtttctatggcaagtgaggatctccacactcccttgccctttaccttccgtgaccccgatccttccttggcacaggggtccgtctgatctgctcatcttctttggattcttttggggcctctgcacactctccgttgaccctttttgccaggacaaggggactcaggctgcccatgttcttctttcctcacccagtggatagtgggggcttgtgcagctctgaagtcatttctaaataggaaagcagacacttcttccagatcatgcatactcttacactttgctgggttagggcgagctcatttcctaaataccctttgagttgccctccttttcttatggagacaactggacgttcaccgtgctcctttcgccatttgtgtgtctacactgacttgttctctcttctcggagttccttgtctgggtgagagtgggcgccccaataagatgtagggcagggcttccattgtgcctagtgcttgagtgaaaaggggccacactagttgctcctgtgtctgaggaagaccggggtatatttttgcctccacttgactcttgtgtctcaggagggggcaaccttcatcagttgacactacctcactgggaaaagggtcatgtggccttgttttttgatgttttgattactgtcttctgtgcagtgagaaccagactttgtccgtcccacactcaagagtccttgaacctttcctggatataaacttcccgattgttttttgagagaactcatatcctcctctgtggcttctgcttcgcagtcagccatatttagtgagcctgttactttgactttttctaattttctcaaattgtattcatgttggctgggtaaggagaagccatatgcctttccattcagaaaagggagtgtagacacccgtgtcgcccacatgccatcctggaagaggttgcttgtgtgctccttgttgtactagaaccttcctttggctctggtgttgtctcttgtgggatccagacatttctttagatcttgtagctttcagaagggggaatttgaatgctttctgttttttgctgttccggttctgctttggagaaccagatcatgatgctatattcatttgtttacatatacatacatgtaggtatacacagatgaaatcacattcattacatatacagtgcacaggaagttggaagggtcagatgactagctctacattttgggtgcatatggggacctttatgtgtaatgatacagatagatattaacgttgttggtaactcttcaggcttagaagcagcagcagaagaatcacggataaatggccaattctgactattctttggtttgtaatgtgtactgtactgaataagcagaacgacatcctgcgtgttcaccaagtccctgaatgtgcgaagcgtacagtgcctgcccatacgcatcgcaactttggcggtctgaatttaggggtggtattcgttgcttgattctgcatagagtgaaaagttcttgatttctttactgcagtgtaggggaaagagatttcgtgtgtttggacaaacgacaggagatgggtgagaagaatatgttttcctgtgacagaactaggaacgaatgaccgtaaatatgtcccttttgtattttggccatttaaataattgagagaggttgtgaaattagcaaaatgtacctgtggaaaggccctcgacgcttcatgagaggatggggaacgttattcttcaagttcttttctcttggacaggggaatgatttgagccctgtcggctctagtcaggtgctttgcctcctcaggtctccctccctccctccctccctccctttctccctctttcacgaaattcagaatggctgctagccgctgtcactcagcagggaagtcttactctttgacaggcttagtgtggagactcatcctccccaacaagttccgttgggctctggggctttggcctttaaaactgttctagctcagaggctcgctttgcctcagtttactgtgtaaggagaagtggctcatcggagattgggtcagcgctagttctgtgacttctggactttgcctttcagttagcattgagtcgtccagtgggcctgattcccaatgtcagaaagtagagcttttgagctcattttcttgtttttggttttaaatgtttttatgctgttcgtattctgtgtctgtagtcagcttgatgggattgtgtatttttagggggtgttattagggaacttcggaaaaacgaagagtcgaatacctgctgtagatggtgtagactcagcggagtcatcccgtttccagtggtggttcttcctaccgtttcctccatggccccatggagactttgggagttttccctggtaagcagggggctccgtgcaaggcgcagtggaaggaaaagtggtaaagattggttggaagaagacacttgaggttattgtctgaagctgggccctttttcttgagtttgatgtggttgtgtttctgtgtcactggtcgccacagatgattggaaattagctttttccttttaccttgtagtgcagaatgctctgttgcagttgggcagactagacgggttctctgaaccacatagtttaatctttctgttcgactttctgttaggacatgactctttcctctccttcaccccttacctccagtttttgggactaggttgggtgacctcttcctcctttgtcttcttggaaaccttacttatcctgcttctgcaaatgttgggtttctccatctcatcattgagtggattcaaagtgttgacatacacagagcaacctctactcaaggtcagattgggtcagcttttccttttcaaaagagtagtgttgctcttacttgctctttgagacatatttatgcatcctgctcagctgtgttttctgtttccttagtttttaggctctggcgattttaggctttcccccagaaatagcctattctttagagagtagtgtttagtttagtctcctgtttatgctggatgtccgcccatgtgtcctgctcggtttttaattctttgtgactgattttgaggtagcccatctcaaaatcttaacgtttttttccccactgtttcattactttgagccattcttcctttcctgtttgggggaaatacccctttgtgtgcagttgtacttctttctcctttccttatggaaaaagcagtagaaggtgattctcttattttcttctgttcccctcatagttgtgtcagttgactcttttgtggaacctttgaatttgcccttctggggagaagtcgtttttgtatttatactcccatgactggagtcattcattcaggagacctttaccgagcttctgttatgtacaaggagctgtagggggtgatgtgactttgcttgagaccatattggatcttgttagccttttatattaatgacattttagtgtatcttttttttttttttttttttttttgagacagagtctcactctattgcccaggctggagtgcagtggcacgatctcggttcgtgcaacctctgccttccaggttcaagcaattctcttgcctcagcctcccaagtagctgggattacaggcgtgcaccaccatgtccggctaatttttttttgcatttttaatagagacggggtttcaccatgttggtcaggttggtcttgaattcctggcctaaagtgatccgcctacctcagcctcccttgcctcagcctcccaaagtgctgggattacaggcgcaagctgccacgcctggccttcggtgtggtgcttgtcttaatgcttgtcttttatatagtcttgcaaggaattttttttttctgatttttaagtttttggattgttaacttacaaagatatagtgtaatagtgtgctatcttgttgaaccttttttcctcctcagcaggagtgggggtggtgaagagggtgggagggtggactgggagaggcatttagcagctttcccccagactgtgtgcagagtgtgagagagagagagagagagtgtgtgtgtgtgtgtgtgtgtgtgtgtgtgtgtagacaaaagtaaagtcagccttcttaatctgattgtgtaggcataacttttaggttgtttagatacatgattggttggaatgcttatttaatatttgaacggcagcatcgcactaggcattctatagaacatagagtcaaatgtattttttatataaggaagtggtagaaaaatatttttttcttcggattaactggtatggttcatagtagatagtgagaactgtatgagctgctgttacattttcactgccatgaagaattatatccaaatttaatacctaattgatgctcattcttaggctaggcatctgatataattatcacttttattatatgacttttaatttatgctttttaatggtattattatttttgtaaattgcctcaaattctttgtgggtacaggttaggtataaataatgataataataaaaattactaacaatttgaaataccccttttcttttttcctctattaaattagatttaccatctccacaacgtatatagaaaccaattctgctactatttcactcttgtgaaaactcctgtgtgaggtttgtaatatgtggtttggcagtatgagtatgtgactgagtgtattttgtgttgacaagtgatgtgtgtgtttcttttgcatttccattatacagatcttttcctaaggtggtgtgtatcttctagaatcatgtaccctgtcctttttttttttttttttttaaatgttctaggtgacttaaatccgacctccctttcttttcttcggcctttccttttattttttgtcctttcccacatagagaggtttcttcactgacctgtcattattataaaaaagtgtttgttagatgtactgtatttgtagccttttagtaagaaggggatgcccaccatccctttgtcctgtagcacaaggcattgcttcttgtttccctaagaataggtagatggaatgagatttaagccagaaggccgctggtaatagtatttgtaactagatagcatctctagataaaacactgggtcctttctgctctgggcctccccatgtaggattttggaaatttttttttgctgcatttagccagcttctttctgtctctttggcttgatacaataaatttctttaagcacagccaagtatattatttcatttggagccttcatttacaaggaagtatgggggcctctcctaatgttcctttgcctgttatatatagtactgcctttagtttttggtgtgtttgagagtgagagtgagaagcattcttgctctgctactttgtctgtgtaacttgaataagagtgtacggtcattcactctattttccagatagtgtataatctttctttttatttttcttgaatacctaatcaggttcgagctagaggttgatccgactatcatatccttttattttgtgccatccctggatatagtgtcccttagtcctgtgattaagccatgttcctattttgtcattagagagagggacttacaaacatatagatggtctcccatgataattgtcatgcatttataaggaaagtgtttcttttctttttttttttttgaggctgagtcttgctttgttgcccaggcacgatctccgctccctgcaacctccgccttccaggttcaagcgattgtcctgcttcagcctccaaagtagctgggattacaggcgtgcaccaccatgcccggctaattttttttcgtatttttagtagagacggggtttcaccatgttggccaggttggtcttgaattcctggcctcaagtgatccgcccacctaggcctcccaaagtgctgagattacaggcatgagccaatgtgcctggccggaagtgtttccttgtataaattgacaatggagagcagttcacgtgatgggacaaagtaaagggtgagtaaagggtggttttgggtttttttttttttttgccatcagtatgctagctgtatatttctaaggttgtattgcatccttctgctttgaacaccattgcttgtagaaggtcatgggcctcctgtgtaaagattggtactgtttcctgagcatttttttttttacctcattaccctggacttacagagaaatattatgtaccccattgcaaagagaggccaagggtcagccacattatttccccttttgctctttttctggaggattgttcatttacttcgaactgattgacatggcataagatggaatgactagagatttttttttttaaaggttcctccatattcaacctcagtgtttggctctatcctgacatggttgcttgttctcctgtacatgaatccttttgcagttactttcttgtttttgtttttcaaatttagccagggctttcaagtcacgtaacatatcctttcctgagactgtgagccgaaggtaacttcaaggaagatatgcttgtttggggctgtattcatcactctgctctctacggttttgtagttttcatgtgtacaaagtgacatttcttgaaagaaacgtttggggctgtgttcttaatagttttaaacatgttattatgtggagactaagtggcaaaggtctcaccccaacttcatttcttcataccactcatatatatcttatatatatataccccactcttatatatatatataccccactcttatatatatcttatatatatctcccctacctgcaaatcccaaaacaatagtcatagcaacagaaaagcaaaaccttgtgaagcccagctctgattggttctgctgtgcagttcagtcgctagttttggacaggtgcataagcagataatttttggatgtgtaatattctcagtggggctgatgtgtgacttttgggacatagagcattcattcgttcagcagaccatgcagtatctcttccatttttttccccttatcagttaccacaaggtaagattatgtattcagtcacttaaaaacacttgcaaagtggatttttccccatttattcctatctaaccattggaataaatgttgacagtagtaaattaccatgtccctatttttgtgttcaacatgtctaagagaatggggagctaacttccagtaagggcagtacagtcagtcatgactctttctccatgtagcctgtgcattgtgcagtgatgatttatactttcagctaaatttagtgtctatgataagggatacatcagatgtttaagttcacttaatctcttttacagtgtgcattcaacaaggtgtatttgtgtcttatattagaatgaaatgcagatacaaccagaggtattctttcaacgtagagagagagagaaagcctttctttttacaagttttgaaaaaaagttattgtctatttttccttcatggtgcttgatttagattgccaggagtcatttctgaaggtatattaatacaatcaagaattaatgttcttaaaacttaaatttgttttttaatccttttctgaaaagtcatttctgaggatatatgtgccctgttggttttctgggcacttggatatcaaatcatttgggagtgataataagaaattggtacaaagtgtgaaattatcagatagaaagaaaaaagatgttatagtggaaaaaattactcatttatgattaaaaataatctcaaagtgatgactggaagtataaattcagatatttgaagaagaaatggaatgttgatagggttattgtattgaatcaacacatgcacacgtataaagaatgctccccaaaatggggacgcttagaggacaaataagttgattggattggttttaagaaaaatattgtttgtctttttaaaaagtaattgaaataacccttcttagtgaagaaaatgaaaactttgatggaagttcagcagaatggaatatttaaaaagattcaagagaaggatttttttattgcgaatccacaagggggtagtgatgttctttcaaagatatttgtggtggcaacaatgtgagatgatctcttcacattttagatttacagataaaactggcatgtttgcattttaacttaataagatcttctttttaaaatgtttattggcaaaattgtttattgcttaaattaaaaaaaatccattttgggtgaatggctactttaagccatatgaatggtaaagaagagagaatgtccttacagttttgtgctttggagaggtcaccaaggatgtgagggtcactgttattttctaagaatgtaataatcttaaattccctgggaaacattagacatctaggaatcagttacttaagtgtcctgaataaaaggattttagtaaattgtgtctaaactttacagaagtttgtattactagttgtattttcagtgctgccgagagatgaaaaatatgaacaatccatgccactagccacttttaatagttctaagtaaatcaaatttttataatcttttttattagtttatattacatcattagataaaggctttttttttgttttttttgtttttttgtttttttgttttttcttccctcacataaaaattcaggagctttcttctggtcactgagttccaccccatattattcagaattacttaaaatcaggtgtggtaggcctgtgctgggtcattttcagtggaggactgcctagctgtattatgcactcatttttgaaagttatgccgtgtggtgggagaaagatttaaagttggggggcggctgtgtcctacttatttagagacacaactagtcatcacctgtaacaaatgtgacttcttttaaaacttattttatcttacttttttttagagacagggtctcgctctgttgcccagactagagtgcagtagtgcaatccatagctcactgaagccttggcctcctgtgctgaaatgatcctcctgcctcagccccctgagtgactgggactacaggtgtgtgtcaccatggctgcttaggttttttttttctctttttcgtagaggtggggtcttgctgtattgcccaggctggtcttgaactcctggtctcaagcagtccgtctgcctcagcctcccgaagtgctgggatttacaagtgtgagctaccatgccctgcctaaaaaatattatttctaacaataacacaaaataattatgtggtttagaagttatgatagtttgtgccatatacattgtatatttttcatttttggtttgtggaaaaggttgttaattgagcttttctctttttttctccattccctcattctgagcaaggaatgactttttcttttatttcctttacgaaatgactttggtgttttaacattccagaagatacactgttttttatatgctactctaaactctgctgggaactgaactatgacgtcagcattttcattcatgaatctgattcttctaaatttttttcctgttttgtattcctgagctgacttctggcacatgcacaaatcagtttaccattagtcagcccataaatcactgataaaaggtaaaacaaaagataagatactggagttattttgatagtgctatagttctcatgctgatttgcatcagtacagtttggataaggtttctggctaaacagattgaaacctaaaaagtcaatttaattatctcatgattttgtgacttgaactgtgttgtgaacatattgacacaatatttttgttcttacaggaagttgagagtgctatgctatggctcctttgttataaaatagcatttcttttttttttttttttttttttttttggagacggtctcactgtgtcactcagtctggagtgcagtggcatgatctctctcggcttactgcagcctcgacttcttgggctcaggtgatccctcagcctcacaagtagctgggactacaggcacgcgccaccatgcctggctaatttttgtattttttgcggagatggagtttcgccgtgttgcccaggctggtctccaacttgtgaatgcaagtgatccacccactttggcctcccagagtgctgggattacaggcgtgagccactgagctggcctaaagtagcatttcttgtataatttgactaagttggaagattatataatgctttatttcagagaggttaggcctagagattaaatgatgttttattcaaattacctttgtaatggatttagatttttttttggagcattttcttgcctttgacatattttaaataacttcattgtttgatacttttattttaagatattattattgtggtggaactagcctagtattccttgtattggacttagggtgcatctaccctggattgtgcactcgtgtagctgttgactccggtttctcctctagggaggtcactgcttgcagttcagtactacgttagaacagttcttgaagaaatcttatttggagttttcttctgcaggccaaatttcaggctaagcctccggcccatagtatctttcaagcctgctgtagctgatgaatggtgagccgtaaaaaagtttattttctctactttcgtgggggatttgctgactttctggatactcaattgccaagaaacatttagaaataaaacgtgttatatttaggaatcatcattttagctaaataataatgcatgattagaattgatgattcaagctgcaaccactttgattgatacccagtcttactcttgagatcacttttttttctgagacagtcttgctttgtcacccagactggagtgtagtggcgtgatcttgtgtcactgcagcctccacttctcgggcctaagcagtcctcctgcctcagtcccccaagtgactgaggctataggtgcgtgccaccatgccaggctaatttttgtagagacggggttttgccctgttgtccaggctggtctcatactacagggctcaagtgatcctcctgcatcggcctcccaaagtgctgggatgacaagcatgaaccaccacgttcggctgagatgactttttattttttatttactgggtttttttttttttgagatggaatctagctctgtcacccaggctggagtgcagtggcatgatcttggctcaccgcaacctctgcctcctgtgttcaagcaattctcccacctcagcctcctgagtagctgggattacatgcatgcaccaccacgcctagctaatttttgttttttttagcagagacggggttttaccatgttggccaggctggtctcaaactcccgacctcagctgatctgcctgcctctgcctcccaaagtgctgggattacagacgtgagccaccgcgcctgtcttgagatgactttttaaatgccataacaactcacagatcctgtgtcctcccattcttaaatgaaactagagctttgtgttcctttaggttaaactaaattatctaataggtaacagaagagtggtctgttagctggctttctcctttcagtagatttgctaagagaaaggaaataaaagcaagtagactgtgaataaacattgaagatgacttaaatgacattgttttccctaataatgaaataatttatatattatttaaatataatttctataaaagaatctatttgcaagtgataatgaagaaaggaatttttttttttttttttgagacaaagtcttgctcttgtcccccaggctgcagtgcgatggcgcgatcttggttcattgcaacctccgccgccttggttcaagcgattctcctgcctcgccccccaagtagctaggattacaggtgctgaacaccacgctgggctaatttttgtatttttagttgagacaccatgttggccaggctggtcttgaactcctgacctcaggtgattcacccacctcggcctcccaaagtgctgggattacaggtgtgagctaccgcacccagcctaaaaaaggaatatttaatggtagagggctctgtaaaaaccccctaattttcaaagccatgtgccactgtagaatttatgaaaagttatgggctattattattaggtttcaaaaagtctggaatactggcggtagcatcagaattatttatttatttatcttttgagacagagtctatctctgtcgcccaggctagagtgcagtgatgcaagctccacttctcgagttcacgccattctcctgcctcagcctcttgggtagctgggaccacaggcgcccaccaccacacctggctaatttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctctatctcctgacctcatgatccgtccgcctctgcctcccaaagtgctcggattacagacgttagcctccacctccacgcctggctaaagcgttatcatttttatctaaccctgaaccaatcagtgattggttagttctctagctgtgaaggctttgcacttcctagacagcttgtagaacaagcccacttggattcccagctcaaactctttcctttttactatttatttattatttatttattcgttacttattattaattaaaaaaattttttagagacaagagtcttgatctgtcacccaggctagagtgccatcacagctcactgcaaccttgaactcttgggttcaagtgatcctcctgcctcagcctcctgagtagtgaggactacgggcgtgtgccaccacacccggctaattcttttttaattttatggagaaagggtcttgctatgttgcgcaggcttgtcttgtactcctggcctcaagcagtcatcctgtctcagcctcccaaagtgccaggcttacaggcatgagccgctgtgcctggcttgtactctttcactagctgggaatgctggtgagcaggactcaaggatcccagcagagctgcatcctgtgctgtctttgctgccacttaggtggaccaggagctagaagcctttctctccatggcctccataccttcttttaccagatggtatttctgcatttatcactcttgattccagcacagcttttcctcatcttgcttttctcagacctcagctcttatgtaatgagatagttggtagtcattttgaggggattcatgtgttgggtaaagggttttcctagcgatgacctcgaaagttccttcccattaataataattactattaataattaatagcaataactaatgataaaacagaacagttgcagcaatatactgtaataaaagttgtgtgaatgtggtctctctctctctctgattatcttattgtaccatactcacctatttttggaccttagttgaccgcttgtaactgaaaccatggataagagggggactattgtgtaaggaaatgaagtcggagatatggaatttcatttcagggcttgctttcctgatattcagctattctgtataactgtatcttttccttttgaggtccttgctccaggacaagaataatatgttgactcaagctgtatggggggatttgaactacagacactcagatatctcctttctgaggtacatagagggcttaattttttaggtctgtctgtttaatatactatatttactttaaaaaacgtaggccgggtgctgtggctcggtgcctataatctaagcactttgggaggccgagacgggaggattgctttagccctggagttcgagaccagcctgggcaacatagtgagaccttgtctctactaaaaatagaaaaaattagccagatgtgttggtgtgcgcctgtgatcccaggtacctgggaggctgaggttggaggattacttgagcccttgaggtcaaggctgcagtgagctacgatcacgccactgcactccagtctggatgacagagtgagatcctgtctcaaaacaaacaaaatgtaaaaaaatttaaatttattaaaaaagatgtacaacaccaaaatgttcatagttattctgtatgacagatctgaggtctttgttcagacatagatgagggttcatagttttggaaaatagacttaaataatatatgattacagatgaaaaatatttgctaacctcagactttttatgtttaaggtagtatttatattcatttagttgtactttctggagttgattaatataactgttattaaaatctatcgattcccagtaattcagtaaatgaagactcttcctatttagaaactcgtgtggattggggagttgctgtgggcccactgtcattgatcatatcacatcttcacttgaacctgctccctgggcctcctataggcctcgcgtttggagaggccgtgaacataatttatttttggaagtttctttcatttttaaagatactgagaggcaagttgaagttcctggtgttcgtgtaaacattccctgccttatcctttccatctcagccattatgaaatgttctggctgaatcatttgctttcacaaagctttgatgaaagtttcttcctcatttggttttcttgatagaggctgttgtgctaaaaagaaagctataacaagttagaagggtggagagtgggcacttaacatttttgaagtacttgtctttcttcctaggggtcctccagaaattgatcatagataacttgaccaaattcaaggcccagagatttcttccaggcattctgggagggaaggaacatcaggctttctgtactgaatctaattattctaaatatttcccactgcagcttgtatgagtgttttctgatgcaaatatggtgatagtggcgacctctctaactgggctaaatatccttgacagctttttatctgtcctctccaagtatttttagtctctttagcttctgtggccatgtctggaggaactgaggatggatttagctgctctggtgctgctccaagttgttgtgggtgctctttgctaccttcgtcactgtcctgccacagtcctgccactgatgaggctcctggcccttgtcatttgatgagggaacataaacacttgtttaataaaaataaaaaagtcatgattttcagaatgctttgaaaataagctatggctaatggtgatacacaataggaatgtccctaatttcactaaattgtatgctcaaaaagggttaaagtggtaaattttatgttatgcatattttgccacaattaaaaaaataaaaacttcaaatggatttgaagcttaatgagaaaactagttataatgtcctaacagtaaatatatggccaatattttcatgaccccaaggtgggaggctgtgccttaaataaactgtcagaatcacacattaaaaaaaaaaaaaagtgatggtaatcaggccctgaggttcatttatacagaaagtgatttttaggtgagattttaatatttgcaatatttatatttgtaaagaggattggctagctcattcagaaaagtctgaggttcttaataaacactaggaaacagatggtttggggttgatgtcagggaaggtaagcaggccgtgctttagattagagcacttttgattgcaagtcccatgagccacacagtttaggccaagtgaaagcagttttagtctaagaagagcagaagcaatcgtagcctctcgggacagaaactgaagtgcagctgggcagtgggaactggatctggagagtctggagtacatgtcttctctggagctgggctttttccattcacatgtagcttccttgcttgagttacatgtagtggccttagtcatggctcctgcatgtcctgactctagttccagtactcatcatcatctgactcccatttctatggctcagtacaaaaatattcaagactgggtattggactgactcctctcagccatttgctttgtttccataggccaggtgatcatctcactctggtcgactatgaaagaaggttggttagatccagcagcctgctgatcatttagagggtcttagagtgagaggagattgtgtgagaagctggttatcatagcagggggtcctggcacctcaaactctgtccccatcaaacagtgtaaaagaaaagatattgactcctaaaggagtgtcttatgttcagatgctatagagttttgcagagaaagtgttcagtgtagctacagatagaaggccaagtgtccttggtcagccagcctgggtgtgtgtggagtaagttagtggtaggtgtagtaactgtctcaaagctttttctttgtctctctctctctcttttttttttttgagacaaggtcttattctgtcgcccaggctggagtgcagtagcacaatttcagctcactgaagcctcgacagcctgggctcaagtgatcctcccacctcagccccccaagctgaggacttagctggaaaacacaggcatatgccacaacgcccggctgatttttatgtttttagtagagacaggggtttcattatgttgcctaggctggtcttgaactcttggccagctcaagcaatccacctgcctcagtctctcaaagggctgggattacaggcgtgagccaccgtgcccggccccagaactttttctttgaatagtggagaagcagaacaccttggaatgctatggtctgtgcggtctttgccctgtgggtgttctcaggtggaatcaggcagtttgggtgatgtcagtatcatttgaggtcttccacagttcagctatttgggtgggcttccccacttttccccttgttttgggtcggtaaacataaaaggatggagatgtgtatccttagtaagaatgggagacgttgccttcagaatgggtagaaagcagaaaacaagcggggaagaaaacagaaaacagcctctctttaagtgtatgtggctgcctgtgtgcacagtccttcaccttttccttagtatatccctcctgcctctgatctcttgttgttcttgatttttcatggtagaaggaggaaacaaaattatagaagacaggtggaatactgtgaaagaatagtagtttggagataactatgtaaagggctactagcctgcgcaccgttgaattctctgaatttacagctgtttagtcattgatgtttcatagtgttgaccttgagtaaattcagaaaagcaatactgagtatgttctgctaaacaaaagaggaaagtgtatgtttttaaagaaacaaccttcacagtggtttcagtagttacagggatttggttcttttttaaattattttatttctttttaaagatggtctcactctgtcatccaggctggagtgcagaggtgtgatcgtagctcactggcaccttgaattcctggactcaagtgatcctcctgcctcagactcccaagtggttaggagtacaggcatgtatcaccatgcctagctgattaaaatttttttttttttggccaggcatggtggctcacgcctgtaatcccagcactttgggaggctgaggcgggtggatctcctgaggtcaggagttccagaccagcttggccaacatgggtgaaaccccttctctactaaaaaaaatacaaaaagctgggcatggtggcgggtgccagtaatcctagctacttgggaggctgaggcaggagaatcagttgaacccgggaggcagaggttgcagtgtgtcgagattgtgccatcgcactccagcctgggaaacgagcgaaactctttttttttttttttttttttggtaaagacagggtctcaatatgttgcccaggctgatcttaaactcctggcctcaagtgatcctccagccttggcctcccgaagtgctgggattgcaggtataagccactgtgcccagcctgatttgttttttaataatagcttaagatgtaattcatatattataaaattaacccttttaaaatatataattgagtgggttttcttttgtatatttacatgtttcgtgcaactgtccccactctctaattccacattttcatcactccaaaaagaaaatctgtacccattagcagccactccctgttgcctcctcctcccggccctagtcaattactaatctgctttatttctttatgcatatttatgcctagtgtgaacatttcatataaatagaatcatgtagtgtttgtccttttgtgacttgactggcttatttcccttagcataatgttttcaaggtttttatctatgttgtatgtagcatgtactgttacttcatcccttttttaaaattaaaaaattttaaatttaatataatagagatgggggtctcgccatgttgccaggctggtcttgaactcctgggctcaagtgatccttctgcctcggactcccaagtgctgggattacaggtgtaaaccactacacctggccacttcactccttttatttttgaataatcctctgttgtgtggatatataccacattttgtttatccattcaccagttaatagacatttgagttattccactttttggctattaagaaaaatgctgctgtgaacatttgtgtacaagcttttatatggacatatgttttcatttctgttggaaagatacctaggagtggaattgtggtgtcgtagttaactctgtttaactttttgaggaactgttttccaaacttttccaaagtggttagatcatattacattcccaccagcaagtatgagagttgtaatttctccacattcttgcaaacacttgttattgtccatctttttgattatagccattgttgtagatgggaagtggtatattattgtggttttgatttgcatttccctagtgactaatgatgttgagcatctgttcatgagcttattagccatttgtatgtctgctttgacaaatgtctattcaaatcctcttccatttttgaattgagtcaattgaatttttgctgttcagttgtaggaattctttatatgtgttctagatatcagtcccttatcagatatgtgatttcaaatgtatgattgacatgtgatatgtgatttttctctgattctgtgtgggttgtcttttcgcttttgttttttgagagagggtctcattctgtcacccaggcaggagtgtagtgatgcagtcatgtctccctgcagtcttgcctgcctgggcttaagcggtcctcccaccttagtctcctgagcagctgggacttcaggggggcaccactggtctggctaatttagaaattttttaatagaaacggagtctctatattatattatgcccaggctggtcttgaactcctgggctcaagtgatcctcctgccttggcctcccaaaatgctgggattacaagtatgagctgctgtgctggcctttactttcttgatagtgtcctttgaagaacagaagttttaaatttgattgtgtcccatttatctgtttttttgtttttttttttggtcacttatgcttttggtatcataataagaaaccattgtcatatccaaggtcgtgaaggtttacacctgtgtttttttgttagagttctgtagttttagctctgacatttagttctctgatagatcttcagttaatttttgtacacagtgtgaggtaggcttccagcttcatttttttgcatgtggatattcagttgtcctagcccatttgttgaaaagaccattctttcctcactgaagtgtcttggcacccttgttgaaaatcaactgactataaatctgtgggtttatttttagagtcttgattctattccattgatctatatgtctatctttgtgccattaccacaatgtcttgattctgtagctttgtagtaagttttgaaatcaggaactgtcagtcctttaactctgttcttctttttcaagattgttttggctgtgctagctcccttgtatttccgtatgaatattaggatcagcttgttagtttccacagaagagacaactgagatataatggggattatattcaatctgaggatctatttggggagtttaaattcattttatggatttgctgtatgcttaggaagtcctggctaactcagacacccaagcatcttgccttaaaaacacaaaattttgttttaatttattgatgtagtaggctgccttggtgaaacactgtaattcactgttagactggaattggacttttcaggttctaagagagcaaacagctcttccacgtagcgtgtaggttgacttcctgtagtaaatgtttttttgatgtgaaagtttgctgataccttgcatgttttaaaaaaaatgtggtattctggttaatatacattctggttaatagagaactagcagattatatatatgaatatttatcaaagagttaggacatgttacaataaaattgtgacattaaaatttatataattgttattattactggaggaatcagaagatattttaggaccttgtagtcccgcaggggccacgtgaacattggttattgttatacttttaagtcacttcatttactcaacaaataacaaagtgcctatctgtgccaggcacaaggaaggacagacccagtctctgtccttatggagctaagggggagacggacattaatcaagatgccatatgaaatttcagctgggactcagtgctgtgaaggtgcgtgcaatatgtcataaagggatttgactaatctgcaaggttgggggaggcttcttgagagctctggaggaaaatgggaattaattgtgggaagaattaaggagaaaagttccaggtaattgggtgagtttgttagtgagttgtgtggagatactctggttatatcctgtttatcacttttgggaaagagtatctgaatacttggctctggcctttactctgtcccttaaatgccttgtggctgagcaggtactctttctgagcttgttcacatactgttttttaaatttctgtagccatttttatttacagatacttacatgaaaacatacagaaatctaggcttttggttgattgttttcatataattaaaaaatcattcactttgggaggccgaggcgggtggatcatgaggtcaggagatcgagaccatcctggctaacatggtgaaaccccgtctctactaaaaatacaaaaaattagctgagcgtggtggcacgtgcctgtagtctcagctacttgggaggctgaggcaggagaatcgcttgaatccaggaggcggaggttgcagtgagctgagatcgtgccactgcacttcagcctggaggacagagcaagacttcatctcaaaaaaaaaaaaaaaaaattatttctttgtgaccttccatggttagctatttagaactgctttagtggtaaattgaatacttttctgaacatttttcctagactttgaaattaggagtcatttctgtttacacatacttcagaagcctgtcagggacagagtctgtagtgacagaagtctgtagggaagcagatatggatgtaagtgattcaagacaagtcataatgctttaataaggctctggaagggaagatggaaagacttccgggaggaggtggaatttgacctgaaatcattgacgggcaaacatggtagttggaggagaaattccaagcagaggaaatggaacagaggcatagagccaagagagtacagggagtgggtggaattcatgtgcatatgggtaggtaagcctcggaaagtaggtaggggtcatgttgttaggggcctgaaagtcagaccgaagaatctggatttaattctctgctcaggagaggcttttagaagttttttttttttagtagaggaatggaattgattggataaagtcgattctcctgaaacaggtgctaataagggccacctagttacttctccagcttcctctctacagtcacgtcacattttttagactctgattgttccaaggtcccacagtgtctggtggttttaggcctcccacattgctgttgccttgatttagaagttgcacctgcctcaggaacacaggcacacacgctcacccatgctcttgctgactttctgtgtcttctgtgtttcagcttaaatgaaacttccaataggagaagccttcttgaccttgcccctcttttcagattggatcggatgcccttcctgtgtgcaccatagcactacgtggttttcctagtcatggcacattttagtttgcattggagttgcttgtttacttctctttctctctcaattagatgtgcatttctggaggtaagaggcttgagtacctagacttagtaaatgcttgttggctgaatgaatgaatgaatgaatgagcaaataggaaggactagagtcgggagaaaatcacttctggcaagagttgtctgtagaattggggtgaggaaagagctcgcatggctgaggagtgtgtgtgtcacacacacatgcaattttgtgactgactgaatgtgggccttgagggaaggtgactcctaggttttgaaccataactggggatttagtgaggccagactgagatagggaagacaaggcaggtatatttggggagaatggctgcaaaggtaccactgtttttcttcttcttctttttcttttttttttttttgagatggagtttcactcttgtcgcccaggctgcagtgcaatggcatggtctcagctcactgcaacatccacctctcaggttcaagcaattctcctgcctcagcctcccgagtagctgggattacaggcacccaccaccatgcctggctaattttcgtatttttagtagagacggggtttcaccatgttggccaggctggtcttgaactcctgacctcaggtgatccgctcaccttgacctcccaaagtgctaggattacagacgtgagccaccgcgcctggccggtatcgctgtttttaaggcgtcattgggtagctttagaatgtgtatatacagcgtgacattggagatgtgggtcaaagatcagggagtccttcatatcaccctgctttttttcttcattgttcttccagagggcaagggagggagccttggtgctggagtccttagaggtcagccccctgggcttggggcagggagagaagggctgtgaggaggtctggaggggcagatgcagtggcagcagcacagcacaaaaggtacagacagtacctttgcaaccaatgaatgaatcagttcaaaacaattagaagtcacagttgtgagtgagattggaaggggagcagagaaggggcctgagggcagaaatgtgatgaatgcttacattttaatgccaccagaggggagagaaccagtagaggctgagaaagaatggtcggagaggtaagggaacaagcagaatatgaattcagggttgctgagtgtggagggttgaaaggaggttgtcagtcgtaatgctgcagagttgagtagactgaagactaaggaagggtattggttttgtcaattcgataatgagagaataaaggagtagagatagggtggatgattatttcagaaccgtggtggcatatacagagtactggtagaaatgatggtgaaatgattgatccagtccaagatgagaaaagaaaccactgtggcctgatgggctgtgagtgtattagttatctatagctgctgtaaccaatcatcacaaacccagtggcttcaaacagcccagggtggaatctcctggttcccatgggtcaggcatttgggcagggcagggctgggtctgctggattgggactgctgaactgtggtcgaggtgctggccaggactgggctcaccttggaaacctctggtaggggaggatccacttccaggctcccttggccatttgaaggactcctttctttgggctgttgggctgagggctcagcttttcgccagctgttggcccgaggctaccctcaattcctgccccaggggcctctgcaacaccatagcttgcttcatcagagccaggagggacagtctctagcaagacagaagtcacagtctgcccattacctttgccatgttctgctggttagaagcaacttgctaggtccagcccacactccgggggagggggttacacaaagctgttaacagtggctgggcgcggtggctcatgcctgtaatcccagcagtttgggaggctgaggcaggcagatcacgaggtcaggagatcgagaccatctggctaacacggtgaaatcccgtctctactaaaaatacaaaaatttagccgggcgtggtggcggacacctgcagtcccagctactccggaggctgaggcaggagaatggcatgaacccggaggcggagcttgcagtgagctgagatcgtgccactgtactccagtctgggtgacagagcgagactccgtttcaaaaaaaaaagctgttaacatcaagaggtggggatcataggaggtccatcataaagtttgtcctccaccgtagaggggtggtgacgggattagaaggcattataacagttcttcaggtgaggccttggaggatgcagatggaaaaacgggagctttcagaggcggaagttttggaagtgcagttccagttgaaagttgggatagtcaggtggtgacgcttctcaggaggccttctgtgccctttgtcttcatgtgccttctatgtgctctctcctgttagacaaatgaacattctgtgttacagttgccaccgataaatccatctgtctggctaaaatggaattatttaccagccaattcctggccagtggaggtatctgccctcttgccttatggttttgttgaggatcaaatgaggtaattcatatgaagtgttttatagactacaaagtaatatgcaaacaaaaggtattaaacggtgctacctttttctctatgttaagtagaacccatggaatttaacttacattttccttaataacttgggttcattatgttgtatgtagcttattaaactgggctttatttaacactgtgatttgggtttttggagtagagagtttacttttatgataaatgaccccaaactgctatacctttcaaatccttgtgtcccatttttattgtttaaaaaaacaatctcaccttgccgttgcctgtcactcttttgcttctgtgtgtcagttttgagctacattttttcccctccgatttgttgcttctgatctctgggcttggcaacctgataatgaagcatattagagctgtgagtagttttatagtaatcaagctacgaatgtgggtcggagaaactcttctcacagtggagtacataagcttttgtgcatggacttcgtaaaattcacttttggccttcagagtgttcttggcttccttcctagttctggctgtgttcggattaagggaggttcccagatagccgacctccattccggggctgtggctgccattttcttggcgtccacctcattgctctgttacgagaaacagtgtcattctcttctttagttttgatgaggttttagttctttgggcagtagcaagtagtgataggtgatggtggtctgtggttcatggaccaaaaaatgtttgagaggcatggaggatctttagacaagatcaccttctaggtgtatgtggtagcattctgttccaccgctctcttctccttcaggatgtctccctcccagctaacctgctcggtgttcctcagtgggagcgtttgccttagctttctctcagagcatcgtacttactttttctgcccgcatttttgcattgctgctttgtggagaagcgttgctgcattattagggagagaaccgtgttttcttgtggaaatcacacagtagtatgggagaactggtctggttctaattctgccccgtcctagcttgtggcctttgcccagtgccttgttacccatgtcttggtgtctccatttctagaataggcttaatgtgtgctttgctaccttttaggatcgaaataagattttatatatgaaaatgcttgttatacgtacataatattgaatagaatgcctagtttgttgggttgattttgttgatattttacaatgctctctctgaggagttaaacaaaattatcattagtatgggtaacaataagtactactgaaacaatatcattttaaatgttatacagttttttttactgaatgtattctagttgaatctatttgtacaaatgtggacatttagtaagtgctctttgattattttcagactttgagtatactggcttccaagccaaattaaatttatgaaaattctaatgatactgtgattcatatctagaaagaataatttaaaaaaaactgtaaaatcactttaaacatgctttacgtgcatctctggtaatagagaatcaattaatctgatttctcaggccataaatctggcttgatatattgtaatattagttcctgtgtcagcctcttagaacttgaactgttttgtagtctgttccagctacttgtttgcttttgaactcaattctaggtgttgaactcaatttgagagcctaaaatggtttgtgccccaattaccttagaggttactgtttcatttttttatttagcctgccccaggagtaggaagtcggctacctaccagactttttccttttaacttgactgtatactttaatttttgtctctatcccatgggggagttgtgagggttattatagtatagtagcacttaatggcatattttaaacttcttgaaaagtggtaatatgtgagcacataatatttttgtactgtagcacataattttttcccacactaaccttttgtggttcagaaaaagaataaagttacttgggcttggggtacatgttgaattgcccatctcataaaatcgttaacctgattttagggagtgtctctgaaacatgtcttttgacagaccttgtgctgtttcttatttattattaataaattgatatttcatttattattcataaattaatactaattaaataattaattgtgctctagcccccagttttagtttggttttcttggtatctctgaaaactgttgagtattccccctactccttttaagtttttttttttttttaagcaggtttaaagtagcttttatcatattccttgatttctcaaatgaatagagggataaggttcctttctttaaaaatatctgcaacattgctggactgagaggtcgtatttacagttttttctttttaaaaattttttttagagatggggtcctgctctgttgtccaggctggagtgcagtggcacagctcacagctcactgcagccttgaactcctgggctcaaacagtcctcccgcctcagcctcccaggtagctgggactacaggttcgagccactgcttgttcagtctcttgcttttgtctcagtggcacagtaccaagacatagcaaatcaaagtgaccaagaggatgagtggcaattcggtggccttataggaagagatgtgcttgaaaacgacagaaggcttttagtaaattccaccaccatcaccaggacgagagacgggaccatttttcctttccataaacttaggggctggttattaatttatgaattctataagtaatttgagcttgtgttatgtaccagacattgtattaagtattaccagagatactgggaagaacaagccagacatcctttcaaggatgcatttgataaaatctcattttgagtatgttaggaaaatatttattggagaaggaaacctcctagattggttttagatcccgaatggccttagggattgaaaatggagttgtaggttagcagaggacatttctgaaaggagtaactattttgtaattaaaaagcagtttacagaagatactgtggcagagactgctagttgatcatgaaacccatctccttctcttcctcctcttcctgggcattttccagtcccccttggaatcgtgaccaaattctagccagtggggtgagagcaacgaagtgtgccacttccagacttggcccctgaaactcttgaggcatgggtatcatgccttttccttatctggcttgatgcagagggcctagtgacctagaaagtcttctgccacaaggtagaaggagcacaggcagcagagccactgctgtgagaacagtctgcccaccaggagcacctgttttggactttacctgagcaagaagtgaacatttttggtatttgagccattatacagttagcctccctaactatctaggcacgatgcctaggatgctaagcaaaactggactgagaggtcgtatctacagttttttctttttaaaaaatagtaaaggtgctaagtagtaaaggtgctaagattcaggcgcggctttaattctgtggagacctaaatattctttgtctttatttcaaagaacggtaaatacacttttcattatgctgtttctctgttccaaagcctgtaatcacttcttactatatagcatcttgtttcattaatccatcttccaaaaactctaatatatgtatatattatccatatacaatgaatgtgcctgtgtgtaacatcctgatctaggttctctgagtggagacaaaatgaataaaacatagtccatggcttcaaagagtttctgcttgatagccaggtagttactgaatttccatactgctatcatctgtcccttgttttaacctttaagtcatatattattttttcattacctttttttaaaagtattgtttcaattagatagtatactttttgaaaacagggaatatatattatagagctctgcatctctcctcttgggtatttcttttttttttttgagacggggtctcactctgttgcctaggctatagtgcagtagtgctgtcatggctcactgcaacctcgatctcccaggctcaagcaatccgcctgcctcagccttccatttagctgggactgcaggcacacagtaccacacctggctaatattttaatatttgtagagacagagtcttgccatgttgcccaggctggtattgaactcctgggcttaagcagtcctctcgccttggccttccaaagtgctgggattacaggtgtgagccaccatgcccagccttcttgggtacttccagcagaaactgggcactatacttgagtaaccatccctagagtttctactaattatcttgtgtggatattctggtatagttttgtattatgtactaacagatgaaagtactttttaaatcttctaggaattagtggaattatgctgttgaggaatgttaggattggaaggatcttttatagatcatttatctaattcctgatcttttagtttgatcatctggtttctgatactcaaggtgtggccattaattgcagcatgggcatcacctgggggcttgttagaggcagaatctcaggttctccctcagacctgtgaatcagaacttgcattgaaagaagatcctaagataacccgcatgcacattacatttggagaagttctgctcaaggtcaactactcatttgactcttgagaaaactggggaagtcagagagttgcccagtcatacaactgtttatttcagtggttctcaaccttggatacatcttgggatcacttggggacctttaaaaaaatactgaggcctgggtcccatccccagacattctgacgtaattggtttgggcatcagagttttggagatttcactagatgactggctaaggctgagaaccattgatttgattaatgatggaatccaggtttcttcatgctctaatcaagtattccttccactccaccatggctgtacattcagaaacaatgaaaaacatcctatcaaatttttacagtaatgcatcactccatttcatttcctttataggaatttacccctattggatagtgtcccatttaccatctgtcttccccccactagaatgtatctccaagaggacaggacccttgtctgtcttgttcagtgctgtgtcccagcttgcgaacagtgtctggtacatgttaggtgctcctttaatagttgtagaacaaatggaaggagctaccataaagaaggatgtgttctgtgagaggaaaacacaggctactctaaaggtaccctgtgggcgagaggcttcctgaagggtgaggggtctgagttgaagtgcagaatcagcgggggaggtgcttgaagacctgcttctgaggaaggacttgaacccagatctgacttgaaagcttgtgcttttccattccactgtgttgtcctgtggacacagtggctcactgatttgcccggacttcttagtagtgagtggtggactggaacacaccaccgcggctctgcaggtgcttaaggccagcccgcctccctctatggcagagccgccccagtattgcagacaggcgcctagagggagatcaaaacacgaagttgtcctgtgaaagttcctggcccagtgtttggcacaggggtatctagtacaaggtagccctttcttatcatggaagtttttttgtgctttggcttgttttgagaacctatggttttcaaagatagaatgacttgatttcagttttaactttggtttctttcctagttaactatggagacttcattatgcagtgctgtggagagagtgtgattggtttttgtctatgatatttctgtgtcatatgttattttagtgccaagttcttcctgttatttcagatattctgtcactgatttacttattgttagactttgaagttgggtataaaaatccttttttatgaagctattcattagtgtgtcccactgaaccaaagtgatttttaaaaacttttcacctaagaccattgttaagatatctcaaatggtaatcttataccgtcagtttttgataataggaagccaggaaatgttaagccttgaatgtaagacattatttttaacatcgtaaaatttcaagttttaattcagaaactaaattaaaatgaggtattacattcatgtgattagtgggctgttactggtgactcttaaagatgttacaagaagtcagcgtgctgctgacttttcccctattggagatcttcccatgaaccacttttcctaaggtatgatgattccatgctcacagtcatgggtagaaagtaatgttggattttccaaaggatacatgaattccgagccttgtctagtctatagggtgaatccttggacatgactgttaccacagatgttatcatagttaactactttttttgtttttgtgtcagggtctcattctgtcacccaagctagagtgcaatagcatggtcatggttcactttaggctcaaattcctggctcaagtgatcctcccacctcagtctcctgagtagctggggttacaggcgtgagccactgtgcctagctcagtatactactattggttaaattggagagggaaacagtcctagaacaagagttttacagaaatagaaaagaaagaattaaggagctcatggttatcctggtagctaggagtcacattatagagaaagactttatttatatggaccctgaaaacaatttgacttctgaagcacttgatcatgggcataagggagaggaaaattaataattcttggaagtcaactttagtcagattgcaacattttttggcataaaaaactcaggcgcggtgggtcatgcctgtaattccagcattttgggaggccgaggctggcagatcatttgaggtcaggagttcgagaccagcctggccaatatggtgaaaccccatctctactaaaaatacacaaattagccaggcatggtggcggacacctgtgatcccagctactcaggaggctgaggcaggagaatcacttgaacctgggaggcagaggttgcactgagctgagatcccaccactacactccagtctgggcaacagagtgagactccgtctcaaaacaaacaaacaaacaaataacaacaaataaataactcaggcaatcctgtttgttcttagaaaatgttaacattgttaaagctcaccctcattaactatggtaacaatagtgttttgtatttgggtggtacctttgaattgaaagcacttgggtatgtattacctaatcctcctcctgcctcagagagaaggagagagaagtatccacccgccctttttggatgaggtagtacagagaggttgaattactttcctaaggacagctagtaaatgttagaactgaactctttatattttattttaattaattaattttttgagacagggtttcactctgtcatccaggcgggagtgcagtggtgtgatcatggctcactgcagcctcaacttcccggattccagcaatcctcctacctcagtccccccaggtatctgggaccataggtgtgttgccaccatgcctggctaatttttgtatctttggtagaggtgaggttttgccatgttatccaggctggtctttaactcctaagctcaaataatccacccgcattggctccgcaaagtgttgggattacaggcatgagccaccacatttatttatttatttattattattatttttaaagatgaggccttgttctgttgcccaggctggagcaggagtgtagtggtgttatcatggttcactgcagccttaaaagtcctgggctcaagcgatcttcctaccacagcctcctgagtagctgagactacaggcacaagccaccatgcctggtagcttttaaatataaaatgttgagggtggttgttgaacttgtaaactatctttggttttctaagtgtataaatatgtggtttataatgtaggatgaataatctaaaattttatttaatactgcagccaaacaaaaaagatatttttaggactgaaaataattggccgtcaatattcaaaaaattttctttttttttaaaaagttaccgttgtgtaggttttaggtgaaatctttaattttatctgagtgaagcagcctgacagccagagaccttgtttctttcctgttaacggaattccccttgatttacttgccatgccataatactagttggcgctctgcacattttttgggtgagtcgggtgttgggtttattgttgggaaatggttaaaaatgttgttggtgttgactgagcttcaaaatgaatatgacattggttcttagcaaaaatttcctctatgtacagcacacatacttcccatttaaacaaattacacaagttatgcatgttcatcagcacagaccttttctcacatatgtatctaaaattttgaagcagccttaagcttgcagtgcaaagaacggtttccccctgagccatttgaggataaattgctgataagttccatcactctcaaatacttgatcatgtacttcctacaaacaagaacattctcctccataaccacaagaacagtaatcacaaccaggaagttaacactgagacattcctactctccagtcctaaagtcctgttgctgtttgccagttgatccagcaatggcctttgtagaaaaatatctaatcagaaccttgggtcataactggttgtctcttcaatctcttaatacagaagagttttcagtccttttagactttcatgaccttgacactcttgaggattgcaggccagtcattttgtggaatgttccttgatttggatttgtctgatgtttcctcatgattagattcaggttttgcatcttggcaggaatatcacagaagagccagattatatctttttgaaagattagttttacattttattttctgtttccttagagcgtttcccaaagtgtattctgcggaactagcacctactgtgttctcaacaccgtgccacctatagaaggtaggatttgaaaaagcttttgacttacaggaaggggtgggcttggcagtggcagtaattatcatctagtacagtggaaacagccttcagcccggactcagaagacctgggttctgcacttaactgctgtgtgatcttagatgagttacttaatccttctggggtagcaaaaagaatgctctcctcataaagtttctgtggagatgaaaaaaggcaaaagatttaatcacacggagaaatcaaagcacttaacaaatgtttgatactaatacaacacttctgtaattctagtgtccaataccaggtgacttagagtaggagcagtgtggtattttgggaaaagccacaggtcatgtttgaatcccagctgagccactcagcagctgtggatcttgggcaaattaatctgagcctcatgttcctcctctgtaaaatgggagtaattaagcccttgtgttttatcgtgaggattaaatgaaagagtgcaatgtaagatcctttctgggtgcctgatacacagtagagtcccacaagtgcttactccctaataaataatggaaaatagatttacttaatcacatgtacctccagttggaattgaatgaagtagaggaggagagaatgtcccaaaacccaaattgaagtgatggcttacagggctgctgtgccctcactttatctgttccctcatacatatttttagattgaaaatgtaaatgtagataaacagtgagaagtttattgaacctgagttatgatttgacctaagcctggacccgagattttgtaatatgatcaacaggaaaaaggtaaatctgggctacctaaaaatagaagcggtaagttgatcatcacacaactctaagaacaagaaggggattgttaaatagcaaaactaattatatttttctacttaaaaagctgttagtttctgtttctttaaccttttaaaaatcttttgtagaattactactgggtttaattcactttggagactttggaaaagaataatgcaaaatcagatcagtgtttggcacatagtgcttaattaatatgtattttggatatatggtgatttgaaggccttaggttagtaatggctgtatttgctgctgtgagcattatgctgacttgaatataacaatatatgtttatgttttcagttcctatcctactaattaaatctaagcacataataattagagctaaacagaaaattgtagagcttccttttgattttactactccatgttgttgatcaaagatattcccaataagatttagcaatttgatacactgttataccaaactgtttgaacagtttggtctagagtttgaaagattaatcgtaatcaacttgaatgaataacagtgttcatcattattcatagaaccaacattattttttattatgaatcaaagtaaaatgaatgtatcatttctagattagttaatatagttataatttaccttggcagaagtcacagaattttcgaaggaaaaggtcaaatacatttctttggatttaagtaaaggatttggcaatgtgaatctcatttttttgaaacaaaacatgaaaacagtaattctgctttttgtctaagtgaatgagcatttttttgcatattggaaagttatattatactacaccttgtaggttgactagaaaggatggttcgttctttagaattagagttgtcagtcaagcaaatcatctgtcattttcaagagcctcactagttatttttttattgtgaagtaggttagaaaattattttgtaaagtctaataccatacacatatattttgttagataatgataatgaagtgttttactgtcatttggttgacactcccacttttcagtgtcaaagttcaactatttgtattgaatactgaataatgcagtggaaaccagtatatgccttaattttactgttcactcaagatactattattaggatttgaaaactggtgcatgtgtttagttattttatcattcttagttatcccaaaacattaaaaagcagattttaatttaaaaacagatttttatgcagtatagccatgtaaagttcttttccagtgtaaaatcaaagtttctctgtatcccacttcacctgtagaaacactgaaatttaaaaatatgagttttaacattttgcctatttgaaattccagtaattcttttctcagtattaaactcgcaatccttataatgtagtaggaaaatttacccattgttatgtttcttaaaaacatccagtttatattcagcgtgaacctaaaattctggaaatggtacactttaaaaactgatcaaggggaacccactggccagtcatattcctgttccttttgactctgtggccacacctccgtgtaaagtgtaatgtttagaaactagattgagagagtgcttacacagccctgccctttggtcacatttaccactgcctgatttggtatcagagtggaagactgaagccttttctatagcagttaattgtgctgttgagaagagtacctttattacataaataccacacacacacacacacacacacacacacacaaacacacacacacgcacactctttatataccgcacagtagctgggttcctcgaagaggctaaaagaacagaaaattaacatcagattgtgatcacaaacatagaagctggggtttaaaactctgctcgtaagtgttcagaattgtacttcaaactgatagctttctcagagatatggctattcatatacaattcagagcaagcccatccattgagcaaccagtatagtgccgttttcataaaaggtacctgtaaatgttgaatatttgaattgagtatagattttagaatttcacctctattttcagaattgtacatatcatgggggattttaaaaaatggaaataaaagtactttaggggaagagagaagggaggtaaaggctcacgtgatctggtattctctgctttaaagttttatggcccgtggaacctccctcgggaggatgaagtgcagggagcataagcacataagattaccgaggttttatagtgtgtaattcatacagaactttctatgaactttcttttagttgaacagtttccttttggtttcacaggaagattttttgaaaggtttaatcttattttcctattaaattaaaatttgaaattcttgaaagcagtcagtttttaggtttttaaagtttttatactgcttatagaaatagaggatgggtattataattcaattggttatgtagttcatggaccaaaaaagatttagtatgccaaaactctcttaagttcatctccataaaatctttctatatgatgtagtaaattttttagactttatttctatgcccaatattttccttttaagatcttttccttgagaagaagtgtgttaatcagatgaaaaatgtttggagaggattttgtgaccttagaaaatattttttgttctttgatgtttttcatctgttcaaaaaaatagactgtactgaacaaagccgtagtaaataactggaaaaagatattgttgtatttcacttttaagattattaaccaatgcctgtatacttatgtaaggttgcttaattgtaaggcctattaagttatttaatgacagtaaattttatagggatttgtgtctggagaagaattagagataatctaatcttgttgatttgggaaaactgaaactattaagtaacttacccaaggtcacacaattagaaagtagcagaactgggccagatcttggactcttgactctgagttcagtgttataaaaccttattatatcatgaaaagttgtttcaactgtgacttactggagcaaattaagtctttgatgttttaatgtgcagctccttagtacctagttatgtgtaccctttgtatattggggatcttatgtagcataaaaagcctgggatgaataatttgtaactttgacctaaatgtgccaaagcttgtgagaaattttgagtcaggcaaagaaactttgttataggagtgaaaaaataaatgatatgtaagcaaacaaatgagtgaaataaatgttatataaaggaaatgatctcttctagaaatcatcaggtagactgattattaggtagtcagacataccatctagtctgaaagtaattattttttctctaactcatttagaagagttacattttgatgaaatacattaattatgtagatatgtatatgtaaatcaagttaattaaaatgatgattttatgttcagacctagaaaggccagcttctgtattacctgagtagctaactgcaggcttaaatcccttatatttataagatttgtgatttgcttttgaaaggataaatctcttttatagtctaggggatgaagtagtatttacgaacaaaatagtcatatattactataattcttcttacctaagaaacttaacattttttcaactgcttaataaaagatttttgggctttgtgaggttaattttataatttttatgtgcttcatcaaaacatggggaaagaaccttttaaaataactttcggttatgggcagctgcggggattttccctgttcactcacatgtcagggagcacaagcccgatcctgttttaaatcctcttgaccagattcctgctgccatcaatctgataaatgggtaaatgagtattattaactaagaggaatagtggggcctctgatgctcttggtctcacattgactaaactgagctgctatttctgactttgtcagtgtactttaaaggagattttatctattattttctctaaatttattgttttcttctttgtagatgatcatgggaacagcaatagtagtcatgtaaaaatctttttaccgaaaaagctgcttgaatgtctgccgaaatgttcaagtttaccaaaagagaggcaccgctggaacactaatgaggtagataagtttctttttttaagggtataattattttaagggcaaattttttaggttgcttcacatagtcctactttatgttagctttaaatttaaaatactgatctaggaaattgtaaatgacattatttaatctggatttgacagaaaccaaccaacatgttttttgatctgtctctgatctgcttggcttgcattgaaagatacacaatgtgcacgttgacttaactaaagtagcatgagtttctgtctgtgttttcttgcattttagtgtcttgcatttagtggttaaccctgcctgcatgccagttaaacgttagttgttatgtcttcatgaattaataaatatacagtcccactgttccacagaatgtgtagtgtcttgacaatgtgaatttttgtagagttggaaagggcaggtttcataggagtgaaacagcttttcgtcctttctaatgaagaaagtttgcttaatgctaagaatttttattaagattgaaggctgtacagtagattatgtatttagcatccaattagaaagtagatttatgaagtagaatgaaaaaagttaatcatcttggatgatgtttccttttttggtaaattttaatccaggagtcttactgttaggagtggattgctttgtcatcttttttattttgaaatctgaatatttcaatttaaggtaatacccgtttagtgtggtgatgagaattgggtatacgtccatcaatttgggagttatattcctttaattcagatggctggggttgctggttttgccaagttccatttgtgtgccttggctcaacattgatgtccaagttaaagcaaatttagcaccctatccttattggacactcagttctgttaaaagacacaagaagaaaatagtgctgcctattgagccttattttttaaagattctttggcgctaactacttcctgattcagaatgcttttgttttgcgtggtgggaggttatgtggataaaagtctctttccttatcacaggttagatttaaatactcactggaaccttacagctttgttaacttgtctcaactgattgtaaaattctttgaaggactctatgttttgatcattttcataaattacattttcccgtcagacagaatgtttttgctttgacaaatgtttgctagtttagaggcctgctgtttaaccagttatttattaactatttcagacatttttagacgtgaaaatgaagtagatatgcttaaaattagtcttaatcatagtttgttactctttcagcaaaatagtattatataatttggaagccatttaataagtcggaacttgattatgaattatttaaaaactcagtgtatttcttagtattccctgaaacgtagatttgataccaaattattatacacgttagttctagtttatttataaatgtaacccaacccataataagtatgtatttttccatattatatttcctgtggaattggcagcttatttattttattttttcccatggacccatgtcttgtggcagtttattttaactatgatttgacattatatttgaaaccagaaattgcttagtgaattaaaatcagtggcctgaagagtcttataaagctggatgtagcagtgctgggaatttagttggtagattatttccatcagtggcttcaaaactttttgaaacttttcagcataacccttcaactttcacatgtttaataaaacctctaaattatttacatgttgcaccttactagtatattagatacgttttaaagcatccgataaagaatttttatagaggatgagattaaaagaaaaaaatgagaagtttttccttattttctttctggacctcagtccacatactcccttggaggccagaggctgccataattcagattacagagaggaaaatgcatcccattctctcactggtgtaatgcaaatttgaggatctagatgggaaaacgtggattgttttgcatcagctatcactcatgctgaaatctaggtagaggagcgtatgttctgaagggtggaggcagcaggaggtggcacagctgatgggtgaagccatgcagcaccctttcccttgggatgggctgttctttcagttaattgtcagctcagctgacaaaagctcctatgagggaactgaatttacaggttgactcatttctctgtagaggaccttgacttttttcttgttttattttttggctttggaaaaatagaggaatattaagtgtgacagcgaagacttaccctacgaattgttaattctgcagaatgttatgtggcgatgataacctgctatttttttttttttaaactggctttggtaatataggtggaataaagcaatcagcggtgttactaaagcacttctttgatctagctgggaattggcattttcttacgttcttcagcctgccattcttcatgttgacatgaaaacctgaaggaaacgtagttcagtggacttgtttctcattggggctttgtggtcctatgtcatgctaaatcatatttagtcaaaattgcccgtgaaatcccttgacttgctcataaagtaaagtttagtcagactgcccttattaagagcccgttttccttccagagttggaatagatttctgtgttttggatgaggaccacatgaagtagttggcttgtatttagaagctgtgttgtacaaaaactctatttcttagatcccactgaaggggctcacactggaagaggcgtgtgggaatgcgcacagttgagagcacagtagatttgtgttttccatctcactccctgtacagcatatgttcacaaagtaagactggtggctcgagctgcctgtatgaaatgtcaactgtcatctttctctgttctccatgttcgtgtgtgctcgctcgctctctctgctggatgtgtacagttgaatttctgggtataatgtgactcctctatactaataaggaattcctttactcagacctgtgtttaaatatttgtgattgtttgaaaaaaccttttatactgtgtgtgttgtgagtgagattgtgctcattccatccttttttttttttttttttttttttgaggtggagtctcactctttcaccaggctggagtgcagtggcatgatcttggctcactgcaacctccgcctcccgggttcaagcggttctcctgcctcagtttcccaagtagctgggactacaggtgcgtgccaccatgcccagctaatttttgtatttttagtagagacagggttttaccatgttggccaggatggtctccatctcttgaccttgtgatccgcccacctcagcctcccaaagtgctgggattacaggcgtgaaccactgcacccggccccatcctaccatttattgagcacctgttctttactactgactgggtattttatataattatttgtaagccttaaaatagtattgcaaggtgggtaacatttccttttagagatgagggagtgtaggtagacagtagttattttttggtcaagagagcatacttgatagagcctgtctctgagcttaattgcatctgtgttgcttgttaattcttaggaactttcattctattgtttactctataggagtttaatcaaaggcctacaaacctaaactacagcaagtctattctgtaacgtagtttttttttttttttttttttttggagacagagtctcactctgttgcccaggctggaatgcagtggtgtcatctcagctccctgcaacctccacccctcaggttcaagtgattcttgtgctttagcctcctgggtggctgggattacaggcatgtgccaccacacctggataatttttgtattttataattttgtagagatggggtttcgccctgttggccaggctggtctcgaactcctgacctcaggtgatctacccgcttcagcctcccaaggtgctgggattacaggtgtgagccaccgttcctggcctgtaatgtagttttgaattaaaaagagttaatatagtcttaatattgtggattcatatgcaaatgtttggtgaagctgaaagtcactaaaaggaagactctaagaaggtaagagagatcgttggacctacttaagctacttttaaccttttctaacccattggaatacctaaaatcctttcccttcttggatgttatttgcaattgcagaataaattaaatgttacatctgaaaccaaatcaattttagattgtgctcccgcagccaccaatactggtcctcaggtggtaaagatgacacaaggagtgaaggtgatgatggctgcactaattatggaagccagtatgtattgaacatcctttgtatgctaggcactagtgagtcctttacatgaatcatcacatttaatctttcagttaatcctatgagatagattatttgactatccttatcttatagatgaggaaactgaagccatggatatgttaactaatgtacccgcagtcagagccgggaagtgggggacgggggagttcagccgctgcagcccgactttgagtcccataatccctcattttgtcccacagagcaatatcaagttgacttttccaagatcttgtagctatttagttctaatcctttcgttttatagaattgtttggcttcttcatctgattttaaaatgttgtaacaaagttaatctaattttgcattatgattttttaaaaagtggcagacactcatttcttaggaaagtagttttgattcctttttttaaaaaaagttttctcctacgtgtattttgatagttttgattctttttttatttatttattttttatttttttttttgagacggagtctcgctctgtcgcccaggctggagtgcagtggcgcgatctccgctcactgcaagctccgcctcccgggttcacgccattctcctgccgtagcctcccgcgtagctaggactacaggcgcccaccaccatgccgggctagttttttatatttttagtagagacggagtttcaccgtgttagccaggatggtcttgatctcctgatctcctgacctcgtgatccgcccgccttggtgtcccaaggtgctaggattacaggggtgagccaccgcacctggccttgtttttttttttttttgagatggagtctcactctgttacccaggctggagtgcaatgacgtgatctcagctcactgcaacctccacctcccgggttcaagcgattctcctgcctcagcctcctgtgtagctgtgattacaggcatgcgccaccatgcctggctaattttgtattcttagtagagacagggtttcaccatgttggttaggctggtctccaactcccgacctcaggtgatccgcctgcctcagcctcccaaagtgcttggattacaggcgtgagccacggcgcccagcttaaaacaatttattgaggtttaatttatgtattacaatataaactgcacccatttgaagtgcataattcaatgagtttttgacaagtgtatgctggtgaaactacctccaaaatcaagacacggcacatttctatcaccccataagtagcttgagagagtatttttttgtttgtttgttttgttttgtttttttgagatggagtctcactctgtcgcccaggctggagtgcagtggcgtgatctcggctcactgcaagctccacctcccaagttcacgctgttctcctgccttagcctcctgagtagctgggactacaggcacccgtcaccacgcccagccaattttttgtatttttagtagagatgggctttcaccgtgttggccaggatggtctcgatctcctgacctcatgatccgcccgcctcagcctcccaaagtgctgggattacggacgtgagccatcgcgcccggcccgatagttttgattcttaatgactattagtatgtggactatggatagtgaaaaaactatattaaaaatagaaattttgtacctgtgtgtaacttgagcattaagcctgacttttatattcagggcaagggagaaagaatgtattaaacacagagcacattcattaaagaacctactcttgtttcataatcagtttggtgttcacatcttcatcaggtgaactgctataaggtttctgcattttaagttagtatttttaaggcctagagccagaaataattatgctaacacaactgtctgaattcacaaatgactatttcataattacgtatattagtactccatatatgttgtccagactgaaaattgttttgtttagtcattaattagctgtttgacttaaaatataactactgcattccctagtctctggatctagatttcacttggcattcttccaaagccaaactaatgcagcaccatgaaccttttataatgaaaatgttctccctaaatatgttcaaatcacttttgtgtgttactatttttgaactaatgttctttttttgtttttcctgtaatacacagtttctctagagtaagcaaacaaaatagaattctagtttgtactgatccttaaagaaagtttcatcagatgtttttagttggtggtagctttagagtgtcatattaaatgcattttttaatggtaaaaatgtctatgtagagagcagtataggttgatacattctaagccacaccaaagcgtctgcaggagaaaaaacaaaacaaaacttgagtaataattataatgctttttataggaggaaacttactctttaaaaatcttgagtactttttccccctaactttttatatttaggtaagaaaaatggcctttaacactgtaagaattattaaataataattaatttcaactgtttttaacatcaagccaccttatttttttttattttttttttttgagacagagtctcattctgtcacccagactggagtgcagtggcacaatcttggctcactgcaacctccacctcctgggctgaagcaatcctcccatgtcagcttctgaagtagctgggattataggtgctcgccaccacggacctggctaattttttgtagagacagggtttcaccatgttgccaaggcccatccaaacaactgagctcaagcaatctgcttgccttggcccctcaaagtgctgggattacaggtgtgagccactgtgcctggttaccttaccttttaaaaaatttatttagtctttttttggtgtcgatacataatcttgagtgtttcttgtgtttttaattttttttcctttgtgtaactttgtgttaggtttagggctgtaatttttcagtgattggtttttctagtgtatttatatgttatctctttgaaatatagacacacattttggggggatcatttaagactcttcagacttcctaaatgtgagctaagctgaaaagcaccagtactctaatcataaaggcaggtgagatatttcagttttgatggcgtggaaagtcagttaacctttaggtagggcttggttttgtttagcttttggcagggctagtggtttgaacggtcccagattattttgttccaggcagggcttttctgattaaattgcaaaaatgaaaatgcatataaacaacacagagagccaagttttaagagtgacattatgtgatttttgaacacagtatatagtacgaagtttcaaattaaaagtgatacttgtgtagcagttaggttaaatatagttcctctgtttgctttgctagtgtgaagtgagatacatgatactgaaatacaggtaggcacaagcctggagatcaggcagcctgtgtcaagtgtgcagtgcctcagcagcagcagcagcagcagcactccacaggatatattgaaaagctggggcggaatgtcctcccacacaggtgaggggagacaggtgaaggcaggtttgacactgaggaatagtaagagaagtaaattgcaccctcagagtacagcaatatttatagcatttgaataagatgttaaagaacattttcttttaaggaagaaattcctgtgggtcttcctcagtttcaatctaaactagttttattatactattacttcagcatgtggcacttaacctggccatagtcagtgttcaataaatatttgttggatgaattaacgtaaaaacacaaaaaactcagtataaaattaattcttggagttcttttgcaaatataaaactcagatatatgcattacataaaaagaaaatacaaaactaataaagttttatattaacagggttagttaaatgcaatagatgatgttttgccaaaactaaattgtctcgcaacatgagtatcatactgactgttctcaagcaggttcttttgaatttggcatgcggtactatcttgtgtcctgcaattattttatactgagaagctgttttttacatatcaagcatttgtataagtctgtcattaagccttggcacaaatacatcatttagttttaaattcacttctggtttttctcattagcccaagaaaaatttaaatgacactactgggtactaggggaaacgtaaccacaaatcacaaacttgagcaatgagtttgtgtgttagaacatactcggttcaggtgttactttttcagattatacattaaattaagatgcaaagttaaaaattttatatggacttacagccccttgataatacttccacagagccgcagttgagaaacactgctctcttggaaagggtgcagagctggtgtcagaagcagattcgagtcttggctctgccgctactcagctgagtgttgggtaaggcacttaacctacttggcctctcttgggtcttaggtgatggcgcttggtgacctttgaagatttgtctttgaagattattgttgcttttgaaggttttctttaggaatgttggactttccagggaggcttgggtccagcttcggagtttatttgattaattttttttttttttttactgttaatcatctttttacttacttttaagttgtacaattcagtagttgtttatttttatttataaatttaaaaatttattttttaatttttattttattttttgtttttttttttaaaaccagaacatttactgcatgactaattgttgaaattcttaagctgatcaaagtgctccaacagctgccctctttggtttaggtgttgtttcctcacggagtccatgcctgaatctgtggtgtacaatttttaggtgcctcgttcggccagtcctggtggcattttgtcttttagccttggcactccagttatacgtcctcctgcacttggcggggtagccacatttgccacaggtcaacttctgaaggtggtaggccttcacgccacagcggtggcacaatgtgtgtgtcctattgcaacactttccaaacggtcatctcacttctgtggctgagaccagagagacctttttaatttttttttttgagacagagtcgtgctctgttgtcctggctggagtgtagtggcgcaatcataacttaccgcagcctcgaccttccgggctcaagctatcctcccacctcagccttctgagtagctgggtctataggcgtgtgccacgcccagctaatttatacattgtttttggagatggaatctcgctcgccatgttgcccaggctggtcttgaactcctgggctcaagcagtcttcctgcctcagcctcccaaagtgctgggattatgggtgggagctcccgcccacactcggccaattcagtagtttttaatacatctacaaagttgtgtagccatcgccactacctaagttcagaacatttttcatcaccccgcagccttctggactgagtggagtcagcatgctcaggggttggcagcatctgttcagggggctcgaggttcttctttggtgtcttttcaagtttctatacctgtccagtactgaagctggaattggagattgaccttttgtccaagtcataacttaatatgctatttcctgaaactgcttttaagaaatgttaaggtgcaaatgaggatccagtttgggcccacatttttctaagttggatgaagagcagttgagtggagtttctagttgcactcgagactctgtactgtgcagacagtttattggtggagttgcctcaggataaaaatacccagctcttctcagtagtgggtgggagactttgggtgatggtgatttccgtaaaggagaagctgagcctggttggaaggaaaaaggaagaatatacggagaggctggcattctttagctgagtggatttaggcttgagctggagtcagaatcacctgggaggcttgttcaaacacagattgctgggccccatccccagagtttctgttccagtaggtcctgggtggggcctgaggatgtgcatttctaacaagtgcccaggtgaaagctcacttagaggaagaatctcagcctcctggaagtgtgttctaattaacttcactggactgtaggctcagctttgccatccccataccactcatgcatgttttggtgtgctttggctacataggttacagttgagctttctagagcttttttctcatgtctttagctagtaggcacctaaaagttgtagaatgcataggttttatttttggcatttatctgaagtatctgttcatgtcttgacatataggaagctcttttaaagtttgggtggcagtggagagggcatatagaagcatattctaatttttcaatgttttttgaaagggtagcatgaacaatagtctccccactccttcttcatatccgtttggctcaagtagctgaaaacagcagaaccttaaagctgagtgtcacagtctgcctgcctacctgcctgtctacctgtctacctgcctatccagctacctgcctacccaccttcaagtcttttcgaatactgcctaccccaggtttctgatgataaattctgttatcttggtaattatgaagttattttgaaggttttaaaagaagctcctaaaaaataacctaagttttacagtattagtgcttttagaaagctggaaaagcaagtgaagaaacaacaaaaagaaatcctttctagatggatgagaaaccacagatgggttggggtgaatgcgatgaaatagaaatgtgtgtttgggagagtgttttctctgtaaggaagaatattctctgtaaggaaggcaggctatgtggctttcatgaggtcttcttagaagcttctgtggtaatgttcactggtctggcgaagggggtagacttgaaaaaattgtaaaatggcgagaacctggaatttacatttggggagaaaagaaactgggaggcccttcagctctggggaattggacaaggtgaagcagagtccacatgtgtgtgtatgtgtgtgtatgtgtgtgtgcatgtgcgcgtatgtgcatgcatgtgcactcatccaggtggggcgtctgcggtagcaccgaggtggattctgaggcaagcttcatttggccctgagttcattttattgtgactccaaaggagttcatgggggaaataaaggctctcatgtgcaagaaacaaggaagcagaaaagtcatttgacctaggctagaaaaggcggccacctctagtctatagtcagaagagaagcagctgttcagaggggctgagacaggtaatgctggtcccaggccaagcctcttgaggaaagagaacaacattccgaaattctgtgagtagctcataccctgaaggagttcttttttttttttttttgagatggagtctctgttgcataggctggagtgcagtggcgcaatctcggctcactgcaatctccgctcactgcaatctccgccacccgggttcatgccattctcctgcctcagcctcccaagcagctgggactacaggcacgcgccaccatacccggctaatttttttgtatttttttagtagagatggggtttcactgtgttagccaggatgggctcgatctcctgacctcgtgatccacccgcctcggcctcccaaagtgctgggattacaggcgtgagccaccgtgcctggcaggagttcccttttaagatcgctgtaggaagagtcagaaggtcaaggacaaggcgccgaggtgcctaccctcttagtactttgtgttggggagtggaggctgtccagagaggctggccaaggggaggctccccctgggaagatggggatcttttttaggtggtgctgcaaagggacactttttcagagagacaaggggaaaacactcgcatatatttacttctttagaagttgagaaagttaaaagaatgggaagatgccatctgcttcccatttctgagaaagggtacattaaaatagcttgaaattaagcagaatgtataaaattaacgtctgagtatagtcatttcccgtttttcctgacacatctttcagctgtgtagcaacagatccgcattcctggtgtcagaagacagttgttaatgtgctagttaaaattttattttatttttgtactgttgagcaaaatttagacttaactctgttttatttaagaagcatttttgttaaatgctttaattattattaatcaaatttttttgtatttaagcagttttcaacaatctattcctcaagcaattcagagaacctgctgtgtggtgattatgtattttttatttcataaatgggggtagtgaggcataagtgttttggaattagcatttgtcatcatctaatatactgtgtaaattacatcttttcactgtgtattgtctggctgccactgctagactcttaagttccaggtggacagggatcttatgccaggtggacatggcatacatgtatgtatggcaggcactgttctaagtatatacaatagtccctggagtgtccagggactgttcattgaatgaatgagtaaagacttctgtcaacaaatatcatttagtctagtgctcaagtgggctgtaatactctgtttctgaattaaacagtctggcttggtgatagtcactgacagcaccaagcagatccatgggagctaccccagaaaagcttgtgatgcagaggagaggagcaaaatgtgcgctccctgtgtgcaaatggattcccacaaccacggaaggaagaactgcggcagacatgcttggttcttaatctcagactcatcagtcagggaattcactcctgtctaaggggcgagtgagggtgaggcaggaagccagcatgtcccctgtgaaggagctctttccaggtagaagcatgaagcccaggaaaggcaatttatacagcacatcaccaatagagagatggccaaaccactctgaactctaccatctgaagtgaacaatttctaattatgtatcttcagatttttttctttcagatttctttctgatatatgtatctacagatatttctctgtgccggtgtgggcattttttctatatttattaacccagaataggtttactgtacatgtagttctataacctggcttttctcttaatatgttatatatctgttaggcattttttgacagtgatccacagcatcatgtttgtttcttgattgactgagacagattctctctctgtcacccaggctggagtgcaatggtgcgattatagctcactgcagcttcaaattcctggacccaagagatcctcctgcctcagcctcctgaatggttaggactacaggcatgggacaccatgcctggcaacgttttttattttttgtggagacaggatcttgctgtcttgcccaggctggtcttgaattcctggcctcaaatgatcctcttgcctcagcctcccaaagtgctgggattacaggtgtgagccatcgtgctcagccaacattatgtttatcgactgtttattaatgttccatttaattttggctgggtatggtggctcacgcctgtaatctcagcactttgggaggctgaggcgggcagatcacaaggtcgggagatcgataccatcctggctaacatggtgaaaccctgttcctactaaaaatacaataaattagctgggcatggtggcatgtgcctgtaatcccagctactcgggaggctgaggcaggagaatcacttgaacccgggaggcagaggttgcagtgagtcgagatcgtgccactgcactccagcctgggcgacagagcgagactctcttaaaaaaacaaaaaacaaaaaacaaaaaacccccccaaaattccatttaatttaatgccatcatttatgcattcagcaatatttttgagggcctactatgtgccaggcactagttggagttgctgagggtataagatgaggttccaattctcatggagcttatcgtttagagggaaaacaatacaaaagtaaacaagtaggtgaggatttctgagtgtgctaagaacaaagtagagcagggtactgaggtgtgagcacatcagtagatttcgtaggaaaggcctttcttaggaagttatatttgagctgagaactgaatgataaaggaaagccagctacttgagtatctgggggaggaatattctaggcaaaggtaatagcctgtgcaaaggccctgaggcaggaatgtgcttgctttgaggaaatgtgaaaaaaaaagttgttgattggaacagtgtggggatctggcagatgagctgggtgaggtaggtaagggctagatcttgttgtgccaagtaggcataaagagttgagattttgggtcgggcacagtggctcacgcctgtaatcccagtactctgggaggccgaggtgggcagatcacctgaggtcaggagttcaagaccagcgtgaccaacatgatgaaaccccatctctactaaaaatacaaaattagccgggcgtggtggcacatgcctgtaatcccagctactcggaggctgaggcaggagaattgcttgaacctgggaggcagaggttgcagtgagtcgagatcgtgccattgcactccagcctgggcaacaagagcggaacaccgtctcaaaaaaaaaagagttgagattttgttttaagggcaacatgaagttattggaggatgagctattaggaagtgagcaacataatatgaagctttatgttcaaaggctttcttggctactgtgtggcagtcaggggaagcagagagaccagttaagagtctgttgcgataactggtgatcttggtaagaaatgacggtgggggtggagggagtgagaagtggatgtatttcagaggtggagctgtcaattcatgggattggatgtagggggtaaaggaaaggagaaattttgtggcctcagctactgcgttggtgctggggctcgtcagtgagacaaggaagtggagattaagagtgttcttctgggatgtcctggttgtgagatgtctgttagacaccagagtgatgatgttgaataggcaacttccataagtctggggagaggtcctgtctggagataaaaattggagagccgtcaatgcgcaggtgacatttaaagccatagactaggtgagatcacctgggatgcagaagatagatggagaaagggagactaagccccgagcagtgcaggaggagccagcacaggaggctgcaggggagccagggaggcagtgctgaggcaggcaggtgtgaagtggaagccaggagaaggacatgttttaaggagggtgcgtcacttttatgtttgctactgtaaccagttatcacaaatttagtggcttaaaacaacacagatttcttaactgttctgtaggtcagtcatctgacatgggtctcactgggttgccatcagggtgccagcagggccatgttctttatggaggccctagagaggaatctgtttccttgtttgttccaccttctagagtctgcttaatgttccttggcttgtggctccctccttcatccttgatgccagcgacgtagagtctttgtgaccctgctctcttctcattcactcaccctgacctcttctgcctctttcttccacttttaaggacccttttaattacgccgagtccacctggataatccaggataattttcctattttaaggtcagctgattaacaacctaaattctatcttcagccttaattcccctttgccttgtgatgttatttatttacaggttctggggattagggtgtgtatatctttggggttcctgttcttcctttcacagagggtatcacaaaggttactgggaagttggataaaatgaggacggagaagtcattgttggatttggtcaactgattagtaacctcaatgggtggttccagtggagtgttggtgcggtggcccaatgggagtgagttgaagagccagcgaggtgaggacgtggaggctacacatcttaatggttcttggtggcagttttgctttgaaggaaagtaaatagtggcaagaattacaaaggaaaagcacagaggacagctctgagaggatgaaatgggagacggaatgtggaacagaggttcagggacgactgctggaaggaaggggcattagtgtagtgtctactggaagagattaactggatgaagaacctggagtgaaaccaagaaatggtttatagggatggggacatatgaaagtgaaattcacagggttatttttaatagaacagcagaaggtactgatgactcctgttgcttgcgcctgggtcagtggacaggatccttgtcagcagccactacagggcccgcaagcccacctcagatgctgtcattccacgggtggtggccaaatctttgaagtcagtgtagaacctctgccctttcttcctggggagcctggatcagccatgatcttgcccagactcagcgccatggtggagggacatctcctttcctctcctgccccccaaccacttcccttacacttctgctcttctctcctcacccgctaaattgtaggcctgcctccatttctttctttactttgttacgttttaataacatttattcactccacaacatgctcacagaggtggaagaccaagttagtgcagacccattcattcctggacccagtggctctcaagtgggagaggtgctggtcttaaagggtgtttaggaacaagtgggcgtcatagtgagtgtaaaaacgccctcgccgtgaggctcagaagagccaggcctcctcctgctcctagtccagtcagtgctcctccttcatatgggtggttcgcagccctgctgcatgttagactcaccaggacagatttgtaaacatatcacgacctgggccctaccacaaactaattcaactggagtctcagggatagggcccaaactgaggattttaaaaagctccctaggagattctgaagtgcagccagggctaagaactacagccttaaatctactgttgactgctttcaaaagaagtcttcactgtgcttaaacaaattgtggttaaaagtaagcaaaagggccaggcgtggcggctcatacctgtaaatcccagcactttgggaggccgaggcaggtggatcacctgaggtcaggagttcgagaccagcctggccaacatggtgaaaccacgtctctattaaaaatacaagaaaattagctgggcatggtggtgcatgcctgtaatcccagctactcgggaggccaaggcaggagaattgcttgaacccgggaggtggaggttgcagtgagctgaggtcgtgccattgcactccagcctgggtgacaagagcaagtctccatctcaaaaaaaaaaaagaaggaagcaaaaggaaatctggaggggaacatttgtaataggcaagtggtcattattaaatgtacagttatattattaaaatgtagatcatttgaatcaactgacacgtctgaatttggattaaaactcctaagcagtatacggtactcaaagcttggtactggtagggcacagtttgttcatttctgtttttcacgttgccttctttacacttttttcctttctgaatagcctaatatgacgaagcagctatttgtaacatgtgggaattattttttcttcttttcctcccatagtctgtctccatctttgagctgctgttctttctacagcttaaggttcttagatgtccattccattccctacccagtcttggaacactgtgagatgagcattcctgataagtggtcatccaatttggaaagacagtattttacaaggtgatcagtttctgaggaatttcagttagaaaactttgtgtttttggtttggtcagggaaagatccagaaaagtgatcaagaggttagctcaaacctgatatagggagttctcagaatagagattggctgttaatggtctcttataattttttccttgaggatagttttattagtatgagagtaacttaaccatcctcattgtgcagttcttccgcctcagtctcccaggtagctgggattacaggcacgcaccaccatgccctgctaattttagtatttttagtagaggcagggtttcaccatgttggccaggctggtctcaaagtcctgatctcaggtgatccacctgcctcagcttcccaaagtgctgggattataggcatgagccactgcgcccggccccaaacttttttataattctctatgacattgacatactcccacaacagcttcagtataatttagatgcccttatacatctgcgtggccaaattaaaaaagacaccatcaggtgtcagcaagaaacagagcagggggagctttcatgtactgctgatgggaatctacattagtttaaccactttgggaaactagaattatctatgagagtggaagatttgcacaccataaagcccagcagttctactccttatgtatattcttgacagactgtatagctgtgaaaactaatgaattgatgaatattcaagaagtgagtaactctcacaaacataatgttgagagaaagaaaccagacactcagaatatatattgtttgattctgtatacaggttcaaaacaaaggcaaaattaatttatggtgttgcaagtcaggagatgtagttacctttggagagtagggaggatatattagcagggcttctggggtgttggtaatgttctttcttgatgacaggtgtgatacacatgcacacatacacacaaatatatttacaatttgtgctgtttcctgtttgtatataatattttaataaaaagttcactgaaatggggctgggcacagtggctcgcgccagtaatcccagcactttgggaggctgaggcaggcagatgctggagcccaggagttcaagaccagcctgggcaacatgacaaaaccattgcattacaaaaaaaaaaaaaaaaaaaatgcaaaaattagcccagcatagaggtgcgtgcctgtagtcccagctacttgggagcctgaggtgggagaattgcttgggcctgggaggtggaggttgtggtgagctgagattgtgccactacactccagcttgggtgacagagtgagagagaccctgtgtccaaaaaaaaaaaaaaaaaaaaaaaagtttactgaaatggtatatggtgtagagtagattattgaacagcagtgagaaatgagcaaaatacagctacatgcagcaccatagaagaagattctcacagaatacatacgatcagattctagttttctaaagttcaaagagtcaatgctaagctattgtttaaggacacataagtaactcgtggatatcagtcaggattcagtcagggaagcagaaccactgtattatgtaataagggatttattttttatagcaataagatattttacaactgtggggaaaagctggaaaaatgacagtctggaaggaagaattagaggaccagagaagagccacgaaagcacctctcctgaagcacctgtacgggtggctgagttagaacttgtgggaggctctgagaagccaggcatgagcagctgctagaacgggaccacaaaggaaagctgatgaaaaagtctatgaaaagctattacctctgcatagcaatcacttctctaggtctgctggccagcagctgatggtccaggggcttctgttcgctgacaaggccggcagttgggggaaaaagctagtgacagaagcagcacgtggacaagctggaaccctctggcatctccgtttatatctgctaccacctctaactacctcggccctcaggaagtaatggtggttttacttttcgctttttaaatcttgtccagattcagggaagggaatcctgagaaaattctagcctaaccaaattgagttaaaagctgcaatagtgatggttgcacaactctgtgcatatattaaaaaatatactttaagtgagtggactttatgatttgtgaattatatctcaataaagctgttatttacttaaacaaaactgccacatgttgaaaactttaaagaaacaatgttaccatggatgatttaagtgctgcttcttggagatatggaagtttcagtttagtaattgcttcttagcaggttgtatctatgttactctacactgctattctttggaaagctagagcgtagtaactaagatctgtttgttaatgacagacctcaaggtctcctgacaggtctgggaataagttttgaaaataggttaatgggatattgtattagtccgttctcatgctcctagtaaagacatacctgagactggataatttataaaggaaagaggtttaatggactcacaattccacatggctggggaggcctcacaatcatggcagaaggcaaaggagaagcaaaggcatgtcatacatggcagacgagagaatgtgcaggggaactcccgtttataaaaccatcagatctcttgagactcattcactaccatgagaacaatatgggggaaacagtccccatgattcaattatctccacctggccccgcccttgacacatgggaattattacagttcaaggtgagatttgggtggggacacagccaaaccatataagatacattttctcacttttcaccatgtatatttggttttaaaatttgaactaggatttctttacttatacttaaaagtaggttttacagattcattaaaactttcatatcaaatctgttttgataatctgagatattctcatcatctcaaactattggaaaatgcccttatctactctccatttacgtggagccacttttcatttgaatgtttgttatggctctttttattctctttataaggagacaattgcccaaataaagatatgcagctttcctgcctggggctgtagttgtaccatagtaaggaaatggatatgaaggttttttaaaaagttcaaaaacagagtagcttgtatcatttatatgcaaaaactagaaacatttttagctgtagttacgaagacttctagctttttgtcaactttttaactaaaaggagtcccaaaacacaggttatttctacatggattaaatttataataataaagaatcattagtattactaaaccatattgacagaattcttgctaaaactaggctagacagacaaggatggatactgaaggttgacactgaagacctagttgggaagaggattcagaggagcttggctagagtttggtcaaggagacactcttggtcagtatgtaagtctggctaattggaagtaaataaaaggcagccatagtcttggagggaagacagacataaaaaatgattgcaatatggtataaaaggtataatagaattataaagtatgtgtgtataagatgtatctgcggcaaaaaggagcagtgatggtctgcttgagcacatgaaggatggatttttttttttttttggagacggaatcttgctctatctcccaggctggagtgcagtggcgccatcttggctcactgcaacctctgcctcctgggttcaagctgttcttttgcctcagcctaccgagtagctgggattataggcttgtgccactgcgcctggcttatttttctactttttagtagagatggggttttgctgtgttggtcaggcatgtctcgaactcctggcctcaagtgaaggatggattttttttttaaaaatgacactaaagctgtattttgaagatgattagaaagtttgctaggcagacaaagagaatcagcaagaaaactttctgggctgaaggtactacgtttagtcaaactattaatacttcctttcctgtgcaaaggaacggaagaaggaagtagtttgagttgcttggataattcgctatggctagtttagggtttaaggagagagatggatgagttaaggttagagagtagcagctagatcatagaaggctatgtatgccacgttgcgtttaaattttgtttttttttttttgagacagagtcttaccctgtcacccaagctggagtgcagtggtgtgatttcggctgactgcaacctctgcctcctgggttcaagcaattcttcctgcctcagcctccctagtagctgggattacaggcatgcactgccacccccagctaacttttttttttttttgagatggagtccccctctgtcacccaggctggagtacagtggcgggatctctgctcactgcaacctccgtctcccgggttcaagtgattcttctgtctcagcctcctgagtagctgggattacaggcacgcatgtggcacccagctaatttttttttttttttgtatttttagtagagacggggtttcagcatgttggtcaggctggtcttgaactcctgacctcgtaatctgcctgcctcagcctcccaaagtgctgggattacaggtatgagcctccgcgcctggcctaagatttttatttctagtagaaaaagagtttcaccatagtgaccaggctggtctcaaactcttgaccacaggtgatccacccacctcaccagtgtgccaggattacaggcatgagccaccacaccagcctgggtttacattttaacagatttttttgttgttgttttctttgaaggtctcactctgtctcccagcttgatcatagctcaccatagacttcaactccttggcctcaaacaatcctctcatacctcagcctccagcgtggctgagaccacaggggtgcaccaccatatctggctaatagttttatttttattttgtaaagacagagtctccctacatttccccggccttgaactcctagtctcaagtggtcctcccgtttcgtcctcccaaagtattgggattacaggcataagctactgcatctggccttttagcacagtttaatcagaagaggaaaatgagcagatttttattttatgcagttaccctgtggaccatgtagagaatggtttggaagaacgctgggagtctggtgaggaatccatcccagaggtagtaactaagacctgtttttagacattggcagtagcgaaggatctgacttgggaggtagagttagtagcatttatgtgacctctaagacgtgatcctgtcacactttttctctactctgttaggttcagtacttgagggcctttgaattaaactgacagatgatagattagcaagagaaaaggtagattttaattttgtaaatacttaggggagttcacaaataaatgtgactgaaaagagttgttagaatttggggtttatgcaccatcttaatagatgaagaggagagggagaaagggtacttccgggaaaacaaagaactatttggaaagataaatgggctcataggagaataaatggaagctgtatattttcgtgacattttctgtttggttgtcttctcatctcagatgattagagttgcccctgtgggaaagggttcatgacaattgagttctttgagttcttttgggaggctctgcttttaggcagataaggggtttcaggaactcaaatgccttcagctcaaaataatttttatgctatagtggcttattctggatcctttcacggtgaaggagaggagaaattcctgagattctggtttgagtgatggtggtactgtagataatgaaatacataaagaagagcaggtttcaggacatactgtattttcatttgtatggttgagcttggagcacctggggaacatctagagatcctagaaagcagttggatgtagatttgggacctagagagagctcaaagaagctgagagtacggataaaattttccttggagagtaggagaatgagagaagaaagagcttccagaaatgaactgaaggaggctggaaaatgagagaggatgaaatgagagaggggacatagaaaggaaattgagcctacaaaggagactaagaaggaatagttgaagatgaggggagctgggagagttacagaaaccaaggcaggacatagtagcaaggagactgagcaatagggatcagcagtgccaaggtgcagagtaaaattatagaagtgttaaggaaaaaaaaaattatatatatatatatttagtatatgataaaggtacagttttgaggaggaaatggagggctgtttatttaaatggacatttgggacaattggcttaccacttaaaaaatattaggttaggccggatgtggtggcacatgcctgtaatcccagcactttgggaggctgaggcaggaggatcacttgaagtcaggagttcaagactggcctggccaacatggcaaaaccccgtctctactaaaaatacaaaaattagccagatgtggtgacgcatgcctgtaatcccagctacttggcaggctgaggcacgagaatcacttgaacctgggaggtggaggttgcaatgagccgagatcatgcaactgcaatccaacctgggcgacagagcaagactttgtctcagaaaaaaaaaaaaaaaaaaaagttagtttaggtccccacctcatgccttataccaaaataaatctaaaaattaaatgtagaaattgaaaatagtaaaaatattaggagaaaacgtgggtcaatacttactttgtgttcaagttaggaaggaccatacccattctaattataacagaaagaaaagactaagaaattttcatgtaaatccagcatgtctgtgtgctaaaaatatcataaaattaaagtgtaaatggcaaactaggaaaagtatttgccatagatttgacaggcagaggtttaatatccttcatatctaaatgatctatcaaaaaaatgaataactgaaggtttctggttaagtaggactcattgaagatgtctttatcttccatccttccaaaattttgataaaatgacaggaattacagaaggggtagacccacaaagagtgaaaaagggagagtagggaagatttttctggttgatgatagactaagttgttgggccttatttcctgctgagagcaagtcgagatgatggacaaaatttaaaacaaaatttatgtgaaggaaatggagagttaacaaaatagtgaagatttgtgggtgtaagaggtggggcgtggtgatgaggtagggaagcccaagatgtgagaccagcatttgcagtcatttctttcccagaggaatctgctcattccagaagaattaggcagatgagaagctggacggctgaacagagtttttgttagactcagagggcggaggacaaaaattggagtttggctcagatcagggagcaggaaaacttcttaggctttgagtaggagacccaaaagcctatatcttagagatagtagctcctaacaggtattgaagtccagctccagaccctctcagttcctggctggatcaaggtgttctggaaagaagcaagtataatttctttcattaatagaagaagataacatcactcagaacctcagatgagctctatgtttatttacaatgtttggcactcagaaatcaccaggcagatgaggatttaagacaatgttactgaacgccaagagaaacaacagactatggaagtggatcgacagggatccagatagtgaagttattagaaaagggtaaggtatgtagtatgtttacggagttaaaagattaagaatagggaaattggaaccacaccaccccctccccagtagaaaaaccaaatgtaaactgtagagttaaaggactgtaaatgaaattaagatgtcagttaatgggtttagcagtacattagtaataagtagaaaacaaatgttcagaatgaaatatggaaataaaaatggtctggacatacattatagagtgagtcttagggattctgtggaaaggtctaaccaacatgtaattgaaatcctagtaggaaaggaaggaggagtgctgcagaagcagtatttggagtgatgatagctgagaattgttcataacaggcaaaagccatctcatcacagatttaaaaaatactaccagaaatctaagataaggagaacattttaatagtaaccagaggccaggtgcggtggctcactcctgtgatcccagctctttgggagactgaggcggatggatcacttgaggccagaagtttgagatcagcctagccaatgtggcaaaaccccatctctactaaaaatacaaaaattagctgggcatgatggttcatgcctgtaatcccagccacttgggaggctgaggtgggcagatcagttgaggccgggagttcgagaccagcctggctgacatggtgaaaccctgtctctactaaaaatacaaaaattagccgggcgtggtggtgcacgcctgtaattccagccacttgggaggctgaggcacgagaattgcttgaacccagaaggcagatattgcagtgagccaagatcccaccaaagtactccagcctaggtgagagtgagactctatctccaaaaaaaaaaaaaaaaagtaaccagagaaaaactacgtactacattgaaaagagcagtgagattgacagctaatttctcaatagatgtaatagtgcatccttctcagaaggcaatgaactaatgttttaaaaatgtaaaaaagaaggtaaacagccaaactagaatgttatacccttcaaaagtgaggacaaaattatcacttctttagatcaacaaaaatgagaaggatttaaaagaaaaagccaaaaccccaattctctttcttctacactcacaaaacttctcataccaaatgtgtagggtttttttcataccaaccaattctccagttctctgtggactccgggtattctgcaatttaactcaatttggatactaactgcctggaattacttgcttcacaggttgagagcttggcctcacaagattgcttagaaaccaattgcaagtccaggtctccgatatttcttaccgactgctatgaagtgattcctataaccccctcctcagattcagtgatttgctagaatggctcacaaaacagggaaacatttacctaggtttacctgttgattatacagaatacaattcaggaacagctaaaagagagatgcatagggcagggtatggggaggaactcagaacttgcacaccctctccaggtgagtcaccctcccagctcccctatgtgttcaccatcccggaagctgtctggactctgttgtttgggtttttatggaggctctattacgaaggcatgattgatcaaatcattggccattggccgttggttattgaactcagtctctaacctctctcccttcccaggaggtggtggggtggggagcagagtgacaggggatgaaagtctgaatcctctaatcacatgattggttgctttggtaaccagtcgccattctcccgagagtcctctcatcataaactcaggtatgtctgctcttcttactaccgtgtttcagggctcaatgccaggaacttgaaatgaagaccaaatatatgtttcttattatatcacagtatcacagagttaattacaccagacctgcactaaagggaataatagaaagattggtctttggcagaagagaaatgatcctgcatggcagctttaagatgcgtggaaaagtgaagaccaaagaaaggagaaataagatggtaaatgtaaatgaacactgttgggtaaaataattatttgtggtttaaaatacacatagaatttaaaaatatagtagtagcatataagttgtgggggtgttaaataaaagttaatatcttacggtcttttcattgcccaggaagtggtaaaaatattaatttacttgagactttgataagtcaaggacacatgttgtaatctctaagatagtcattaaaagagtagtaaaatatatgtaattaacaaattaatagaggggaaatatggaatagtaacagcagtagtagtagtaaaacttgattaatctgaaagaaggcaagacgaccaaaaacagaaacagagcatgtgggaaaaataggaagtgaacagtaagttgttagatttaaacttagtctatcagtaattatattaaataaaaatgaaccaaaatttctaattaaaaagcaaagattgggaaattggataaaaaatcaaagcagatcacaactctgtaccgctttcaaggatgtagaaaagttgaaaataaaatggtagaaaagccatattactcaaacattaaaagaaaactggtgtacctttattaacaaagtgggctttagggtagaaataattgcttgggataaagacatacataatggtaaaatactcaattcagttctccaggaagttacaacagttctacctctgtatgtacctaaaaacactatctcaaaatacataaagcaagaattaacaaaaatgacaaagaacagacaaatctgcaattcatagtggaaagttttaatataccgtcttcattaactcagaaacaaagtatcagtaaggacatagaagatttccataacataatgaacaaacttgacctaattgaaatctcagtgggtttatgtgtaatctagacgtactactgtcctgtgcttcataacgatgtttcagtcaacaagggactgactaaatatatgatgctggtctcataagattttattggaactggaaaattcctgtctcgtagggatgtcatagtgtcatagtgtaacacattactgtttctatgtttatatgtgtttagatacagatacctatcgtgtcacagttgcttgcaatattcagtacaataatacgcagattcatagcccaggggcaataggatataccatatggcttaggaatgtggaaggttgtactatctaggtttttgtaagtacatctttgtgtaagtacgtttgtgtaagtacattgtcatctttgcacaatgatgaaatagcctagtgatgcatttctcagaatgtatccctgttgttaagcaacaaaagactgttgaaaataagatacattcaaaatgaaatatggaatataatgaaatatgaaatacaacactgcacccaataactgtagactgtacattcttttcatatgcatagggaacattgatcaaaattgttgatttatagagtaaatctcaacagatttcgaaagactaaattcagaatatcatacttacaaagacaggtttaatatttgaaaaattgatcagtataaatcactaaattaatagagtagagcagaaaaatcatgtgataatgtcagaggtgcaaaaattgcctttggcaaaatccaatacccattcaaaatggaatctcttaatacattatgaatgaaagttaacttccttaatttgataaagattactcagaaaaatcctatagcaaacaccatgtttactggtgaaatgttggaagttttcttttgagacagggaaagagaagttgttttcactgtcaccaattctgtttattattttactggaagtcctacctagttgagtatggcaagaaaaatagtacagggatgagaaagggaagaataaaactgtgattttgtagatgacatgattgtatatgtagaaaattaaaaaaaacctctttataacttattataaataataagctaggttgcaagattcaaggtaattctggacacaattgcaattttatatgccaacaacaaacacaaattccaaatttgtatcaatctggatccaatcaggagagagaaaccagttgtattagtttgtcctcatagggctataaagaaatacccaagactgggtgatttataaagaaaagaggtttaatttgttcatggttccacaggcggttcaggaagcatggtgccggcatctgcttggattctgggggaggcctcaggaaacttacaatcatggcagaaggagaaggggaagcaggcttgtcttacatcgccagagcaggagcaagagagagagagaggaggggaggtgctacacacttttaaacagtcggatctcctgagaactcaatcatgagaacagtaccaaagggacggtgctaagccattcgtgaaggtgcacccccatgatccagtcacctcccaccaggccccacctccagcactggagattacagtgtggacatgagatttgggtgtggacacagattcaaacttcatcaccagtaaattgaaagcagcgtttaatgtggataattactaattataacagggaatcgaagtaaggagggatttggttaggctagtgaaaagtgaagagaattgtaaagaatatgaaaatagcagataaacagagcaactgctgcccctggggctgaggtagagtctgcaaggaagagtctctccttcccccaggaccaagatccagacctcatccagagagggcatggctggtttactgcatggccaagaagttgctggcatgtcatactagtggaacttaatggaaatccaccctctgatacctgccagaagttgctcactagggcgccacacaaaagctcttcatggggaggtgtctcactggaggtaccctgctacaaaacctccagagtgggatgctggggggagctgctggctgctgggtatggcctgctgttgtgtgctgtagtctctggaggctggagcagctgcaggtgcttgtagagatgggtactggagaagccacctgcgttgcaggagctggacgccatacaattaacacaatgtagagcaatctggaaggctgtatatatcaagatggccaagatggaaccagtgtttttttttttttttctctgtgacagatagaattatgatgcttccccctgccgcttttttttttttttggtattcattcagcatttatttaatgaatgttgagtattttctctattccagacaatgtgtttgttacgagatacataacagcagacaaaatagacattgaacttgtttttgcagtttataggctgataggacagtcagtcattcatctgagctcttttgtgccaggcactattctagtcactggggggatagatggatagattaaatagattggttagatagatgggatggatgtatggatagatagatggatcaagataaaatcttgctttcaaagggagacagccattgagcagataattaattataagaatgggtacatacttacacagtgctataaagggtgtaagaaggaaaaatacaggctgctacaagagaggacaatgtaattcagatgagaagccagggcagacttctcttagaaagtgatatttttatgatgaaagtgatgaggaggaggttagcttggtgagatgagtgatcagagaagaatgatctagatggaggggaggcttgcgggcagacttcatgatgggaagagctcggcatgtctgaagtgaggagtgggaggtctctagagggtagggggaggtagagagtggcaggagaagaggccacagcaggggtcatgctactcacagccataggccaccttggaaactagggtgtccctgtgaagggttgcccgtgatagaggtctgaaataggagattcttggactgttttgctatttacagccaccgtgtggggtgctgagtggtcaggggattggaggcaagaatggaagttgagagaccactgggtgcaatttgcaggaatccagtgaaagttaacggtggaggtggcgccaaggcccagcagtggagctggagataactggatggcttggagatggggtttggaaatagagtcattcagaactggtgatggattgagtgtgggctgggagagacagggagacattgagaataactcccaggtttctggcttaagtcattacatggcatgtgatgccattttctgtgtacttttgtagtgaatacgaattacttgttcaattaaaaaagtaaaataagtttggatttgcagatgaagaaggctttggtgaccaaacaaacaaaaccaaagcagttgcagtgaaagtgaagaggtggagatagttgctacagactactgcagttctgcatcttcaaagaagccagaaagtagcaggcaaggtagggtcgggctgtaggacaaggacatgtgttttgtttacagagtaggatagatgtgagcaactttcattgggagagagagctagaccatagagggaagagaaggcattcgttaactcaacaaatatttgaatgtctgtatgacaggcaatactctaagctcttggaacatacaaaacataaaaaacattcctgtcttctggagcttaatgttctaaagtggggacactgaaaatcaaatcatgtgccgagtgcactgtaaaaagaaaaaaaaagcctattaatggggagatctagggatgttgaggtgggacggccagaaggatgtaattttatgttgtgggtggcactgatggatttgatgccactagaatgcaagatatgccagggcagagattttagttttactcactgctgcatctccagtttagaatggtgcctggcacatagtaaatgctcaataaagaattgctgtgcgaatgaattaatgattcaggatcccaggaatgggaaggaatgaggagtgggatactgaagaaagaaagataggccagtcataaatgaagacatattgtagggatgttagtactgatatctccaattcaaattacagttgtttttgcttttaaaggattttaactgttcaattgtattttgaattctttgaattagctttgtttcatggcattcattttgtttactgtatgtttcttagacacagtaatatagtttacagaactacttatccttagggacattacccacttaagaagtgactgttttcagtattattacaataaaattgagattacatatcactttgtatattgaggttctgttacaacctgtcttttcagcattatccttaaagtggtgtgtgtggtggtggtggtggtggtggtggtggtgtgtgtgtgtgtgttggggggggggtgttgtgattgttttatgcccattacagaaaccagtttagccggcattatactggtgtggttatatattaaataagttaaatttcttgcagctactcttttgatcagttaattggtctgatcctatagtgggtattttcatgggtctctgctaagtttagcctcacaatgattttgtgtgtctgaaatcgtattgacaggctgtagctccttctaatttatgcatgcgtgaagaagattgtcctctatttgctgagtcttatgcttttatatgaggaccccagtgtcgtaactttgccataactcaggaagatctaacttctgactgtgcagtatagagcattcctttgtctaaaaaaataatatggatgttttaagaccattcagtcataactggaagctgccttatagttaaaggactttacatattaatgaagaaagggaacatacaaatcattatgtcctttttgccatagattgctgtcccctcccatagaaattatcttattatattttattacaacagtgtatgtaaaatatatacttataaaagtaataaatggtctttgaaaaattctaataacaggagtgtagagattataaactgattttatcctaaaattgtacatcctaggagataaccattgtgagcaatttgatttatatccttttttggactttacaaatgcttgtgtaaatcgcgtgtgtgttgtatgtatatatgtttgagtgtacatacaagaggaatcatatacagcttccctgttttttcctccccatttatacaccatgttgtggacatttttgtgtcagtgcctgtgtgtgggtatgtgtgtgcataaagacatagcacgggtatgccataaaaagttttcagccaatcccttattggttgtcgtcatattttgctcttacaataagtgatgcacttaacatctccagttatgttctaggacagaagtgcttgtcagagtgtaaatatttgacatatgcccttagaaatgttgtaccaggccaggtgcagtggccactcctgtaattccagcagtttgaaaggtctgggcagaaggatcacttgagcccaggagttcaagaccagcctgggcaacatagggagacctggctttacacaaaataaacaaaattagctgggcatggttgtgcgttcctgtggtcccagctgctcgggaagctaaggtgggaggatcacttgagcccaggaagtcgaggctgcagtgagctgtgatcgtgcgagtgcaccccagcctgtgcaacagagtaagtccgtgtctcaaaaaaaagaaaagaaaagaaatgttgtagaataccaatttggactctcattagctaaaagtgagagcatccatttccccaaacccttaccaatggtaagtgttgtcagtcttttaaatcctttctcagcccaacaggtagaagactcagatctccttttaatttacatttctttgtatattcctgcaatttagcatggtttgaccatttatgctatttttttggatatgttactttttataatagtcttcagtctttttttctagtaggttcttcgttctttttctttctgatttctgtttttcttttaaaagaagtatgtataatatttctccctttagtcatctgtatttcagtcttagttttcttaactcattatgtcctcatgccaatcctatgagtcatgctcccaaactctgaatctttttggccttgatggcatgtgtacttggtctttcccacaccagtaattaagtattctccctagattttcttctttgttttgaatttttatccttagatgtttaatatagctgaactttttttatatgtgaatgggatgagttagagctctaatttcatttttctccaaataagatggttattattgagtcattgatcattttctactgatttgagatgttgccattaccatgtgctaagtttccacaaatatgtggttttttacctgaactccttgttcattgatctgtttattctgtgcctacaaaattaccacattgttttttctttccttatacactgatttagtttttgtcattctaacatattgtaaagaggaaagtattgctcctattctgttcttaaaggtctatcagggccgggcgcaatgactcacacccgtaatctcagcactttgggaagtcgaggtgggcggattacttggaggtcaggagttcaagaccagcctggccaacatggtgaaaccccatctctactaaaaatacaaaaaattagcctggcgtggtggtgcatgcctgtaatcccagctacttgggaggctgaggtgggagaactgcttgaacccgggaggcagaagttgtagtgaccccagattgtgtcattgccctccagcctgggtgacagagtgagactccatctcaaaaaaacaaaacaaaaaaaccaaaaaactgtcagaagtggagtgtgacttacttttttttttttttttttgggtcagagtcttgccctgtcacccaggctggagtgcagtggtgtaatctcaactcactgcaacctccacctcccgggttcaagtgattctcgtggctcagcctcccaagtagcaggcacatgccaccacgcccggctaatttttgtgttgttggtagagatggggtttcacctcgttgtccaggctgttcttgaactcctgacctcaagcgatccgcccgccttggcctcccaaagttctgggattacaggcatgagccactgcgcctggccatggagtgtgactttacagtagagattcatttgtctaacatctctgttactggtttcagtaagatcacatcatcttttttgtcctttggcagcagaagttgtaggttaacgaaaactaaagcaacttttcttgtcactgagatggaattgaaatgatctctaacccatacttcttcagccatgacttctcacatcttagaacacattaaaaataagaatatttgtaggacgtactggagaatgaatgagtatccttgaggtcagaaaccactggtcaggggttagcgtggcttagttcccctcacaaggcacgtgtaacccatttacattgaactgcatgtcagtagggaagtgtttaggaagtgctgctgtaggctaatgttcttcaactttaaaattttctcatgacacgtcattgtagcttgatatggattggccaaactgctttaaaaaatttttaattgtggtaaaatatacatatataaaatttgttgtcttaaccatttaaacattcacattgctgtgcaaccatcagcaccatccatctccagaactcttctcatcttgtaaaaccgaaactctgtacccagtcaacagtaactccccattctccctacccctcgcccccggcaaccacccttttactgtctgtctgtatgaatttgactattctaagtacctcataaagtgaagtcatatagtatttgtcttttttttttttttttgagacggagtcttactctgtcacccaggctggagtgcagtggtgcaatcttggctcactgcaacccctgcctcccgggttcaagctattctcctgcctcagcctcctgagtagctgggattacaggcttctgccacaatgcctggctactttttatatttttagtagagacaggatttcaccatgttggccatggttggccaggctggtctcaaactcctgacttcaggtgttccacctgcctcggcctcccaaagtgctaggattgcaggcgtgagccaccacgcccagcctagtatttgtctttttttgtgactggtctatttcatttagccttatatcatcaaggttcgtccatgttggagcatgtgttagcctttcctgccctttaaaggctgaattcgttatgtgcacaccacattttgttgatttgttcatccatccatgggtgcatgggttgtttcagcctttgggtattttgaataatgccatgaacataggtgtaaaatctgagagccagacgtcttgaaagagttttgttttttttctttcattttttaactattccaatttgaatttagcttccattattccgccaaaccttctttcttagatcactattaagtagaaggaacatttttcctttttaatgatttttcagacatactcacccactttggctgtgccatcctcccttggctcttgggatggtgcatgccccctgtttctctcccacttaggagatttcctttgtgaccctcctctcgcatcatttaaaggtggaatttccccagagcttgaccctgggccttctgtctgtgaccattaaatgtgggtatttctcagcaattagagcgaggctcttttcttttcccttgttttggaaagaagagagtcaaaaaagcttaatcaaataatctcatcttttacccaaaaaagataactattttcttcgggaaaaaaggtgacaagaatataaatcatcagaattacactaatttgtttctgaaggaaatgataaactttcccccagctttgttgaggtataattgacaagtaaaaggtgtatatgttcaaagtatacaatgtaatttgatgtgtgtgtacattgtgtaatgattagcacaatcaaccagcacgtccctcactatacggtgttttactgtgtgtgtatggtggaggagaggagtgaggacacttaagatctgcttattaatttgcttagcaaatttcaaataaacaatacagtattattagctgtagtcaccgtgctgtacattacagccccagaaaatattcatcttataaccaaaagtttataccctttgaccaccatctccccattccctccccaacccctgtgagttcaggcccttctctatattccttcttattctaggtgacccccatctgcttacagagatccaatctgctgatggctcctaggtttgtttcatgaggtcagagctctttgctgagccccactccagagctgcctccttgctgtctatgctgagtgtctgatgggtgctccagcctcatgtctgagatagagcttcatgattttcctcccacgtccccttccgtgttctcagtgaagggtacttgagcctcccaggcgatcaagtcaaatttcagggatcagttttaaagtaaactttttaatttaggatagtttcagagttatagaaatgtctgaagaatattaaggagagttcctgtgcactccacacctgtttcccctgctaacattactgtggtacatgtttcacaccagtgaaccagtaccaacacattatttacactgaactctacacttcattcagatttccttaattttcccctaaagtcttgttctttttcagaatcccattcaggatgccacgttacatctagttgtcatatatcttcttaggctccattagactgacagtttgttagatttcttcttgtttttgttgaccttgacagactaagtattttatacagtgttcttcaatttggatttgtctactgtttttctcgtgattagacttggataatgggttttggggaaggaagaccacagcggcaaagtaccattctcatcacatcatatcaagggtacctgctctcaacatgatttactactgatgatattaaccttgatcacctggctgaggtagtgtttgttagatttcttcactgtaaaattactgacatttttgacactttcctcttctttttatctgttttgaatccaaaacaattcctgctggttctttttcccaaataaatttccattctgtccaagtcactctttgcagccactgctgcagtccaagccacaattgcctgtgcgcagacggtattgagcgatcttctgactcatgccctgcttgtgcccttgccttctccagcccagtctccacccagatgccaatgtggtccttttcaaatgccagttggtcagtggtactcttgttcccaagcctttgagcggcttcttgttgtacttgagataccaccccaccttctagacacagtctgccaggcctgcttaagctcgtctcttgtcacctctctcatctcctgccaagcccctctcgccttgtcctctgttccagccaccggtttcttgcccgagtcccttcaacactctcagctcccttagacatgtcgttgcctctgcttagaatgatggtcgccctccaccttggttcccttgggaccccagcttacatgccatttacatgttgtttcttcaggggacatttcccatccacttgcagggtccatggggcactcttgctgggtgtttctggagcatgccacactgtacccctgatgctgggagttacttgttctatgtcggaattgttcctcagtgctggggtggacaaggctgagacgtgcctcggcatgtcactgtgtgtccctgttacctgtactgagcctgtgccagagtggatgcttgataagtatttgttgactgggtgaaattttttaaaaattaaaacatttttaatagaaatggggtctcactatgtggcccaggctggtctgaaacttctgggctcaagcagtcttccctccttggcctcccaaagtgctagaattacaggtgtgagccaccgtgcccagcctgaatgggtggattttatcttttgaatggaaaacactcttcatttttagcatgccagtatgcaaaaaagtacttgaatttatttttcttagtccattgatttaaatcccacatgtattcttttaaatctgtcacataaggtgctgtggtgggtacagtagtggatctagaaagtgtgttcagcctctgccactcctgagggcccattcattcattctctcattcaccagacagttactgggaacctgggtctgccaggcctagtgcagagtgtggggttatgagggcttgtgagtgagcctgttgagggagagggagaaacttatagatccttcagcatttccagttgtggttaggatagatttgggcggatttagtttgaattctggctctaccatttttaagatctgcactcttgagcttaacctctacccgtctgcaaaaatgtgggcagcattgtctcccttgtaagttgtggaaagaatcagctaagaaaaggaatgtaagaggatcagtataatcatagtaatcacagaactaatggtttttgcctttgaggtcctgagtactagcctaagtagttacattaattatttttgtttattctcacagcaactctgtgaggtagggatgttactgttctcatgttgtaaatgaagaaagtgagaccttagttgaaaaattaaatactttgtccaaggcacagaagtagtaagtgggagagctataacctgaacccaggttcaaggacggcgtgattttaaagcccagaaaggactccttacattctgtgtagctaccccatcttccagtgtggctttattctttaaagttgtaaagactttttaggtatcttggcatttaaaaaaatgtaatagtctttagagggacgattaccttaagctattatcaacttgaatttgtttctttattcacattttagcagctttgacatctgtgacttggtgcctgtgttgaggagagagggtatatgttgggactggaggatgaagtttgaagttagacccatctgggcagtatttatcttaaagtgagaattgtgaacttgtaatcagactcacctggaagatttatcaaaaacgtaaattccttaaccacttctttggtaccccacattataatctcttaggggtaggacttagaaaacatttttgcaagtgatgttatttagatagtggattctttttcattctgaagtttgagaatcagtgaatagagggaatgggaaatgtcaactccttgatgatccagactgccctacaggaagccagtggaaagatgaaagtgaaccctggtatgcctggctagtaagtttaaaaacaagtaatgtggaaataaaatcaacagtcggtgaatttgtctccctgttgttttactttttatattatttgtgtttgggaggaatttgatttgtattttatgatcatttttccctagtgggtagtggggtagcacgagaaatgagtgggtctagactatgatagagttggtgcaatgcagcaggccaatcggaagaaaaaaatttaagcatattttgtggattagcatgtcagttgcaaaaataggagtatatctaaagctgatttcagatagtctctttttagcgaaactatgtcagactgtgcccggacttttgctttggaaaatatggtaatttcaggtttgtggctaatttgaaaattagtaatcaatactaagggttttaaatatgtagcatttatgtgtttattatgtatttctatattcataaacattgaggattcttttattgtctcatgtaacaagaagacaagcagctcagggatggcggctcccgtgtgcttctccatgatctctcagcttcctttgtgtggatggccacagcatggctgcgtgcctaaagcacgcggagagggcagcattcttgtctcaggctccccacccaccattcttaagcagctttgttgaggtataattggcatactaagttgtgcattgtcttgtacattttgcaagtgtgcatctgtatacaccgcacaaccattaccatactatgataatgagcatgttatcactctccaaagtttcctggtgccttttgcgattccttctgcccacccttctcctccttttgtgaaagctttgatgtttttagggaaaaaaaaagttacattattgaggataaaatactaggtagaaagatatttaacttgtagttttcgctttttttttctttttgaggagtattgtggaaataatatgattgtaggtataggttgctgtaatatttatagaaagttttgagaaacagattctctgaacagaccatcttggaagagtttgacaggaaatatattttcggaaaggctggaatagaggtggagatggtgcctgctggcaggagagggagagaaagggaggacagcacctgccggccacttgcgggtgagctacagacatgaaagccaaaggctgcgcttttctttggtttttcaatagatggcatttttatcatgctagaaagactaacatgaattctaacatgaaatggtaataaaaatgtaatccccactaactgtagtgtatacatagctcaagtgcatttttttgttgttgaatggcatgctggtgattgatttatttatatttatagattaaaaataataaactttgctctcattgtaatcacctctttttttttcttttttttccctcccccagagactgggtcttgctctgtcacccaggctggaatgcagcgagtggcacagtctcagctcactgctgcctccacctcctgggcttgtgttccttctgcctcagcctcctaagtagctgggactgcaggcatgtaccaccacacccagctaatgttaattttttgtggagatgggatctccctatattgcccggctagtctcaaacttctgggctcaagtgatcctcctgcctttgctttccaaagtggtgggattataggcgtgagccacagaagcgtgcctggcctgggtagttctttttaattgttgaatatacttgctgaggttagtttctgctgcagaaagcattatataatgttgagttaacagcgatcttgtaaagagttagtagaatgtgtaaagttttacctgggaggcggaggcagcagtgagccaagatcttgctactgcactctagcctgggtgacagagcgagactcttttttttttttttttaaaaacaaaacaaaacaaaacaaaacaaaacaaaaaacgactgtatagggttaaaaaacgactgtatagggttttattttaatgggtttcttcagctgtctccttttagcttctatgactctgcattttcttggctctttgtttttcatttctttacagttcttccatgtattttgttttgaaagtaatatgcctgaggtgaaaatggcggcatttctgtcatgatttaaccttactagaaatgacattctttgttctttgtctgtttagttgagaagtgaaccaattccctgtgcttaaagtactactccttggtgtggggcagggagggaggggggaagatttttaacatagaatacaaattgagtttgttggaaaaggtatccctataaaatgttgtccaggtagttagagcttaatatgggtgataatttccctagaagaatattctttgctgtaacactgatgacttgatggacttgtgaaagtgaaacttggtgtgtttcttctttcagcctccatgtaactcacagatagggcagtgtagagtagatttccagttttagattaaggatagcttgtatcctatgcaaggttttgggggttggttagggtctttgagtatttcctgtctaattcacttactagttacaaagagacaagctgtaatgtaaaaagtcttccttgagctagactagctttctgtactctttgatttaaaaatacctggtagttctgccagttggggatttgtttggggtgaatgaaaacccctcaggctcagtctgttcatgcactggtgtgtattaattcagtccattcatagtcatgagctgactgtgccttattgaagaaagggaggcttctggaagagagaggaagatggataatcttggatcctgaagcactgctgctggcgcctgggagtggggcaggaagacaggaggttctgaagagagggctttgtatccaaagttaagacttaggccagcccttgatggggagagaagctactcaggcccaataacctcaaatagttcaggttaaatcgacagttgtcaagtctaattcctctttacagcattatttctgtgggaaaatgtgtgtggcttatatacttgcctcagcaaacagaccggactcagaatcagctctttgttgtcataatttaagtggaattagttactccctagggttgcattgccccttggatggcttctagccttctttttacttattaaattatattccaggttccttgactgtgagggacatagtaaactcctagtagcctttaccttcccctccctaaatagcaaactcatgtagaaaacattagctaaaatcctttgcagatttttttgaaatcacctaaaatgttgttattggcaccatttcatttggagccattttgtcagaaccactaagtatttaggtgaggcgattgatttcattcccacgtgggaatttggttggttgtaatattcaggcactcagagcaattcctgcctggacgtcacgttcaggtagtctggtgtctgaaacttttggcagagattaagctgatagaagatttgggctaacattttttagtgtgtgagttggtgaattttcaagatgatttagaagactttaaaaaagcatctgtgaatactgcatcatcttgatgtcaagaagagattgttatttaatacatacatgttttagtaatgaaggaggtacatagagataattgatttgaaccggtttactttttcccctttttaatgcaaaatatttttgggaaacagaacttgactcgtgttacactactcgcttcttgttttttgttacaaacatgctgaaatggtctaaataatgatgctactaaaacaacgtatgcattgttttcatggggtgttgattccttctgcagtgttcaaaattacttgcatgcctccgagcaacaaacacatatgtgacagactttatgtgagatgagcattccagagaaatgaaatgcaagtttacttttcagtagctatgcaacttaaaaaaaaaacattgtgttttttgaaacatggctttagggcactaacactcggaccgagtgcatgagctctgcaagttattttaacaaaacctaatcacaggaacaaacatctggcatttatagagtttgtttatttattgattgccgtaagcctctagaaagaatattctgtttcttttaataaaatccttttggaagttgtctatattttaatatctaagtgtttttggaatttagttttaacaaggttaactcaaatgttaaatttattgtgggctacagctgaagtaggagaatgtaagaagaaatggcaagtgggaactcttgtaaaaagaatggtaactaagttctttttcctggttatgctcctgccatttactcttctgtatggcaggccatcatttacactgctttgtagaatctgctgtctagtaagcactaaggaatttggatccctaaaccagggagcatatagcctgctaaagcttaatttttagacaggagacactaaagatgattgtgttatgatactgttcattttatatactagtgaaatgaatactgaaattatttagtataaccattaattatagtgcttaccattactgcaaagtttgtcatgatttgggtggtagcttcatgtttcaaaacaaaaccataggtctatccttttaaaaaacataaactgctttagtttgttaatgggaaaagtgagtaaataataacacttattgatgaaatgaagcctgtcagatacaggaaaaacaaaacaaaaaacccttgtagatattcctcgtgtcaagcccctattaattctgtgtaattccagtagaactagcaagttattttgcttaaaatgtcttttttttcccctgtgcagtgaaagttgaatgtgagaccacatcttaatagatatagttacacggtttattttatcatgtatcactttattgctgtcttctagaacattgttatactaaatgttccaataatggaaattttatgcagctacttcaaatgaaacaaatttgcaaaaactcaattttggaactcattccttgaggagaggaaaaactcaccatgctgtgaccacattagatttctgatatgttggcaacttatcaaacactgtcatttccagaaaacaggttatggggtcaaattgaaatatcagcacttttggtcactttcagttgaagatattttaggttttaatgattgaatggttaaattaaaaaaaaattgttggtaacaggtaatgaaagtgtggttttgtatgtaaataaaaatggctctacacgacatcaggaatgatggggttcagttacagtggaatcttttcaagagcttgattttaaattctcagagatactagttttacttactggagctcctttgttttgcagagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtaacacgctgatttcctcaaatagagatacccctttgagtgataaatttgcaaaatgctgtcttcattttctgtattaaaattcatttcagttttaaaataaagtgtaatctgtgttttcatccttttaaaatttaagtttaatgagtgcatttccccatacagtatatttccttttttattcatgttttgcagaagctgaattaacttgatatttacgtataacttacacacacccaggacacccatacctcttctctactcccaaaccacccaaaccattgcccctcaccttatcacacatacaccctcaccatcaccaccaccaccaccaccaccaccaccacataccctttcctctgcagagtaacttatctttctttcagaaatagtagcaacttgaatttattagtcttagctgccacattatacatcttcagattatattttgtattctgaagtattttggggagaaaaagcttagacttttaattttaatttcatttaaggactagaaaaatacaaagttgcctcattacccaaattcacctttccccactcttttaatattttatttctttaattttaggcataagttaagaacaagcaatttaacatgaccaaaaaatgtacttttgtctctgccaaaacctggtcagccagccctggtagtctcaataccagattgatttctgccatatgcaatttcatgactgtttttcaaacaatgcatttttattgtatttctcttttcagaaaattcttaatctaaagcaaaacaaaccaaaaccgaaagacagaaaccaaacttgagtcagttctttgaactggcaagatactccttagaaatcatgtccttaaaaaaaacatgtgaattctctcagcatggcccactgaagcacagattactttttaagtgtctcattattttattctctaacatttaatgctgatgttttaattgcacacagctgaagctgctaaatgagtactgaaatggatttaagtcctctttgagctttgttgatacctataaaagtttatgtcattcattagaaccacaaattaaaattagtcgtggttagctgttcactggcgattggaactctcacgaacagttttgttcaggctcacgagcttgttcttgcctagtatacttggatgcctgaaaagctgcctttggcctgttgggtatgttttcttttcacagaattgcaaaatatcagagctgagaaatacaaataggtaaaccatcctatgattataaagcccctgtgatttataatgtcccagtagtcaggagcaacttttttgctaaacctggaattttaaggtgattttttttttttttaaataatgcttttcacagttgtgctggcatgtttaccagatccccaaagacttttttgccttaagtatgtcctttatttgttcctttgatgccatgtccttctagcactaaaggaatggcatctggctcagtggatggtacatggaagccatgtggggggccatgactgcttgttgcctccattcctcttgctcaagcagccccaaaccggctgacccctgagggatgagctggttgatggtccccaggagagtcacagctccctgctgttggaatcggctcccctggggctcccatctgcctttgaggtagacagtactttatttgtaagtccagtagcagctgaagagaaattaataggttaagacgagaaaagtttttaattctcttattttacgattagatcagttagattttctttaaagttttctgcttaatacattttaagataacctcatttttctaagagagctagtacatggacacatttatggcttatttccaatgagccttgtttatttggttagcatttaggacatttagtagactgtaagccaatggatgtttttgtaaatgtgattcattgagaaaaaccttcatttgagagtcaggtaacctgctttggactagcaaagtctctggatatgttactggtatctgttgaggtagtcacacaaaactgaaatactccaacagaaagacttcagaagactttcattttggtgtaaaaacagtgaaattagctgtttgacttaaaatataggagttgtaagacatttcatcgatgctacttctgttttatcctctgtgaaatgtagatactgtgtgtctcccacttgctttttagggttgttgggaggataaatgaaactgtatgacagacacactgggaactcagaagaaaggtgctgttgaaactgaacctcatcctatggctgtgccgttggcaggcataaccggtgtgctgagaggcagtggtagtgaaccccgtggtgaaaggccaggaccatgggctctggagccaggctgccttggttcgaatcccacctcgacctcttgcaagtggtctgaccacagcaaatcacccaacctctctgtgcctgagtttccccctctttaaattggggatgataatagtacccactaaaggatcctggtgagttttagctgagcacatgtccacaaagtccttagagcagtgcctgccatgtagtgtggctgatcctcacacccagaaaaccccagcagggggactcacaccttacagaaaatcaggttcgaaaccattccccagtagtcttctaacactgacttagagacccttatatgtttagagagaggaaccgaatagtttatggtaattaagctcctctaaaacagatgcaagttcaggtgcataaagttaaatctgggtttttaatctcttaggaagaaaagtttagatcacaaagagctccataaccctttgttgataggttcttttaactgtttttggctatggagggacaaggaaggaaacctgagggacagacccaccttttacctgcttagcctttctcgttcccttttacgcttggtaaggtgtctagggagctttgaaggagtcagaagtgttgaactgtttcaaggttttcacccagctgcgggaggcttcgttgtcctcttgagtgaggtggaagggacatcactgcctttcctgagtgtgtaagaatgcctgttacatattcatcccagggctttccatacattttaatcatccacatttacctacaaggtgggtggtatgttcaccccattttgcacatgagaatgctgatgcccagataggttaaataaattcacccaggctcacaccctcagtaaactgccagacaggcacttaaatccaagtgccattcatatcacagcactgctgccttgcattgagctgcaaacctggctgagccactcctaggaaacggttttgcccttttagttgtagggacctcagctgtacgcattatcatccttcagccatcagacctttttttgtttttgttttttgagatggagtctcgcactgtcacccaggctgagtgcagtggcgcgatctcagctcactgcaacctctgcctcctgggttcaagcgattctcctgcctgagtagctgggattacaggcgcccgcgaccacacctagctaatttttttgtatttttagtagaaacgaggtttcaccatgttggccaggctggtctcgaactttcctgacctcgtgatttgtccactttggcctcccgatgtgctgggattattggtgtgagccactgtgcctggcccagaccttttaatgcaacagcgcccctaacttctgaaggcccctagctggcttcaacaaccgcccctcttcctgccccccatggagggctctgtcatacatgtgtcacttttagggactcttattaccaatggcttccttaatcctggctgcacatccagattcctctgtacagcttttaaaataattcactttttaagaaacacttgccccatcccaagactcttgttctagagagatggataggttcagaaatacaggaagtttattttgtaaacaagaaaacaaataggtccttacattgtgcacatatggatctgtgcttctggagtgtgggccaatgctgttaattctgtagttgactccattgtaaggtaaaatgagttttatgggccagtttagttgttcagccaacaattgttagtactgtttctgtaggaaaagttcctggcatccaccctgtagaataccatcttccatgagtgagcacttgatcaccacagaagccaggtttgaatttagttagagtgaaatgaagtagagggccctgcttgcttgcttgttctttcatttttttttctcttcctctcttttatgggtttatcgttcccttcttttcttctccttcgtagttccctctttccttgttttctctttcttccaccatctggcgtatgtttacaatgtatctgtcatcagactgtgaggtccctgaaatccttcaggtgcctaccacagagttgacgtgcaaatgaatgtttctttattttttaattaattaatttttttttttttgagacggagttttgctcttgtcgcccaggctggagtgcaatggtgtgatcttaactcactgcaaacctccgccttctgggttctaccgattctcctgcctcagcctccaaagtagctgggattacaggcgtgtgccaccgtgcccaactaatttttgtatttttagtacagacaggatttcactatgttggctaggctggtctcgaactcctgacctcaggtgatccacccgcctcggcctcctagagtgctgggattaccgtggtgagctgctgcgcctggccaaatgaacatttcttaatttgtcttagtatctgtctttcaaagaagtaggtactgcccgtcattagcttgaaaattgtcagattttgtttgtgattgtctgtcctaacttaggtggtttatcttgaagatcttaggtaatttagcctcatagatttagatagatcgagaaatggcaggcttcaatcactgaatagtacagaatgttgggcaataagatggatttggaccattcaagggagcacttatgtcaggcttttagcatatctgctgcatagtttttagagctggaaggtctgagatcatctgggttggacccttcatttttggtggtgaggaacccactcctgagagagaaaggtgcttcttcggtgcccgcctccaggccaggacttgcctcctcctcctctgtgtccttagctgagtgagagttgggatggcggagagcagaggcaatgtgaccgcatagctgctgcgattaactgcctgcctctagacatgttggagaaacagtcaaagtaatcatccttctgcgctccccctcccatggaaacaaatgatagaaggttagggcagttttgagggcaagcggcagacttcctcactgtgaaagtcgggaagctttggttgtgccctagaccctgtccttttggccttggcaccaccaagtgggctgctttaggtgtccatcctgatggtgtttaaccctgcttgaggcttttgaggacactaagaaacacatggtgaaggtgtggaaggattttttgtcattcctcaatgaagatctgccctaggtagaaagggagttaatgaaggaaaagtcggcaacgctattgctgcacgatcaggaaataacagaaaacgtctcccatttgttctcatttgtggtgattgtttccctgggaaactggccgtggttaccatcacgctgtgtgatgctcctcagaatcctagaattagacgagattttccactttccgcacacatcttcaggtggggtcgcaaatactccatatgacagactgtcacatacgctggccacagaacttcaattattcaggtttggatatccagccccttttctctcttctgtgtggatccttttgagtactttatacctctaagcctttcgtatttccaaaggagaaaccagaatgacttttgtcactcttttgtaatggtgggaaaaggactggtaggggaaactaccaaggtttgacctgggatctactttacctgctctagttcaccttggagcatctgaccatacataggtccttgcacatagtagatactcagcaaacattaactgtcttttcatttctcattagcacaggtaattaggaacaggagctgatagactgcacgtatctgtgcagagatatatctgtaattaaagttttaattaaagaaacaccagaccaggcagatggttcttatccctgcatcctgtaaaccaaacagccgtggcttttcgatcttgcaaacatgcaaagctgagagtagcaacattcatggtggtacaccaaagggaataggttgtcttataaactaaccataatctaattttggtagcactctatgtgatgccagattcaaggataatcattgcagtttgaaatgaaagacaatacatcaaagttatgtcccaaccaaagcttttaagcctcaagtcaagggcattaccacagcccagctcgtagatcacaagacgtgtggttttgtgctagatcacaaaagctgacaaggtgttatttaggattatcagctaaatacagtattaaattagagggctatcattctgatttttcaggcattgccacggtatagcagtacagaattgagaagtgacttgtacctgcctgcctcatgcagatcctctcagccatgtcacagtgaccttaatggtcaattgagtgcagaatttgaaaacaaaaaacaaaaacacccacaaagagtgacagaagacgacttctctcatatcttagcacttttccaggaaccgctcccccaaggatccccagcgatttgttctagttccgttgccatcagcaggaagctggatcagtaagggacgtgggcagatggtaaagtccatggcagttcaccatgaccgcttgggcttcacccattccataacccccagtttcttacccctcctcaaaacccttcactttgtcacacatgtcattttcaggcattcagtgcagataggcagctgtgcaacgggattacatactagttgatacaagtatgtttttaccacctacatctcactaattcattttctacttggtagaaccagtactgaagatgttcatttcttttatcacagcgaagagttttagtttagaggctaggagagtaatttctactttgctgaacagtgaattaccttaccatccctgcacttcttttaaaggaagtagagtttccgcttgaaaaagagtccatgttataccgggataaatataaggatcttcacattaaagaatatgtcatcaaatgtagagcctggaagtattttatcttaataccatctataaaactcagtcatcctaggagaaatgtgtgtgtgtaagtgtaaggagacataccaaacccacaagaccctgtgatgtgctgtgagcgaagcctgtgtcttggctggtagacagaaatgtgtccattactttctggcttggggaagacttcaggtatttgatgatatgtcctttggtttcagaagtcaattaaatcttagctgctctgagtaaacagccatttgtggttgtgtttagaaaatacagtaagatcagatttgtgctgctaggtattaggttggcattttacatgtggaatttgaaccggactatgaaatctatttcttctctaatttggttcaagacctgaacatgtaacctttgagtatacaacacaggtttagattataaaggcttcttttccttttttctttttttttttttttttgagacaaggttcttgctctgtcacccagatgaagaacccgcccactggagtgcagtggcataatcatggcttgctgcaaccttgaactcctaggcccaagcaggcctcctgcctcaacctcccgagtagctgggactacctttgctgctgcgcctaattttttttttttttttttggctttgtagagacggagtctctgttgcccaggctgatctcgaactcctgggctcaagtgttcctcctgccttggcctcccaaagtgatgggattacaggtataagccaccatgcctggccctgtgggaggtttcttataaagtgaaaccacttgttactcagaacggcattatgcctcgcttcagggtaggaaatagagaagcatcagcaaacccacctggaatggtaggctttttatttctctttctctagtagggtttttttttaaattttatttattttttatatttatctttaatttaatagagacagggttttattctgttgtccagcctggagttcagtggcacgatgatcatcactgtgacctcaaatgcctaggcttgcctctggagtagctgggaccagaggtgcataccaccacgcccagctaacttttttgtttttcttgtatagacagggtttcactatgtgtccaggttggtctcgagctgttggcctcaaatgatcctcctgtctcaacctcccaacgtgtggggttacaggcatgagccaccaggcccagcctctaaaagtgttttttttttttttttttttttttgagacagggtttcactctgttgcctaggctggagtgcaataacatggtcttagctcatggcaacctccacctccagggctcaagcagtcctcccacctcagcctcctgagtaactgggaccacaggggcatgccaccatgcccagctaactttttgtgtttttgtagagacagggtttcactgtattgtccaggctggtctcaaactctggagctcaagtgatccgcccgccttggcctcccagagtgctgggattacaggcctgagccattatgtccggcctctaacagattttaaggaagcttttgttctgtctgatatctgtatgatcatgggaggggagtggagtgttctgcccaccccagagtgacttaaattcaaatatttgtttgttcaataaatacttattgaataccgagtactaggcactgtcctaggtgtatctagaatgaagcaataaacaaaaccatgttattcccctcgaagagcttattttctggttgggggagaggaataataataaacaataaacaaaaacaaaaataaataacagtaattgcgtgcttatatatgccaattacatttattaactcactcttcagaatactgaggaagtagctgctgtcattatccccatttcatagacaaggaaaccgagatacagagaagttgaattaacttgctcagtgtcacatagctagtaagtggtgctgttgcattcctgtccaggtcattggactccagatttcatgcccttaatcactgtggtattttgtttctcttttaaaaaactgcccaatctgtttatttctaaagaaggaaagaaatgtcagtgatagtgtggtgaacagtgcagcaaggtacacagtgagagggttcttgcatgtctgtttgtgcatgctattctagtgtgactgagcgggtatctctcatgaggtgaattgaaggaagcaacactgtgaccacttgaaggaagcaacaccgtgaccacgtaggtgtctagagtgagtattccaagcagagggaactgcaaaagcaaaggcgctgagatagacagagatagatttggcaatggcgagagagaagccaggagaatgacaaggaggcctgtgttgctgtgcagagcgtgggaaggggcacgggaggggaggagccaggaagtagtgtcctgtgcagccccgcagggcttggcacggtcttttggttttgccgaaagagaaggaaagccacctgaggatttttgagcaggaaaaagacatgacagaaaggatcattctgggctgggcatgatggctcacgtctgtaaccccagcacttcgggaggccagtgtgggcggatcttgaggtcaggagttcaagaccagcctggccaacataatgaaaccctgtcactactaaaaatacgaaaaattaactgggcatggtggcggttgcctgtaatctcagctatacgggaggctgaggcaggagaattgcttgaatctgggaggcagaggttgcagtgagtggagatcgcaccactgcactccagcctgggagacagtgtgagactctgtctcaaaaaaataaaagtaaaataaaataaaataatcactctgaatgtagtgcagagaatcttccagggcagggccagcagaccacagcccatggcaggttctggcccactgcctgtttctatatagctagcaagctaagaatgctttgtatgtttttaagtggttgaaaaaaaatcagtattttatttcacatgaaaattatatgaaattcaaatttcagtgtccagttccagttctattgaaacagagccacactcttgtgtgtattatctgaggccgcttttgagctgcaacagccaagctaagtagttgtaacagggagcatatggcctgtagaggctgaaagatctatactgtttggccctttacagaaaagagttgttgatccctggtttgggatagaagtagggagaccagtgaggagactgttgcaagaactgatggtgccttggacagagcaggaagaaatggtcatatatgggttatgtttgaaaggaagagctggtagactgtattaatataggaagagtcagggatgatgactgtgtttttgcactgagtaactggaagaatgctattcttctttactgagatcaggaagactgagaacagcaggttggggaggaggggtgaagagaatgtaggttgtgttttgcacctgttgactgtaagatcaggtggagatgttcaataggcagtcgtatgtttgagtttgtaacttcaaggagaggctgaggctggagctagattttgagtgttttcagcatatagggggttctaaaagccgtaggactggatgaaattttttagggagtgtatacaatagagaagtccagacatggagccctgggacacccaatgttaaggggaagcgggtagaagggaggcaaaggagaatgagaagcaatcagagaaggaagacaggagatgggggtgtcctggaagtgcatgtttctctttgctttgctttgcttttttgagacagaatgtccctctggtctcagctcactgccatttccacttcccgggttcaagtgattctcttgcctcagcctcccaagctgggattacaggtgtgtgccaccatgcctggccaatttttttatttttagtagagatggggttttgctgggttggccaggctggtctcgatcccctgacttcaagtgatccacatgccttggcctcccaaaatgctgggattacaggtgtgagccaccgcgcccggacaaggaagctcatgtttcaaagcagagtgatatctatgtcagatgctgctaaagctggagcaagaaacagacgggtttcactgtgggcttggtagcggggcgatcgttggtgactttgataagagctgtatgagtgaaatggtgagaataaaagcccagttccaggtggttcaagcaaaaacgactggatagggagctgagctggtgctctgaaggaattctgctttcggcagcctaagtgtagggcaggagagggcaggagagggcagggagttggatttaacctgggattaggattttgccaggtgagtacagtggagggaggaggcataagggagttgagcattgcgcagaagaatcgatgtgaggattgaggatagaccatgtggtctaagccaggcaaggagccaggaggcatgaaggagctgagggtcagtaagaggtcatggggtcagtggattcaaggaataggatcgaggagttgttggagttgggatagtcgaagagtagatagagggcttgaaatcggtatcatggaggggtcagttttggttacatcaaggtcaggggctctgctgtacagtagcagtgtcagtgagtcacgtgtaatttttaatgttctagtaaccatatttttaataggtaaaaataaaggaaactaattttaataatatattgtaatatattttattttacccagtaagtctacattacatgaccatgtagtaagtataaaaattgagaagttacttattttggtatgaagtctttgaaattggtatatatcttatatttccattaccttctaatttgaagtagacacatttcaggtgctcagtggctgccttactggacagctcatgggatggtcatggagtgtagtccaggattatcacaggggaagtgtttaaaggaacaaggaggtcgtggttcatgaaggattggccgtgtagatctaaaaccatttctcactccttctgaggggagcaaggctgaagaggaaggaggggacaccatggcagttggtagaggtcatgtgcttcgatggctgaacctagcagccttttaccatgcagagaatttagcttattctctagagacacacacacacacacacacacacacacacacacacacacacacaattttgtttggctttgatccacacaatgtgtttttaaagatgaataaaaattgataatatcaggtattttttagcctcgtaggccaggaaaaagtaaaatattttgaaagagtaaacaggagcgtctcagcagcatacatgttacttttcatcttaatcatgtgagcctctcatgaaagcctccaaggaggaggttaatggatgccccaattctgtacctttatcaggtttaagcttacttcagtttccctttagtttgttgcctgcagtatcataattaaccaaagaattcttctcaaaaattaccctcaaaaatcctacaaaccccactgttaggaagcgagcccattttgaggaagtatttgtgaaccctgtgttcttggatgccttatgtgttgaaggaataattacttgttcattttgtagtgctaaaatcctgggaatgcgcagtctaagcagtctagagcatgtcagtatcccacctttggaaatctcctaggagcatgtagagactctggtttatcattaactgtgttgctttcctatcttttacacaaagtattctccttcccgcaccattgtattcacatgacagaaagctcagttaatgccttttagtaataatgaaagcttactcattacatacattttcttaaactctctttattctaattaaaatgtttccatctgatgaggaagtgtatggataccaagaagtggaaattaagcaagaaattaaaagaacattaatggctttcttgtaatttgttttgaggtttttcttcctgctaaatggtgttttgcttacagagtcacccctcacacagaaatctttatgatgaatggactggaataaatcccagcaaaagaagagctattttatgatacctcttgtaaattacaacacatgttatggaagtatttgcttttttaaaaatattagctttttaaaggcattgttagtataattaatttggcacacacacaattctagtttctttgaaagtgaaggtcagtgtgtgtgtgtaggggattaagaaaatgagagttctgacatttaaaaaattattttctatttatacctgagtcattagaatgctcaaaccatccaaagtataacatttaaacttgcagttcattcattccttcagaaatttgctgctgaaacttaaactttaaccagcatagccagcgtagccttaaccagggcaggtatttggtctgcagtaggcaagcctttgcccccatccctcgtcttcaggctgcagagtccacatgcatgccattgctctggtgggttctttttctggtcatttggacttgtctctactaataaagtattcattaacttgaaactcctacctctgaatgtagatgcaggtgaaagcagagaaataccaaacccaccccttcctgatgaagtgcaacatgccccacccagctgcatctcacctgctgcctcccctcctcctcccctgatgtgtggacactctttctgtccgttcctacttgctgttcccttctctgcacgagtccttcccctggagggcagcccgcatgccactcctcccatgcaccttttcttgggaactgtgttcagtacagcctgtcctttggttcactcttaccctgggcactgcttcccatgtcctgtgcgggcccttgccatagcatattgtgatttatctctgttggtgtctttactccactcaagtgggagctccttgggcaagggtgctggtcctcccttatttttgttttccttgagcccaccatctgcacgtggttatgggtggatggatgggggaagtgacagtggggtaacataccttcaagcccaaaatgtaaacttaataagtgttttggaggaagagaagaataaatactgtttttgtttatacaggtcttaaaattttggtagcagaaagcaaatgtgcaaagagcaatggaaaacaagtcagaagctgctgtctgattccagaggaactcgtattttatgttaaaaaaaatgtaattgacatttgattgccttgaaatcttcaatttgttgtgctgatatcttaagtaactaattatttagttgaataactactagggaaataggccataaatgtcactcgtgctttccttgtaagaagcccacagctcttctcgcagcatgctcttttcagtacctgttctaggtacttgtgacttgtgaaagtcactggcctctgcgcattgggcacaggcctgaaggcgatgttttactcacattttgtccactggaattaaacagctgtgctgatattcagttgatttgaggtttgtttggaaatcagtcccaaatttgggaagcaaatgagacagaaccctccacaccctaccacatgcttccagctcatcccatgaaaactcatgagcacagtgtggagtgttttatctacagccactccctttttgacccttcccccaaaatagtgagggagagaaatgaaagaacagatctggggcttgccttcagcttcactgtgcatttttggtcattttggtcattttagaagtcatctttcacttgttaggatgttacattaattgggagatgctagtcgttttgttcatggaaaccagagtatccctttgaagtattatattcttctaatctatgaaactggcccaggaagtaacaatgggaagtgctggaaatggaatttaagaagtccaccttcttagtcctgtgcttaagcagagagtctctagcagggagcctctgcaagcattgtgttctgttgtatcaatatgtacttagatatgttaatctgaattagggagttgattgtacataatgactcccctgggttgctatgttagaagaaaacccaaaacttaagtagtttgctgaatatgcatagtaagtaaaaaaattcttccaaaattagtgttaattgaatctgagccttgatcttctttgaacctttaattttttatttgatcttttaaaaaagttttgtggcctcttaaagataaaacctacaacccaataaaagtcatgctgtaacgattgcaaaaagaccattgtatgagacccagttttggattatcataggcgaagaagtcagacatatatggttgtatgtacatgtgtatagtatgtgggtgggggtagatacatacctgttcatctgtatacgtatgtgtgtgtttaatatatactttagtttgcctttacccagatgtctcctcctctctctgcctctggaaatggggcaaatttttcttcagttaaaaacagaaatagaagcgacggttttgacccattttacacctatttatttcaggctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaaatgaaatagaataaagtgacctactcttgcctcatccggagttattacgaaggagctccgcagcctgactgagctctggagagcagggctctgtgcacacgcctcctggtccagaggcctccgtgaccatccatgatgccactctgtcccctcagcaagctgcctttttcttcctagcacctgccccagcggtggtatgttttccagtcagttaccacctgtctcatcagaatggaagctccatgagagcagggcctttgtcttgtccccttgtatcttcagtgcataggacagtgctgacacagtgcagagtctaaataaacgctgttgaacgaatgtgtgggtcacttgcgtcgcatcctttctgaatgtttttcctttaacttgccatttataaataccttttccaatgataaagcagtgaaagtttggaaagaagcataaagcttttgttgtgattgaagtaactggaagcctagttcagggtgctgtgagaagctggagcatatcaggactttggaattatgaattacagacttactatatgtgatggtatcggtgcctcctgaagaagtagaagacagagatgcatagaaacatgagtcatgtctctggaatactgtaatatcgacatctagtgagagtctagaaagaaacatggagaaataaaagggaggcaggaaacaggcaaatacttagtggttctcagttatttaaggtaaattttggcatcgagtaaacaagataaatcaaaatattttctagatcaagtaggcattaacaaagatatagaggaaacttggaggcgattacttagataatactaacagaagtacttttgttccagatacctccacagatgccatggttaccccgtctttattcgttgtgtgttggcataggccagaataccaatattgttcttaaaaacctttgaggaagtttttctttttttctttcttttttttttttaagcaaagaacagaaacaaaaccaaggagacagtatcctgtgatgtaggctgttacctcaaggtgagtttatttgtagcactaacttgtaacgaattgtttaaagaactgaaacttctttttaggtatagcttatttgtcagattttgttcatttcagtgtaaacttcagttatttattacacactgagggaaatcaactaaaatcaggaaaaccaatgtccaattgaacttgagttttattttgcatagagaagtaaccaatatttctgatcaaaccattaaagctgtttcagttccttttaaataaaagcaaaggctaaattttttacataccacaaagcaaaataaaacgaaaaaacctttggtcatgatgcattttttattcaactgattgctgaattattttgattatataatcttacactcttatgaaagtataacaagtatgaattttctgaggtgaagaaataaatgtagaaagcagttaatgaggcagaactcacaaatctgtatttatagtttcatggcaaataaatcataagcagaggatacagatgtaaagaaaaattcttgattgcattcaagaaatgcaaggtcgaactaactttttactgaaatggaattgtatcgctgctcagagggatgtggggagtaaagtaagtgggatgtgcttagaacagcaagctaggccgcagtgcgcactcgtcagtgtctgctgcttgtcttacgaggattctagcacagaagattaaatcatgttttaatcatgcttaataaatggtactgtagttttattatggttaatgtccacttgtaattcaatgaagagtggctttttaaagcaaaggagaaatcagcatgtttttcttggcgctcttatattgtgtgtgtgtagaagatgctgggatgggttatccatacgacaacccctgtgaccagagatgcaggagcacatgcatcactcttagttttattttatttgttttatatgttattttcataaatctgaaggtttgatcagcttactgtttttagtattttctgctgctgcatgtgtgtacctttaagttttgtagaattaaattgaaaattttgaccagcaaatgcttaaagccactgtcaaaattacatagttagcacttcattgatttgaaggctagttttcattcaacattcctgcagtttgtgtgtgacctgattttaaagagcagttccatgagttagtgccctctggtggcacacagaggacgtcaggcagagagggactctgacccaggagccttccggaggctctgctgaagagaagccagtttatgactggccctgtaatttcatattttttcatgtgttcagtgctcgtcagtttcctactccattaagccatggccctggcattgactcagtaccagctttatagcaagtcttcagcagcttaggttgtgagggaatttccaggtggacttgatataagaagggattaccaatgttgagatttcccatgaggaaccaggacatccatttttggatgcatctcttagctccttttgaagagcagaccatgtcacttcctgggttaaggaaggaaggctccctgatggcctttgagtgactgactggcacagcttggggtgggccttcagtgggttagtctttgataggcctttgtttcccattttggtcttccctggagggcagcccaccttgcccacttaggctcttggacagttttctttttttttttttgttgaggtgaagtctcactctattgcccaggctggagggagtgcagtggtatgatcacagcttattgcagccttgacctcctgagctcaagtgatcctcctgccttagcttcctgagtagctaggaccacaggtgggggccaccatgcccagctgatttcttaatttttctgtggagtcgaggtcttgctattttgcccaggctggtcttggaactcttggcctcaagcagttttcctgctttcctccccaaatgctaggattataggtgatgagccaccctgcccagcctgcttggccagattctgtactctttaggcagaccaaaaactgaatcctgtcatcactctgaaaagttgtgggacctcaagaaagtcactctttcatgagtttctttagctgtgaaatagtcacagattctaagctgtcttttgaacctgtgtcaagagagagttgtgaggatgatgtgagatgatgtgtctgagagtcctgacacattgacctatgcagactgctgctaaagacatttctctttccttcctcaaaggcaagcctccccaccttgattagaaggtcattaaaaaggaacttcatttgacaataatcccatatttataatgaagttgctaagatagtttggagtgcccatagatcccttacctggtttcttgtgcaatccccacttttatactgttgagtttccctgatgagttttcatatatataatctctgtgaacttggatcaaatttggcttaaatgcctatttaccactttgctaagacagaaatgtttgcgctcagtccctgaattccattgtagatgtgttggcatttgcttccaaaccatccttctggttttagcttgccctgtgtctgtggtcatttgacattagaatagccttctgtgatcttccgggatcttaacacctaaatattttccctgcttgtacagctaatgagttgtgcagcctaaggaaacatggggtagtcagttttcatcagtatttcaactaggcgtttttgccatctcatagctacttctcaagcaattacaatttaagtcaaggtagtagcacctgcatcttcaaaaaacaaaacaaaaagttttttatcttcagaaataaggaaagaagcttattggacttcccaatagaaagtccaccagccaattttaatacataaataatctatgattagcattagtatatgaaaaaaatagtagcagctcagattttatgtacttctgcagtttaagaaagtgatgccacagacaacatctcatttggtttcttagcaaccctgaaagaccagcaaggagagcttcgtccctcccttttcatgaacctgaatgttgtaagggaggccaaggagtggcctggtgagactgcacagccagagttagagcccaggtccacgtgagtcattgtacagacacatcctgagcaccagcccacccacttctgccatcaggaggctttgaaactgctgtggttcccctcttaaaatggctaacctctacttcagcaaccttatttatgcattcatatacataatcattctttaaagtctagtagacaattttcacattttgtttcagcccagatctttactaaattttgtgagatcagcattgttgggcttgaattaaccaaacttcgccatactgtgccttcagaaatcccagattgggcgggttgtgagttcatctcatcctcttcctgacattgacactaccagcaccatcagcaggctctgggataactgcggccccctctgagaggctacatcttgtttgcgatctgtgggttacatattgtgctagagataaaccttgacagtagagacgtgtgacatattttttacaagagtcactgagatacttgaatgagaagatgatgtagtttgaaaaagtgataaatgggccaggttcttgagaaactagcagaatgtcttattgaaaccttgggatccaatctgaaaacagaaatgagtcttccaagcaaatttttttcttttctttttttttttttttttgcaaatgtggtgggggtagatgcttttatataaattctatacctgtttctgtggtataaaaatcaaattttgtcctcttttgcctcggttggttggtttcattttcaactaggtctccgtttctaacagcatctcaggtaacttttctgaaaaatgtgggttcagaggagctcatgtgctggtggctgtagtggcagctagttctagactatgagatctcagtgaccactttggtgggtgttttgttttaaatcaacaatagaggtgaatctgtactacaaagtaaaatgtatgagtagataggttttcatgttttgaagttttttatcttcagaaataaagaaacagcctcattaaagaactgttaaaaaaaaaaagagctgtggccgggcgcggtggctcacgcctgtaatcccagcacttttgggaggccgaggcgggcggatcacgaggtcaggagttcgagaccagcctggccaacatggtgaagccctcatctctactaaaaatgcaaaaaattagccgggcatggtggcgtgcctgtaatcccagctactcaggaggctgaggcaggaggtggaggttgcagtcagccgagatcgcgtcattgcactccagcctgggcgacagagcaagactccatctcgaggaaaaaaagaaaagaagaaaaaaaaagctgtttgtctgttctagcctggcacctatgagttctggagcagcacccaaagccagttcctgctggctttcctaggagcctctttggcgtgggtgggcgagctgctcccttgcagcagtttcagatgtcacttgagaaaaatatttgttgttgtttggttgccctcttcagttgtgatgcttttaggaagttaggaaacagatgagacagtctggctggaataagagggtgggtaaccactgatctgagatcatccctgttgattaggtttgcagaattctaaatggagattgtagcttcacatgcgcactgagggggttgtgcgttttcataggcttatgttccatcgggcttctgcatgatcttggaagagagagactaggtgtggttcttggctctgttggctggtgggtttagctgtggatcacttaagagacccataatccttgcttttgtaccgttctgtattccgtttgtcaggctgcgagggaagggggtttgtgctaatttgtatcttactgaccctgactggaaaagagattaagattttggttgtataattaacataaatgaccaaaaatatcaagcccactcctcacacaggtgacccaggcatccaaatatttactccaatgattagtgtctttcagctgtagatgggcacttctttcctttcctttctcctctctcttttctttacccaccagatagattcacactgaaagattaaaacaggctgtgggatttaaatgctgaaaatgaagattgatgctttcaggtgccttgtggcaagcacaattaagtgaacggagaactggggcaattgtttatttgaaggttggtgtgacatatgaatgaacttattttttcagtacccacccatctacccggaactgaaataggcatttggagtaggttttgcattttaggttcaattttaagaaccagccattcactgtgaaagcgaagttgctgggaagtttgttttaaggatgatgccaccctctatttctgtgaacccagtaaaaatagcatggaataaaatttaattatgctatactgaatatttcatgtggaattaaggggcaaaagctgcctttaaaaagcattaggtttggaaagaataaaggctttgtaggttctttggaagatactataattaaaagatttgctcaaatgtatttttccctttttgaagaatttaaagaaatccatccctcccttcctaaattgattacctctcaagcgtcagcccttcttggcagtaaatacggtgaagctgccgctgtgctgatttgacggcttctttctgttaaatgtaaaatagttttttaatcttctgatttagatgtttaatagaaagtaaacgtttgacttgctttggtttctgctgaacctgtatttaaatccacacaaacagtttgaataaagtgaaaacatcactggactagctattttaaacatttcaggatataagaatgctaaatgggggttccttttaaaaatagaaatggcggcttgcatttacataattactgctaactagcacaacattttaaatggtgacaaactcagggtagaaaaagtatctgttttaaaagcctggtaaaaggaagcagaaaatgctctgtgagcagctgcttcagatggagggtctttgcaaagccgggagaccaagacttttcagtagggagggcgaggtcaagggaggaggcaagaggtagctcaggcaaactacttacaggccctgagcctgtgtgtgggcctgaactcacccacctttcattttggagcatgattgtctaagtattaacacttaaatctgccttggtgtctgtccggacagggtgcagtgttctctgtccgctgttaaaaggtgtcaggtgagggttgaagttcaaagttggtgaaagagcatggaagaatatttatgaacatgaaggctgagattcacttaacacaaactcatcagtagttcaagccagaatctcaggcctgtccttgattctgcccttttttccccatcccagacacccatctttctccttccaaaatacatccatctttgcacatctctgctagtaccaccctagtccaagccaccttcttttctttgcctggagatctgtcacattttcctgtgtggacttcatgtctccagtttgctccccttggaatagattccccatgcactagccagggcaatctatgaagaatgtaaataggattcgttcactagcttaaaccctacagtgactttctatccatttggagtccggtcagcatgaataatctggcctctgcctctccatttcctaccaggtgcctcttccctctaagcacccttcccatacggggaatccatcaaacatgattcttttttgcattcgctgttttctctacctaaaattatttcctctcctccccatctttgtttgctggctcctttgtgtcattcagggctcacctcaaatgttatatcctcagagagaccctcccccgatagcctgatgacaggtgatagtcccctgtcactctgtcatgtggcagtgtggtttttttcgtagcatttattactgtctgaaattgtctcttctttttctttttgtcctcagctcttccccatcctattagctcttttagggcagggggccctgtctatctccttttcagctatgttctgagtagttagatgtacctgcaagtgcctaggtatccattgattaaatcagtgcaggagcggaaccctgcagatcactaatgcccaagaagagctcccacttggtggaactagctgcctagaagctgctcctcaaattcttgcccacattttttttgaaccgtttgggaaaaaaactgctctaaactttgccttttagggttgaaaattgaaatttggggattcacagaatgcttgtacttaaacagaatcagcctgtgtccctagaaggacatgaaattcccctagttcaccccaaatgagatgaaaatataatttcctagcattcttggtccatagtaggagttcaccagtggcgatctgcctctgtgtccttcctggggcagtgggatggcactgcttgcctttgctgaagactgaatttgaattccctcagatccagccttcggagccagatagcattttctgtgatttctcctgtggcgtgtctggccgggatgctttctgtgttgaatgttcattttggggttaggtagcaaatctgttaagatagagatatttgcggaaatctaaactttggtcagccacttttcgtttcattagttttccacctggcaacatccaagcgttcaggaggaaaacatggtaatggctactgatacctaggcagttgtgattccttccctaaagaagctgatgcagagggttcaattaactacttctgaggaaccctttgcatcagcttccttagggaagaaaagaatcacgtttccaactcactgagtctcaaatgtattatgccactccaagctgtttgttgaagtatttactttggtcttgaatatactcgttggggactggattgtagaactcaggagacccatctgcttggcagaagctcccctgtgcaacttttcattcttgttgctgtctttatcagggcattattacagtgattgggttgtgcaaggagaaacagtaacttcccagttaatttatagtgaaatggacctttttagaactgagacctagagataaagccatggagctggaggatttcagttgcttttgagtgagcatcaattcattagactagttttaagagaacctctcccttctcatgtttgaccagagctgaagatgcctcgactctgcctggttccccacttgcctgagtagagaacaggttcaggtaggagggaacaaacaggttgagcacaggcagagtcaggaaagggcctggcctgttcaggatcaagatgtgtgaaatgaaggtgggaagatgggggtggaaaatgggttttgaccaacatatggatggtcttgtgtgcaagaagcatgtaagcacagcagattgtgttcccatggtgacaagctgctgagccactgtgtgtttagggtcagtgtggggcggggagtagtgttggaagtccatgtcagtcattggtttcctagttagtgcaaactcaataagcctgtatttactggaagccatttttctcatatatacacccccagattgtatatcgcttttctgatttgactttttggctgattgcttttgaagttaatgtggtttagtcaactgaatgttctaaacatctccctttacctacctggtcggtactcctggtgagtttttgaaaggcagtgtctttcccacagagattaattagaagttagtgtgtgcagtacacttgaccctatgtttgacacacattcagtatatggtggtgattatttgtttgaaaatgaaacagagctctctgatggaacctgaagaagtgggattggcacttctagatggatatatgggttgtgtttaactgctttgaatgttagtaagggaaaagtatccacttactattgttcatttcttttttcccagccttaagagccaaaatgattttctgcccacaaacgtcttggttttctttttctagcctgtcttttcatggctaagatatttgcagaaatttctggctagccaccagtccataactttttctcttctttgcagacactgtgtttagtggtatctgaaaaaccctacgaatccaaagttgtttaccctacgaaagttgagattccagttcatttgctaacctgcagtttcttatttcttgtcttggtacttcagttggctcattaaatatttcttaaaattggttgaggagcttaaatatttgttaaaattgtaatgtgtcctgatttagaggaaactaattattatgtacatcttactagatccatctgttgcccattcctcagatacagtgatagaaggagagagaaattctgggccgggcacggtggctcaaacctgtaatctcagcactctgggaggccgaggcaggcagatcacgaggtcaggagatcgagaccatcctggctaacacggtgaaaccccgtctctactaaaaatagaaaaaattagctgggcatggtggcgggtgcctgtagtcccagctactcgggaggctgaggcaggagaatggtgtgaacccaggaggcggagcttgcagtgagctgagatcgcaccactatactccagcctgggtgacagagcaagagcccatctccaaaaataaacaaacaaacaaaaggagatagaaattctgtctccaggcagataagttatagttcatagagtgtgagagaatgggctcataatggaacagttatcctgggtggagttggtgcttcgtgatggtacagatgctttccagggatatgctcaggaaagatactggaaagagattttcctaagtctcatctcaaatgagctttgctttgcttcaactggcctaactcagcaggcccagctagcctgataccaagaaggacctccagcctcttgttgcctagccgacctccaaacaggtagctggccaacatggggccccctggtttgttttattttgtttgattttttttttctttaaatggaatagatgatctagacgtagcaccaaggtgcccctgtcttccatcaccttcatgtacctgagtacccacaagctcgcctgtggatctgtaggaaaaccaggtaagtctctaggatctgtgaggtcatcggtaccgtggatgcttcttcagggtggggagggtttgctgccattgatagccctgcaccatcatggaagcgtgcccagtctgtttccccatctttgatgcactgtggatgataaataatcatcactgctgtgtgatggctgagagggattccagccagtgtgtgctaggttatagtgttttcctgatggatggagcctattctgggaagcagcttattgtctcacgtgaacaggctttctaaaataaatgactgctttcttaatattttgaatccttttcttcagcacatgttttgttgccgtggtttgaaagcttgccaaatatatgcctttgcacaactccctgtagggctgggtatacaatcagaccaaacagtgtgatttaagtttgagcataattgggaattcagcaatcacttgccttgcatttgatggaatggcagtggagtgcttgagagttacttcgctgttaaaaaattatatgtgtataacgcgcacgcgcgcgcgcacacacacacacacacacacacacacacacacacacacagagtttcactatctcataataaagttgtacctgaaaccactgggcaaaaataacactagcatgataaataattgcttgatttttgtgatggaggcaggaattaacttcaacaaatcatagcagttgatactgtagatatgactgaggacttaagttatataaggttgtggaatggaagaaaatcacgtggtggcagcaatacattttaaacacaagcccttgtcaagtccttcatcggttgatctgtttccttgtttctgtgtactttagtaattgagccataaacttggtgaacttggtgttgcctctgtgttatacaagcatctttggattttacattgccaacactgtgcgtgtttgttgctgttggattgtcagttacctataattgagaccttttcgtgtgtctctttgctggtgggaaaaatgctgtcaacagccccactccctgcagctctttgaaaagtcacatgtgaaatccagagtttgtttaccaggctgaaagagatcactttaccagaagcttacagtaaatatccaggtgatagagcctggagatactaaacatatgctgcttcattgcttggtacattggtagtcatcaggcctgccaccagcactgcagactgcacaggacacagaggtggtgtgtggaagggataactttgaaactgtgtgtaagttatcatagccaccagagtttcttgatggtggcctcccgttcccgtgcaatgagacagcctcctgtcatcccttgtaagatggtgttaatctgacaagaaagggaagtaaaaactctgaggtcagaattcttaagtttttttttctggaattttggacactttctaataattgaaaagcacctgtcttttggagttttagacagtcaaattaatctaactccagaatttagcctttatttgcaaacaacatgattatgaaaaacccatggaatctatataaaaaaaaacccaagcacctatgagaataaatgaattcagcaagacaacaagatacaagatcaattgtatttctatatattagcaacaaacaattggaagaggaaacttaaatatcagtaccatttacagtagcttcaaaaacttcagataccttagaataaaactaagaatatgtgtaagacctctatgctgaaaaccacaaaatatctgtgagagaaattaagagaagatctatataaatggagggctataccatgtattgaaagactaaatagtaagatgtctgttttccctaaattgatttatgaattccgtgccatcctactcaaaatctagataaactaattgcaaggtttttatggaaatgcaaaagatctagaaagaccaaagcagctttgaaaaagagcaaagctaggagatagcctgatttcaagacttcctgtaatgctacagtaatcaagacagtgtggtattgcaaaaagatggacatataaatcaatggaaccaaatagggaatccagaaacagatccacacatagatgctcaattggtttttgacagaggtgcaaagggaattcaatggagaaaggatagtcttttcaacagattgtaatggaacaactggacattcatgtgcaaataaaatgaacctcaacccataccccatactgtatataaaaattaactcaaagtggatcatagacctaagtttaaatctataagccttctggaagaaaacatgggagaaagttttcatgaccttgggttagcagtgatttattagatatggcaccaattgtgcaatccataagagacaaaacatcagacttcctagaaattaaaaaatcctgttcttcaaaaggtactgtttagataatgaaaaaacaagccacagactgggaggaacctttgtaaaacatacgtctaataagggatccataatgtatgaagaactttaaaacctttaaaaactttaaaacaacccaatttaaaaatgggcaagagagttctctagacatcttaggatacacagatggcaactaagcacatgaagaatgttcaacagcgttattcatcattgaaatgaaactaaaaaccacaatgagatgctggtacacagttactagggtatcttcccaaaataaaaccaaaaagaccctggtaataccaagtgctggtgaacatgtagggaaactgaaactcttgcctggtgcggtggctcacacctgtaatttacccagcactttgggaggccaaggcaggtggatcacttgaagtcaggagttcaagaccagcctggccaacatggtgaaaccccgtctctactaaaagtacaaaaattagccgggcatggtggtgggccccggtattccagctacttgggaggctgaggcaggagaatagtttgaacccaggagttggaggttgcagtgagcagagatcacgccactgcacttcagcccgaatgacaaggtgagactgtcacacacacacacacacacacacacacacacacaaaaaaaaaaataaaaataaaaactcgtactggcttttaggaatgcagaatgctacagccactttggaaacaacattgacattttcttataagtctacacttaagaatcttacaaatctgcatttacagcaagacccagcaatcccacttctaggtatttacctaagagaatataaagttatgcacctacagaaatttgtatgggaacatttacagcagcattactcatgatgttcaaaagctgaaacaacccaaatgtcattcaactggccaatgaataagcaacttcattggagtactactcacagtgaaaaggaacaaagtgacacaacatggacgagtctcgaatgcattatgattagtgagaagaagccagactcaaaaggcctgattctgtttatgtgaccttctggaaaagccaaaattgtatgggaagaaaacatcagtggttgctgtggactgggttgctgtgggtgggtcggttacagaagagcacaagggaactttttgaggtgatggaaattttctgtatggtgtttgtgattgtggttatgcagctctgtttgtttgtcagaatgtatggacctgtgcactttgaacaggtagttcacaaaagaagttatacacatggccaataagcatgtagaaaggtgttcaacgtcagggaaatacaagttaaaaccacagtgagatgccatctattattagagtggctaaaataaaaaagactatcaacatgaaatgttggtgagattgtggaacaactgcaactctcaaacattgctggttggtgtatgaagtagtccaaccccttgggagacttgattggcaggttttctttcctgaaattaaacatacatgtacaccatgatccaacagttccactcttaagtatttactttaggaaaatgaaaatatatgttcccaaaagaacttatataagaatgttcatataaagccaaaaatagaaacagcccaaatatccatcaactgaagaatgaataaattattacagtggaatactgctgagtaataaaaaagaatgaactactgttaacaaccatatggatggagctgaagaacagaaggacataccctatgaatgcatttagataaaatccaagaacggatgagaccactctatggtgatcaaaagtgttttcttaagagtagggaggggaattaaccggaaagaggcaaggaaggttttgggtggtggaagtgtaggctcactcccattttgggtagtgattacgtgtttatacacttcttaaaactcatccagcagatgaagatctatacattttattgtatgttaattataccttaattaaaaatatatttaaaacccacttttacagctgttttattgaatcctaagtttatttagaaccatttattctgttgggtcatcattatgtgcattttgcataacccaagtttctatgtggtgcatcttgttggcattatccagtattttactgaagcacgaggaaagactcagcttgtgattgtgctcttggacatggctcagagcttcagaatatccaaggaacaggtgagtaacccatgtttctgaccctgggtcctataggacctgtctttatttaccagttcaccatctgtagaacctcagtgttacgaagaagttgaagactttccatatgcctaatcttaaggggcaactccttccagaaactaatgtagctggaattcatcattatggattgagctggatgggtgggaaggaaggaacggtgtggacaaaggattggaagagaggcccttgctccagtttcctgtggacatcgcagaccttctttttatctgtactctccatgggcagtgtcatcgttgggcaagacttctatcattaccactctgttgacgattcccaaattatctacagtttattcctctctcttgagttcaaacgacatatccagatatttattctaccttgctcactctactcagcaatgtgctgccattctcattttgtgtaagtttctcctggcccttccctggtactattttctctctccatttcccttcccattctttccttcaccacagaaatcgtgcatctgcctcctcattccattcaataggcacttctcatgttagaattcactgaacacgcttagttattaaatcccatggcctcttttcagccctcatccttcctggcttctctgtagcatttgttgatgttagctgtccttttcttgaaaggagacctgtctctccctcagccctgggacaccgtcttcctgcctcaccatctggtccctgcccctttcaagggcaccctctgagatggctctcctgagctttatattcttggctctcttttcttttactaagagctctctggactgttttctgatttaaatttctgtttatctgccaatgacacccacatctatatctttaggctctcctcccctgaactttaagcctttttttttctttctttctttttttttttttaatttttgagacagagtcttcctctatcgccccaggctggaatgcagtagcatgaacaacatagctcacagcagccgcagcagcctcaaacttccaggctcaagcagtcctcccacctcagccactcgatatctggaactacaggcatgcgccaccatgcccagctaattttttttttttttttttttttttttttttttaatttttggcagagacgaggtcttgctgtgttgcctagactgatctcgaactcctgagctcaagtgatcctcccgcctcagccttccaaactgctgggattacaggcgtgagccgccacacctggcctaagcctttgtttcgtattgcacgctgaacactccgactcgctgtgtgtccaaagccaaacattctttctccaacaggttattcgtgtggtttgctgtgtgtcctgaggccagtggcccacgcttgccactctggggtccgctctgttgctgtgtggcactccctggagtcatgaatgaagatccataaattctgcctgtgaacttcatgttttctcccatcttctccatctccactgccccagcttgggccctcgtgagtccctgaactattcctgggtctccttgccttgttccttttttttttttttttttttttgagacggtgttttgttcctgttgcccaggctagagtgcagtggtgcaatcttggctcactgcaacctccacctcccgggttcgagcaattctcctgcctcagcctcctgagtaggtaggattataggtgtgcgcaaccacacctggctaatttttgtgtttttagtagagacagggtttcaccatgttggccagggctggtgttgaactcctgacctcaggtgatccacctgcttcggcctcccaaaatattgggattacaggcgcgagccactatgcccggcctgctcctcctttctttaccatccacctctgtcttgccccacccctgccaccagccccgcttccctctcataataaagcttcagctcctagtggaaccctttgtccatgcagtcccttggcccttctgcacttgggtaaaggcttcacattcaagtttcagttaaactctccctcttctctgtattgtccgtgcccctgccccctgctttgcgtttgcattgtgctttgtctcttattaatagttcatgcaagtatctgtcctcatacttagagctctttgggttagtgcctgcatctcttattgcgtgttctggggccagatacagggcctcatatacagagtgtgctcggtgcagggttgccagagtgcagagttgctgcctgtggaccctatgggaagtgctgcttcatcctccctggagtggctcctgctgctggttctgtgcctgcagctcccacacacgcctctgctccttcagatagatgtcctgaagggatgtggagctggtgttgcctgtgggaactctgaggctctggccacaggagcccagcacctgcttaggatcgtgagccctccaagtcacccacggtcttttctgacaagccaggagcgactgctgttttatctggaagctttccagtgggtgatgctaagaagagggattccctctttcgtgtcatgtcaaatggtactcccaggtcctcctcctcctggcaagatgagggaggagggagaagaatggggagaaaccccctgccaaggggtctttctggatatagaggtgccaaatttgtataaaggactgtcttcccaatactgagcccagtgcatttgttgtgactaggctactgatgctagctacttagagatggcagaaaaggctctgcttttccttcctcactgtggcagggccatgggtagtggcccttctcccagccttaaatcaaccaaagaagaggctctatcctagactggctctaccccactgacacagaaaatcagggtggtggcaggtgctgcaggcaatggcgggagatgtgccagggactttggccatgggagcaatggagttgggcacttttaattgatacctttaataattattgttcaagcaacagaaggcaaagtggaattgtttcaaaggcaaattggagcaacaggagcttggaacttggctcagaaatgtgtgcctaccttccccactctggctgttgttcgaatatatttttcctttaagtttccctccccctcattttcgagtgcagcagtcttttccctaaagggagtgaaagaggaaggtgctaaatgaaatattctcatgtagttattatttgcctggggccagttcaagtttctaaagtaaatcaaaatatgtattttagctaagtttaaaacctttctgccttagccatgtgggcaactaaggagaagcagttgtgacccgctgtagaggtgggagctgttgtctctcccatcccccgcgtcccagccctgtgacatggcctttgttctctcgcaggaagtctcgggtctgaagaggaaattgagatccatcttcgggataggcaggcatcatttaagatctcagtatttaaatatatgtgatttgtctgttctaattgcttttcagttttgtttgctttctaaaaatccggtgtgtggtttctgctgtgtccttgagttggtaaaacagtaagagttataggatgttctggaggccgagcagcatcatcaacattcagtgtttgctgagtcgccagacatctgggctctgggatggatggagggacatagtccctgacctctaggaactttgttgtaaggagacatggcaaacgaacttgcagtctcagcagcagctctcccggcgccccctcctgccctccccccgctgtcccgtgtttctacgcagggtgcatgcagaggttttcaagtgtgagtgggttgctgcagcttgactcaagaacacttccccagcagggcatgctcctgggggagtttcacatgaaggcaactgaagaattctggcttgtccagaccgccgctctatgaccttcagtgagccaggcaccgttcggggcttcatgggactcctgctgaatggtgagccggtggtcccctgggtccatagtctcttcccagtaagactgaaggttctgagtcgagcagcaggtacggggccagcctgcccagggcgtaaggacgaccacccctggcctgggaggagtgccctcagccactccagaagtagcgtgggcatgtgccccgtgactggcagaccagtcagccctcggtggggcccttcctgtccagcccttctgctcctgccccacctgggagccactgtggtcctcagacctggcgcagttccagcctctcccgccccactgtcattcctgcctgcccatcacagtgcccacaaaacccagaggcctcccagccctattgccgtggtggtctgccttccggctccctcgccagcctcgtggcctcatgtcttgtcactttttccttgcctactggagccaggctggccattttttctccctcagacgtgccaagtaagttgctgtcccttctgcctggacccccagacagtgcccaccctgtgacttgagaaccccttctttgctcgtcaccctttatgaagaagacatcccatccccttctgcctgcatcattttcttccaggcacttaatgctatccgtcatcatcccacgtcctgtcccctccagggtgccaaggcacacgcagaggggccgttactccccctcactcccttcacgcctcttgtgtccagcagtgcccacggcaagcaggctgacaggccagggttcttgccttgtttctccaccatgccctctgctctcaagtttatctcctggctctggaaatgctgcccgctgctcgctgcaagtgtgaagccagaatattcaagaagtatatttaaagtaaaagttgagcatgctttccccaagaaaaggttttcatgtcagtgaactggcaacgcgatcacctcctgatggtctactgtcaactggaggctcttaggaaagtggctctgtcatcttctccagggtttggtgcagcccaggttcatagttgtggattatagtcctcgttccttttcttggggtagagagttagggaaatggacatgaaaatttttaaaaatatgcttggttcaactttgataacatacccttcatgagactctggggttatggcattgtgagctcaaccccagagctaggtaggagtcttcgtggaagtgctcctggcttcgcctcccctgcagctgctcagtgggacagcctgtgccagggcccctgaatgtgcagttctccaccaggagttgttattgacaagtaagtgtgcaatattaatttagccagatgctggcatcttcagaatcacacatgagtattgagaagtcatggctgaaactgctcgatcaatttaaatttaattaaaaagcatcgaatcaaagaataacatggcgaagtacaataataaccacaagcatctgcatcattttatatcataatccttttaaaaatttttttccaatggtgacaggtaggattaagcaggctgacttgctacgttctcttctactcctcaagaaaacaaggatttcctggcctctaaaagaaaactcaatttatttgtctgctttgatcatctgaagtattagatgtggactggagaatccttgggacttttaataatttagatgaaaggacacacaaagtcacctaatactacttaataatacctagtacctaatatttggatacagtatgtctgaattacttccgaatacttgtgaatttctaagcaaaagtatagttatttcattctcaggaactccctaaaaatgacaaagaagtgcttctggcatcacgagggaggttggaagcaggcacaatttggaaattcagagccagaaaaggcccatctccagcagggtaacagttctcaggttggggcggggggcctctaccctgcagtgggctctacagcagacccttgggctggcagacacagcaggcggtagagctgtgcctcacaggggtttggctgtatgggattggcgcagcccatggggcgtggagggctctggtctcctaaggggcctctgcctgcctgtgagtttgcaatgagggactaactggagcaggtggggtgacccacaggaggtggcctgggtacattcagctctgtcctggactgattctgtgaccttgaggatgagccagatacaattaatctgtgtgcacaaaaagacttggggaaaagactcctgagtgaacttcctgggtctcccggttttcaggctcagctctaagcaaggatagtggtgacttttggctttggcccctctggtgttaagctgaagccaaggaagttttcctgcctctgcatgtacttaggctggttgccccaagggtggcccagcctgtatggaactctctggagcagctaacctggtccaggtcaccaatcctgaaaatcagttggcctttctcacaatgtgccattgtggaatttgcagcaatccttgtttgcttttggctttatctatatattgactaggtgtttgggtccaggccaagccacttgctgtcctcttggagttgacatgctaaggcactagtacccgttatagggcccaggtggctgcccagcaatgcaaggggcaccttgtttattgttctcctgctgggtcataattaaggttcactattcagatgattccaaagccttcatgggcttgatctaggtgacctgctggtttgaaaggagaagctgtagtctcaaaacaccagtatggcaactgtttttttcttctttttaccccagttttctttcagcttctgcataggcacagagtcacctgggtggccccaaacttctttttagccaggctggaacgtaactttgcagggttcattccctctactgaaatgtttttgctacattggaggctcagctcattttttgaggggagcagggtggggagggaaatgctggtcttgtttcttgaaaggaaaatgctaatgtaacttgacttgggcctgagctgttggaaagcgggtctctgcataccttgagtccctccaacatgtcactatctgggaaggtcattgtgtccttgcagtccatcttgtgccttttctgtttatagagcgcagcaaacagggtcaggaacccatgctgaatatttaatgaggaaatatttcaaaggcggaggtgtgcttgcctgtcacctactggggctatatgtgggaacccaaggttgctggatccgtggagctttggacccaggccctgggctgctagaaccctgtggctggacttcagcagctcagaaccttctgctgggggtgctttgttcataattgctcaacagtgaggaaatggaagtggcgggcaaggagtggacttgccagggagctgtgtgtccccattgctcgcgtccaggatgtcatcctaaattgcagtacatctgctaatgaggagacaaggtgttaccttccgtttggagcagctgcattaattacatcctctcagacatcccctgtgcctaccactcctggccagcttcctttgttttaagttaatagaccaaattggagggaaagaggggagggtgtccttggagaccaggtgccctctgctccttgaacgtggtgaggacgttagctcaggactgggagctggtggcaaatggcaggctggctctgtgaggtggtccttggagggagttggggcccaggaggccacctgcatgaagaagcccactggagctgagaggacagtacctggtgtcagctccttcgacctccctgtgaccttgtgggggatgaggagaaggggctgagccatcctcctgcctgtgagtaattatcgtcaacacggagagagagatatgagccacaaagccagaaaccagaaaacaaaggccctgtgcagtgtcttcctgtgtttgagccatctctgtaagtgatcttcctgtgtttgagccatctctgtaaatgatcttcatgtttgagccatctctgtaaatgatcttcatgtttgagccatctctgtaaatgatctgtaagacaggtagaccttcatagggctgagaagccccctgtccgaggccagatccacccctccctttaccaagtcccccagaaaccccgctggtaaggtgctggctgagctcctcatctgaaaaatgggaaggccgagaaccacctctctggtctcttgtggaacctaaattaacaacttcgagtgattccctcatgtgtttcctcgcttgctgtctgcgggctctgttccgcgagccctgcatcaagcatattcctggcacacactgagggcacaggagatatttgatgagcagctgaatgtgacagtgatctgcacaatgctagctgctaagatcaactccctttgtcttcctgaatccctgctctctttcccttctttctcttatctttccctccccttccctctcccttcccttcttttcaggctatagctgaagggtgttgtttgtaggatccccggattggtgggtggctctagtgtgacaggcctggagggctgagcagtgtgagcctggcttaaggaacataagacagacttgctttacttttgcagctcaattgcttggctttcaatccctggattagtgggtttcataggagcctccccaggaagtcttgcacaatggagttcattggcttgagtagctgtaaccctgaaggtcaagttctttccaactggctgcttcaggatgcttagcaggccagcggggtaagcagcagtagcatccccctttgtttctgaatgagaaattattcccaagaagtcaccaagtgtgaaaatgtgtgttgtcttgctaatgggacactaatgaaatattaaagtggctttcttcctgtcagtctcctggggaccactctatcctctggattttagtctgtctttacataaagagccccggggaattaacatttcttggtacttttcaaaataaccttggtctttctcatgccatagtaaagaagttcatgtttccgttagataactgtctggcttagggaggggctctgtccctccgcaggggaggaggattttggtcggccctcccagcagcctgtcctccaggcggatgcctgctcccagctccctcatgccccacctctgcctccctctcagcagaagactaccccagttcacaggggaggcgctgtcatactgccccacactgagcttgagctgggagccaggcgtgctgcccgcctccatgcccgtcactgaatcctcccactacccagtcggcagctgggagttgtttctgtttccactgtgtggggagggaagcttgggcaccaggaggttgtgtggccagtcacagaagcaggatttgaacccagcccaggccctgtgaactccagcgcccagcgtggagttattgccttgccagcacctccctgtttttggctacaacttggtctccccaggctgccatcagcatgccgtgaccttgagtgatttacatgatctgtgctcaggttcctccactctaaataaattccctaagtgctttccttcctcttcatgtttgtaaacacttctggggacaaaaggatgtggaggaaggggtcgtattttagaggccagtttctcctttaggtccatgccctgtctttgctctggcggccactgcttggccccaagtccccttggcctggagggtgagttggcctccccaccctccgcttgctctgacccagtgtgtgcagtgccacatggccagactgtttccatcaggacggtcagagctctgctgaggagcctgcagaaacctcccagatctgcctgcttttggggttccctggccctccagccttgttggggtgccctccccagcagagccatcatggtaacgaggcattcttcccctagtggtcagcaccctgcttgaccccctgcgtggggtaccttgcctccctttccccctgcccccagcttcctcctgcatagactcagattgacttcttcccagaagtttcttcctgccctgggtgctgatctcttcttttcctgagtattttcaagtagctttatggatgagcgtttctgtttgattcagcacaaactgtgctgtgccaggccctgtgctcagttccagagatggtgctgaggaaggtcctcaggagggagattgtgggaggagaggactactagatgcatcacaaaagaggcagcgtggatgtgggttcttaaggcagagtaggatgtttgaaaggtagagatgggggccttcctggtggaagggactgcatgagtacaggcgtaggagcaggtaatgatgaatttggaggcaaatgagtagtatttttgtctggagcacaggatttccatcagtgtcctgagaaaggagtaaagaggctacaaggccagcttcttcactcatatcatctcgtactgcttttgggacactgggcacaaacacaccgacctatttctaagatgatccatttgagcatctgcctccctcacattaatgtaggttgcaaaaaggcagggctcatctctttttttttttttttttttgagatagagttttgctctttttgcccaggctggagtgcaacggcgtgatctcggctcactgcaacctctgcctcccgggttcaagtgattctcctgcctcagcctctcgagtagctgggattacagatgcctgacaccaagccctgctaattttgtatttttagtagagatggggtttcaccatgtcggccaggctggtcttgaactcctacctcaggtgatctgctgccttggcctcccagagtgctgggattacaggcgtgaaccaccacacctggccatctctgactttttcactgttctacctctgtgcacttgatatatttaacagatgctatataaggctttcaaataaatgaatatgtactctgagatgaggcggattctctcacaggcacatgcacacacggctatcggctgccctagctagtggccatgcaatggccattttttgtggcctccgactagtggttaggctgtgtggggtgctgtttacccactggtggaacctattcccaggcaggcccctaggaaggggtggcacatgtacatggttgggacagagaccttttccctctttaaggccaggtctggcttgaacgagccaggggcttttagtttagctgggctgaggcgctcatgtggccagggagatgctgggagcctgcagactctgggatgttactctgcgtttttttctcctctccccagaaacacgtttttgtctccatctgaccaactttttaatcttaatttatgagcctgctgtagcaccagtaaagacacactgtactgcctgaaagaatcactgctgaattctaattctgtgcgattcaaaggcatgcctttggccggagctgcttcaagaataagcagagcgggaggctcggccctgctctggctctgtgggcttgtcaggaagctttgccctggctgcctcttacgggcctcaggcttaattaagccttctgatttatttttcaattcattactttttgaaaaaagaaaagccactttaatggaagcttttaaaatccagacactttggattcctctactttgtcaggcaaaagtggattcgtctaagtagtttcattaaaaaagaaaagcatatatttatgaaggtttcagagattagatttttttactcctttcactccaggaacctaaaagccaaacttggaaaataatttttgtggttaggtatgtgcattcactcagccaagaaatctagtaatttcataagtaccctggatttctgcattttataatttccctgtcctgtcttcttggtgacttgggttttaattcttttcctgcccagcttcctgatgtgggggcattggtacaggctgtggtttgagaaatttcacaggaagagaagaagccaggccggaagggttttagtggagccaaggtgttcaagaaggtgggagcagtgcagcctgaagctagagagagtggacaacgtggtctagaaggagaggactgtgggagggagggctgtgcagtggagggctcatcacagggcttgccggagagggaggagaatcacagcagaagcagcagccggcctctggtttccagccctgtcagccatggccactggcgtggtgaggaagatggagtcagtagcattcatggtctctaagcaagcagtgatcctatatgctggcgaagcctgtctctctgactggggcctgcagacaggggtggccctgatgacttctccaagaccgtctatcctacaactgagtctctgaccccaccatcggtcattcttagacttcagcatgggggactgatcccctggggtctgtgcattaggagcccttgaatgtgccctagctgctttctggtgggtccctggcacttggagtgggtggtggagccctgagtctcctgggcatgcctgtgagtgctgttcgcggtctgttcccaggtgcagacatctcagaggcgaccaggctgccagagaaggggacgagaagggagccaggggcatgtgatgtctttgtgttcttcctctttgctttctcctgctatcgggtgggaatcctcaggaccacagagacctccgggtctcaccctgcctgggctggattcagctccaccacctgtcagcgcagagcccagggcgcttcccgggcatcacagagtagaaagctcatccgttttccaagaaaggacactaagacgatggccaaattgagttaggagtgccaggaatccagatccaggagccgccggccgagttcctgtaaggcccgccccacctctgaatgacaactgctttccgagtttctgcagggaaaccaggctgctctcccccagcatttacggcagcttgacttacaggccctcatgtttgctgcacactccaaatcaattctctctccttctttaaacttttatcactttgctgtatgaataaggccactgattttctaggttccatgtgcttttatatcaggatttttctttcttctctcctactttctccacaagcttgttctgaacacctgctctgtgtgagacccatggtgggctccctaggcatccagagatgaactggttgtggtcctgggcctccaggagttggcactctagggagggatggggaagtagcctcacagtagatacgttttctgctttgttcacccattgagcagatagatacgtcatggacacttattccgtgcagatgtcatagcaggtgctgagctgtacaggtgatgaacaagaccaatgtggacctgagcttgccgtgagcttccactgtagggaggcggaggcctgttgaggtacatgaggggacaattacaggccattctggagctcatagaaaagcccacgtagtctgtgtggggtgggtcagggaagacttctctgagcaagtggtgtctaagctgagacatgaaggatgagtgagagttagccaggtgaagggggccagggagagaaagattgttccaggcagagggagttgccctataaagagatggcatccagggagagagtggcatgttcatgacagtggaggaagccagagggtttgcagtgtggggaatgagcctgttcatgacactggaggaagccagagggtttgcagtgtggggaatgagggtgtggctggtgcaggatgagggtggagttgtgtgcaggtgggcgggatgcagggcctggtaagccgtggtggtttaaatgaagtgccgtggagggcctaggagagagccagctgatgagatatctgacttggagaagcccagggtggcaagattggatgcgaggaaactgttaagagaccaagaacttgcaattattaacctaggtgacagttggcccagagtgtggcaatggagctggagagaagtgacagattcaagagattggtaagaaaaggaatctgtaggacttggccatcgatcagacattgagggtggggggaagggaggcgttaaggacagccctgaggtctctgttttggcacccactgccatgacccaggaggagcagaggagagttcagttggaggccgccctgagacagccaggtgcggctttgcagtaggatttatgggcttgaaattcagagccaaggatagcccaggaaatacagatttgggagtagagaggaagacccacaggagagggcagagtggggtgggggagggggccccgagaaagacgcagcaaggaggggaagggcagaagcaaaacccatcgggggcggggggggacatctacatgccatctttggtgctgtgaacaagggacagtatttcagcaggtggaggccatgggtcacagcgaagacgttccaggtagctggaccaacatgaccaaggtggagaggcaagaggtgtccatgctgtctgggacctaggctgggtggggctgggttaggcctcacatctagaaggccccaaatgcccaagttcttgggccttgcttgcttgtctctaactttccttctgtggctcctaatggtgaaggcctcccatgctcctgtttgggaagaattatgcaattattcctaaatggagtgcatgtcagcagccctggcactgaaaagggaagacatattggaggaggagaaacctttcacccagccctaaaccagctgcttctggagagtactgaagaagaataatatttttttaatctaaaagaactttacatttatgcttgactgaagcacaggccacatttgtcctgggagccaatgagcagacagagtttgggtaatctatgcaaaggcccctcagctgccctgcatccatcatcccaagtgacagaatttacatcattaatcattggcagtaatagaaaagtcattggaatagaatgttgtcacagataaatgtctcccaattgcatataaatgtctcggctttactgtactatttgtgcttgagaaatactgtggcttcaaaacggtatttatctggcattgggaaaccatcaacgccagcctgccttgccgacagcacctcccgaggaactcagaacttcccccgtgggcctcaggcccaggatcgctgcacatctctgcccatgacaggagttgggcagagggaggggaggctgggctccttgggacttcctggtggatgacgcctggggagttagaaaacactcaagttcagtcatgcccaccgcgttcccccagcctgtcaccctgtggctggagggtggcttgctgccacttgatgcagagaagaaaggagggtctgaatcgggcccagcagaactagccgctctcatggcctcaaattcaagggtgtggccgctccaaaggcaccacaggccacagagaaaggagaggcgaccctgcaagctagaagccaaagagctgaacattggaaggcctccttaccatttttgaaatgaagcccacagtggttttgggctggcgtctttctgttttgtgacctgaaaacactctgtttttggaaagtgcagatctgctgacacctttttccggaggtttgtgtgtttctctccgtggtgagccgccctgcctctgacagggccagatgctggcaggaggagggacgtggcttagggagcaaggcattttttgctcaggtttgaaggaattctttttgtttgatccttcacctctctatcccctcaggggtcctgcagccctgctgggcctggctggaggagtgggccccagaggcaaggcaggcaagtcaggggttctgaggcaggaggatgctgcctctggtggatgggcatgtggggctgtgttaagggtgtgcgacagccatgaccagtgagctgctggaagctggagctaggtgtctgagctgacaagccagggcaagtttttgtagagtatattttaagaggtagatctcctctttctacagggaatttcagaaatgtccacttctcagatgtggaagtgatctgagaccagctagctgggtgttcccaaaccttgatgatgaagaccagtcaaatttcagaacgctggtgggtgtattagtctgttttcacactgctgataaagacataccgaagactgggcaatttatgaaagaaagaggtttaattggactcacagttctacgtgaatgaggaggcctcacaatcatggcggaaggcaaggaggagcaagtcaccttatgcggatggcagcaggcaaagagcttgtgcagggaaactcccccttataatactgtcggatctcaggagacttattcgctattacgagaacagcatgggaaagacccacccccctaattcagtcatctcccactgggtcccccccataacacgtgggaattatgggagctacaagatgagatttgggtggggacacagagctaaaccatatcattcctcccctggtccctcccaaatctcatatctttacatttcaaaatcaatcatgccatcccaacagccccccaagtctcagctcatttcagcattaacccaaaagtccaagtccagagtctcatctgagacaaggcaagtctcttctggctatgagcctgtaaaatcaaaagcaagttagttacttcctagatgcttcgggggtacatgtattgggtaaacacagctcttccaaatgggtgaaattggccaaagcaaaggggttacagggcccatgcaagtctgaaatccagcagggcagtcaaattttaaagttccaaaatgatctcctttgactgcatgtcttgtgtctgggtcacgatggtgcaagaggtgggttcccatggtcttgggcagctccgcccctttggctttgtagggtacagcctccctccttgctactttcacaggctgttgttgagtgtctgtggcttttccaggtgcactgtgcaaactgtcagtggatctgccattctggggtgtggaggatggtgaccctcttctcacagctctactaggcagtgccccagtagggactctgtgtggggctctaatctcacatttcccttccacactgccctagcagaggttctctgtgagggtcccacccctgcagcaaactttttcctgggcatccaggcatttccatacatcttctgaaatctaggcagaggttcccatacctcaattcttgacttctctgcacctgcaggctctagagtgtgtgaaagctgccaaggcttagggcttccaccctctgaagcaacagcctgagctataccttggtcccttttagtcatggctggagcaactgggacatagggcaccaagtccctgggctgcacactgcacgggaaccctgggcccagcccacgaaaccattttttccttttaggcctctgggcctgtgatggaagaggctagcatgaagacctctgacaagccctagagacattttccccattgtcttggggactaacattcggctcctcgttatttatgcaaatttctgcagcaggcttgaatttctcctcagaaaatgggattttcttttcaattgcattgcaaattttccaaacttttatgctgtttcccttttgaaactgaatgcctttagcagcacccaagtcacatcttgaatgttttactgcttagaaatttcttctgccagataacctaaatcatctttctcaagcttgaagttccacagatctctagggcaggggcaaaatgccacctttttgctaaatgtggcaagatgccactctttgctaaaacttaacaagagtcacctttattccaattcccaacaagtttctcatctccatctgagaccacctcaacctggaccttattgttcatatcattaagcattttttgtcaaagccattcagcaagtctctaggaagttccaaacttttgcacgttttcctgtcttcttctgagccctccaaactgttccagcctctgcctgttacccagttccaaagtcacttccacatttttgggtatcttttcagcaatgccctactctactggtaccaatttactgtattagtctgttttcacactgctgataaaagacatacccaagactgggcaatttacgaaagaaagaggtttaattggactcacagttccatgtggctggggaggcctcacaatcatggtggaaggcaaggaggagcaagtcacatcttacatggatggtggcaggcaaagagagcttgtgcagggaaactcccccttataatcccgtcagatcccctgagacttattcgctattataagaacagcatgagaaagacccgtcccgctaattcagtcttctcccactgggtccctcccacaacacatgggaattatgggagctacaagatgagatttgggtggggacacagagccaaaccatatcagtggggctgacccaggatggccaacttctgatttgaccaaatgaggccattaaaagccagttgtcagctactgtatcatcatttcataaaatgaaataaaggaaagaatattttgacaccaacaatataagaaggccatcatttcaagatacaaaatatttcttcagttgattataattggttttatgaaggatttgctccactatacctgtttttttaactccccctttttccttatttctcttttttttgccaaaaactcacacaattctgttctgggtccccaggcctctagtttcagatgagcaaaagcaggtgcagagggaagggacctggccagggtccacagctagtgagatttgtgtattgtttcagttatttctggcttcataacaaatctctcctgactcagcagtgtgaaacaacagtcatttattattatcacctctcttggttctggggctggcccaagcagcttcacttggggtctcagtgctgttgcagtcagatagtggctgggctgtcatcttaaaggcttctctgagtgggtctgggaagatgcaagcatttggggacagagcagccagggctcctctggcatccctttctccatgtggttttcagcatgacggctgcaggacagccacatttctcccctggggcctcaaatgcatgtcctgagaaaagccggtggatgctgtgttgcctttcatgaactggccttgaaagtcacacggcatccctcctgccgagttctattagttacaagtgagccattaaggccagcctgtattcagtgggaggagaattggcctccacttcttggtgggaggagtgccagaggatttgcagacatgttttaaaaccacagtgtggatccaataggctaagtccaaagcgccctagggagggccaggttttaatttggagcgctgggatcttggaacacacccccttccgttaagtgttccaggaatgagtctgctggaggatcactccggtgacggtggcaagctctgcttcctggtccctgcttgcacttgtatgaagtgataaatttcacgaataaggtagattccatcaaataagtatcaattaagctgttttatgatctagttgagatgatgaattaaagtcgatttagataaatgatcagtaaaagaacagagacttcaggaagacagcataaactctctgaattgcaggcactcactcttcatcagaaagcagcctcccacacttgtgcacttgttgagcgcttgctgtgtgcatagatagcactggctggtgctgtccgaccagtgatggctgcagtggtatgtggaagcgagaggggtcccagtttgcactcctgagtatctgtgatccaattcgggtcatccctgtgccatctgttaggatctgagtgtgggaagggggagcactgatctcttttcaatccccattcctgggtgtgggctacctgctttcagtttcagggaacagagatgccctcaaggttcctgtttagaggggtttattgtaagagttctctgaaagatgaggaagagaactagaccatcccaaagccacgaggcccagcccctggctcagtgccggcagccctccttgttgcttccagggaggcctggcttattcaaggtccacaggtgtgaaatggagggtggcggggctgggggcttctggtatgcaggaagagggcagccacactggtggtttcctgtggcggtgagctgggggtgttggggtcagcctgggaagcggggagtccatgtgagtgaccaatgtcctagatcctctccttctttcatggatagtaagcacctgtcctatgtcaggcacgcctctagaaacagggcagtgaacagatagacacctttaccttcccatgagactgccaagaaggtgatgtcctctctctgaatcccctagacctgccaatttggtggataattgttttctatcacagctcttggcaaaaggaaggggaaaaacaattccccaaggtgtagaattcaccagagagaacccccattactcgcccaagaccattaggctggtctgtgacttccaaaatgaaggggctacctggttgtgtccacaagaagaaaatggaggcttacccagagtcagtaagagactgttaggaacgcaggctgagcctggctggccacacggcatgactttgttcatgtcatgaatatttattgaacacctgccacatgccaggcactgttcccgggactgggtgtgaatagtgcacaagagggaagcctccctgctctcttggcgcttaccttctagctggggagactggaaacataaagatggtgcaaaggccgagtggagaaaaaccaaactgccaggaggggctcaggctgggaggggatcaggccagctgggagggggtcaggccagctgggagggggtcaggccagctgggaggggcttgctgagcggaccttgagcagcctcctgcagggtcctggagtcagtggtgcccaccccacccctgagctggggctgagggctccacgactttcatccccttggggtgcagggaggtgaccaggggcggccctccctggcctggcttctccctctttcacccactgagtgtcgactctgcctttctgatctgggtccctgtgaggaggaaatatatatttagactcttctgtactttccgtggtaacagccgctttattcctggtgaagaatgaggaaaatgggtcagctgtatttactaagaagcatgttccagcttcttttccgaggctatttataaactttaaaaaatgcgagctaagtttttgcatcttattggaagccggagtgcctatgaataccctttctattactataccggggaatctagcacttcggaattgaaatgcgttgagtagggcagataggaatcttgcaaatagtgattttgatgaactctggcagcccacatttgcctcttggtctgatttctctgggagttttttcatgtgacattggtgtagctttcttggatatggttgggggggactgtgctgtggctacaaacagctgactggctatgctggcccttcacggccggtgtgctgacaactttatctggccttggagccttgaggaggggctgctgccagtgactgggccctgcttttgaccagccttgcacactgggcagtgggcagggggcccaagggcagaagggcctcctgagcatggggacttggagaagccatttctgaacctgctccatccctgccttgtctctagggggaatggggccatgaggcctctagaagcttcgccttggcccaggcctctttcccacatttcttgatgggccaagagccgccagcagccctcctgtctctcatgcctcccctgcgcgtcatggggttacacgtgtcctcacactgtgcctcgtgcaaaaaaagggtcacttctccctttctctctaagtggcctgacctcgctttcgagggggaaaggcttgggggtcctacattttaggcccactctggtggatttaatcgaatggctcaaattgcctcttgaggtaacctgtgttgaggctgtgctcgatctttccaagtgcctcctctcctgctcccctcggcgccttggagtatggggaggagtgcgtccctgtagcctggaggtagctgagggaggggtctctgccctccagccactccttggtaccctctctggttccttctgcagagaggctggactattgagccccaggagcaactagccccgtggagactttgctggggaatcctggcacccataagtggagccctggtcccactgtttattttcttggcttttcaatacctcttcccaagaggcatctccattctgacagtgtgaggtcactggagcctgcaggccatagggccctaagctgtccgctggctgatccatcaccaggaggcagggtagtagggcaagaggataggcatggggcctcctccccctcccggctccagctgtaaccctgaggacctgacttcctctccttatgcctccatctcctgtgggtatcatgtccataatctaagtcacagccaccactactgccacttactgagcacttaactctgtcccaggcgctgttcctccctgtgtcatctatgaactgattaaatccacagggcaaagagggctgttaggagaatgaaataagttactcaaagccacttgctcaggacagtgcttggtggttgtcactaatgatcactctcatcatgcctatctgccccacgttgggaggggatgggccaagttctccccagagcagaagttcccaaactttcttgcatcttgtactccaagtgcctcagtgacctaccttcctttcctctcctctcctctcctcccctcccctcccctctcctctcctttcctttcctccctccctcccttccttcctttctctttctttctctgtcttccttcctccctccctcctctctcttttcttttctctttctttcttttctctttctttctttctttctttctttctttctttctttctttctttctttctctctctcttttcttccttccttccttccttctttctttctctctctctttctttccttccttccttccttctttctctctctctccttctctctctccctttcctttcctctctctctcattctttctttctcccctcccctcctcttcttctttctttctctttcattcccttccttccctttcatttccttccttccttccctccttctctccttccttccttctctcttttctttctttctttcttttttttttttgaaacaagatctggctctgtcacccaggctggagtgcattggctcgattgcagctcactgcagccttgatctcttgggctcaaatgatcctccgacctcaacctccaaagtagctgggactacatgcacctgccaccatgcccagctaactctttaaaattttgtagagatgaggtcttgctttgttgcccaggctggtctcagactcctgggctcaagcaatcctcctgctttggtctcccaaagtgctaggtctcccaaagtgctagtaatgagccactgcacctggcctcggtgattattttttttttaatttttatttttagagtgcagtggcacaatcataactcactgtagcctcaaactctagggctcaggtgatcctcctgcctcagcctcccgagtagctaggaccacaggcatgcaccaccatgcccagctaatattcattcattcattcatttattttgtagagatgggattttgccatgttgctcaggctgatcttgaactggcctcaagcaatcgaccacgtcagcctcccaacgcgctgagactgcaggtgtgagccactgcacccagccgcctcagtgattttttttcctgatgtccctaggccaaaataaatatctaacagttccgtttattaagtagttagatataaacaccttaataaacatttgtgtcctaacaatagctgtttgaaaatataatgcacataattttaaaaattccattcttaaataaccaaattacgaatgggatatgtgtgcctatcaggcactggacaactgtaaaatcctgggatcagattagacaccagtgccctcatttcctgtttcatattgatttttgtgaggtactcactttttctttcagcagccactgaaaccccagctttaccatggcctgacatcctcagaagacatgcaggacagtctaatggtgaaactgtccactgcctcaagctagtgggaccagtggtgtccggcagatgttaagtattgcttgtttcccacaaaaatgtaaatattcctgcaggtctcctgtgagttagcagaggctcctcaggcagccttggtgcacagtttgggaaccgtgtttctagtgacttgtggccttcccctagctacccaggaaactggccaataggcctgaggctctcagactcctacgtacccatctggcagttgcaggagagacgacaaggatccaggtgtcctgccttcttcctgcctccctcctcccacaatctctcaggacaggaggggccaggctccactctctccgctcccctgcatcctgttctcctcctgcctggggcatcagcctcaggacccagccaccagcgctggaaggggcatcttctttgtggccgagggagaactcggtgatctgaatcctctaggatgtggattcagaaaaccctccctcttaacagagcgctttcaagtctgtggccacgctgctgatgctaacagaaatcagtcttgccgttcagagcagagaattccctttgttgttttggtgcgtacgtgccctctgcctgaagtactgaaatcattgcttcaaagggcagggagctccccaaaccactagacttataagacagggagtctgaagagatcagagagagaatcgggtgttcagtgcctttgtgttcagcaggtgcttacgtcttagggacaggtcgactgtaaactcaggtgtcttaggataggtgcttctgctgttctagctcccacacagcccctcccctttacctttattcccatctgccctccccaccctaactctcccctgggaagatgcctgccgttgcctgttcccagagagccccttacttgcagtttcagagcctgctgcctcactcctcctccctcactgacttctgtcaatttgaagatctcccagctcattctcaccccaggacctttgcacttgccattccccctacctggggttccattatcaggcccgtccttggcttgccccagctcattttccaggtctcactttaaatgttactccttaaacagcccagccaagagcaccctgtctaaggcaggcccccagctcctctgtttgctcctcatggccctttaaatgcaagcttcatcatgcaggcagagaccacgtccatctgcatctaccatgttcactgttgtttacttagcacttagtcctgtgcctggcccatcggaggcaccagcaagcgtgtctgtaggagtggggcttccgcaggacagtgctgctttttattattatttttttaaatagaagggacttaagggccaatgacttttaattctgctgagtaagatgtagaaaaattacagctaccatatatcatcaacatgttgtaaaagttggaaggacatactcttagaataaagaacagttcttttcttttcttctctttttgttttgtttcgtttcgtttcatttcaagacagagtctcgctgtgtcactcaggctggagtgcaatggtgcgatctcggctcactgcaacctccgcctcctgggttcaagtgattctcctgcctcagcttcccaagtagttgggactataggcgcataccaccatgcccagctaatttttttttttttgtttgtttgtttgtttgtttttgagatggagtgttgctgtgtcgcccagctggagtgcagtggcgtgatctcagctcactgctagctccgcctcctgggttcacgccattctcctgcctcaagcctcccgagtagctgggactacaggcgcccgccaccacgcctggctaagtttttgtatttttggtagagacggggtttcaccatgttagccaggatgatcttaatctcctgacctcgtgatccgcccgcctcggcttcccaaagtgctgggattacaggcgtgagccaccgtgcccggcctaatttttgtatttttagtagagatggggtttcactgtgttggccaggctggtcttgaactcctgacctcgtgatctgcctgcctcggcctcccaaagtgttgggattaccggcgtgagccactgtgcccggcccttaaaggacagttctttaaatggcataactttagcactattgaaaacctgctgtgtcgtccctcttctcacctcttggaggttggatgaaaattctccttcggtccatgagcacctaggaggtgctgcatttgccctcggtggaacttagtaacccattcaatgtggtcttgaccgtgctctcgtggtatttgtcccctacaccaggctgtaaatgctgtggcgggacatggtgttttaggatgagcctttgcaccaggctgtaaatgctgtggctggacactgtgttttagggtgagcctttgcacatgctcttccttctgcctccagtaccttgttggtctctgggtacctccaagttctgcccagacgccctctcctgaagctttgcaggactggccttgcctctcctcgatccttggtaatcactgtcgactcgcctgcctgctgggatccaagtcttctctgttttggaccagggtgctggcgtaccatgttcccaccattgtacaccgtcatatgctgaaggatgaaggatgttggctggtggcgactttgagtatgtggcagaaacagataggccaccctcaaggactctacatggagcccactctgtctttctgtaactgattctaatttctacttcagtctttcattccaccaggttacagaaacagaatcacatttaattgtgggttttctcagccaacagaaagttcctccagcctcctgggtttgcgcgcatgtgaggagctcatgggggttaggggttcggccctcatcactgctgttccccagctctctgtacccctgtgcaggtctatgctgtacccccctttgtcctaactgtggggtctctgaagggaagggtgagatcctcagctgcttccacacccctcttggggagcaagggaccatttggctgtcccctgaaccctagcagccatctctggtctctggggctcacggaaaaatgctcattggctctgcatgaggagtaaggctcagcccctgctctggagcttgggcctctctggagtcttagcccactcttcaccaggcgtgggaaggagcatctgtttccttctcctccctcagcctggctctgggcagggagtggcccttgctggccttggctccgccgcgtctcctctgcacacatctgggccctagcttttgaaattctaaagccacggctttgattcttctgttctctggttcctcataagggcccttccctggggcatagatgcctcggtctggttagaataaaaggctacaaggcatgggggcaaaaagaaacctccgttcatacccccagtggttaacctgcagctagctgctcatctgagggaagcaagagggtgtgggctgggcacccctagggagcttacttttaaaatgtgcctgtgggtgtgggtaagtaaatgcagaagctatttagcattctagcttatttgggtatttttatttacttaaaaatcttaattttcagaggtaatatgtgttcggcgaggaaaggaaaaacaggaaggtgaatagaatcagagtcacttatctcagcacctggagatgccctcattccatcctggcgtgtgtctctacaggtagcgtagtaataaaagtagtggtaattatagtactaaatggaacacacacttaccgagggcttaggaagcgccaggcatttttttaaagaatcacgcagatgataatttaggaggagcctttgtacatcctcttccttctgcttccttgttgatctctgggtacctccaagttctgcccaacgaactaacgaccctgtgatgtggatattactgttttcctcactgtaccaatgaggaagttgaggcattaagcattcatgggatttgcctacgctacgtggctgggctgcctcgctgtgcacacatacccccacatgcctgcagatgtgcacattaatggccaaggtatagaatcagggttcctggtctagtttcttttgggagagaaaccatatctttgttccctggggacttggtacctcatttgctgaatgaatgaatgaggagagggggatgcttttgaatttggatgcaagcttttctaccatcggtcacaggcaaattactgttccatttggcaattattatttttctttcctgggcttataacacctgtacgcactggtgcctccttgtgtgacctcagggaacaccattcacattgtattcttttctgaaaacagctttattgaggcataattgacatataataaattacacatatttaaaatgtacaactcagtgagttctggcatcaccatcgccaaatcaagataatgaacgtacccatcaccccagaagtatccttgagtcccttggtgattgcttcctccagggcctcccccctcctcgccaggcaaccaccactctgctttctgtcagtctgttagttagcatttctagggttttatataaatggagtcatacagcatgttgtctttttttggggtctggctcctttcagcataattattttgagattcatccatgttgtgtgtatcagtaattcatttcttttcattgctgagtagtgttctgttgtatggatatgagacaatttgtccatgtacctgttgatggacatttgggttatttccactttttacttttataaataaagctgctgtgaacatttgtgtgcaagtctttgcatggacatatgctttcttttctctcgggtaaatgcctaggagtgggatggccggatcatatggaaactgacacgttgctttgcaaagtgaccacgctgttttctatccccactgcggggtatgagagttccagtttctctacatccgcgccaacccttcctacggtcagtctttgtcattttagccattctaacaggcatgtggtatatctcgtcatggtttgaatttgtatttctgtagtaaataatgatgttgagcatctttacctgcatttagccatacccatgtatcttctttagtgaagtgtctattcaaatcttttgtcctttaaaaaagtcgggctgtgttcttattattgttttgagagttctttatatatattctagataaagttctttatcagatatatgctttgcagagattttcttccagtctgtgatttgtcttttcatcctcttaacagtatcttttgaagaacagaagttaattatgataatgtcagtttttttaaatcttttttttttctgtttttagggatcatgctcatggtgttgtatctaagcaatcatcatcttttttttttaattaaaaagatgtgggtcttgctatgatgcccaggctggagtgcagtagctgttcacagcctcgaacccctgacctcacatgatccttctgcctcagcctcctgaatagctgggactacaggtgcatgccattgtgtctggccatctaagcaatctttagctaatgcaaagtcacaaatattttctcctgtgttttcgtttcttttttttttgagatggagtctctggagtatagtggcatgatctcagctcactgcaacgtccacctcccaggttcaagtgattctcctgcatcagcctcctgagtagctgggattacaggcacatgccaccaaccctggctaatttttgtatttctagtagaggtggggtttcaccatgttggccaggctggtctgtaattcctgatctcaagtgatctgcccaccttggcctcccaaagtgctgtgattacaggtgtgagccactgtgcctggccttctcctatgttttcgtctcagaattttatagattttaaaatttaggcctatagtctattttcagttaaagcatatggtgtgaggtatgggttgaggttcgtttttcattttttttttttttgcacgtagacatccaattatttcagcactatttgtggaaaagactcctctttctccactgaattgcattttgcccctttgtaagaaatcatttatccatatatatgaaggtctatttctggactcagttctgttaattgatccggtggtctgtctttaagccaataccccactgtcttgactagtgtggctgtataacaagtcttgaaatcctgtgaatctaagtcgtgttagctctgcaactttattcttgttcaagttgttctggccactcgaggtcctttgcatttccatatggattttagaattggctgtcagtttccagcacaaagcctgctgggattttgattgggattgagcctcacattgctctctgcagatggcctcttctggagctatgccacctgctgtcctgccacaccggtgggtgtaggaccatatgagtgactgaggggccagcgcccgtggtcggcagaaggggaggttattggtatttaataaggcattttcagagacactctgcattgaccttagggtttcaggatgggatgcttttggctgagcccaggtgtcctctgagaaatgtggaccggaaggatgaggcatgctcccggaagttagcatcgctcatggccctcagtcagggcatggcagaggaaccacccctcttgtaaaagaggcacacacagccctcctgctgtaatctgccccatgtcacctgctttaggcattcatatttgaggctccacggatgtggtgaatgggtgccctgggaggatgggtaagggcaggtgtgggaggaatttcctttccagaacattcctttgaggaggagagaaaaggaacttggccactgtggacccgcttgggctagctgcgtgtctctgtgtgttgctggctgtgacaggtactgtggaatccttgccttccaggggagacctgtggccggcaggagctgcccgagatcccggggcaaatgcctcccctcccttcaccaccaccccctcccctctctcccctcttatgcccgcaccatggctttacctagccctgctcttcagtgaaggtatcttgcagagggcgtatggttggagaggaaggcagggctctgaggatgctatgatgtgccatttctttgggcttttccgaggactgctcacttgaggcttcccctggggagaaggagctgttaaactgtcaaaataaaaagtccaccaaactccttaggccagtcgaaagcacctaactcagaccacaggcagcaagagcaacagatttccctgcaatatgttacaaggggaagaaaagactattggggaacttaaaagaaatgcaggaaaagtttcaaagatgggaatatacctagtcaatcatacattaaatttgggattcataaaaagaaattgtggtgaaaatcttcccaaataagtttttattctagaatttgatgacaaatctctcacggcgctggttatcccgtaggtgtggtattctgaaatacaacccgaggcatatatattgtcaaataataaagtattatgaaaccaatcagctgtgagctccccacttggcagtttggaagtaaaaccctttctcctttacaaggccaagtgactcttaattcttcccaggagatttcacgttaaaatgtgttcactgccagctgacaaaagaggcgagtccagatttattaccctggcacctgcagcaaaaaaaaaatgacggatgatgaaaatatatttaattatcattccatgccacatctctgtctgctccagtcgcggggctgcagctgttggcacacactttattttaaagtcaatgtgcttatctggagagaaggctgctctctgaataaattgacttgagggaggaaggaaatggcgatctcctccagacccagctgaacaaatgcagatttgtattctgtgcgcctgctttaattgtctaatccgcccgacatcacatcagctctgggatttggcttttgtaaagaaaacatttgcaaaaagtaaacttttccgtggttttcttgagccaaaatgaatgattttccttcctggactgaaaagtgctggccgacagtggatgctcatgtttctgctgcaggcacggaaatcactgttagttgcatctcagaatggaaggagccctagacagtccctggtggaccgtctccttcaccagatggagaccccgcagagtctggaggggtgggctcagggtctcagaaggtggcaggtcggaaactggagaccagaacttctggctcccaggaagccactgtgtttttgtgactcgaggctgtcggaggtctaactgtttaaggttatgcgcctgagcctggaggatggcctcagagaattgccttcctctttctcttccgttaaaaccttctggaaaataaaaacttgggatggagcagcagtgccctgactgaggtggaaagcatcagatttcttggagtgaagtctgcggggacttaggttggctgctgaaagtctgtgccattagttcctgcctatgatgtgttgttttcgacaaaagtagcccagataataggcagtatctaatgtggcaattttcctatatctcttcttatcaggagaagccactcgatgttttgtatatggtgggatttagtacaaagtgatggcatttccactgaaatgaaatacaatcactggtttagcagttaggattcagggaggagagatgatgctgagtgtttctggtggtgcctggtgtcactggtggccagaggcagatgcctgtggatgggggcaggagggggatgaggtttctgtaaatggagctaactcaggggttgggggagagggaggctcatttctcctgaccttctctttgatgaataaggattcaagattgtatctgctgagcctgcaggacatgagaactgggggaggaaagagagctctggcttatggatttgggctgtgaccagagctcttttgccaccaagctttttgatgtattgaccagaagttactataaaccagagagagggtggggcgtggtgactcacgcctgtaatcccagcactttgggaggccgaggcaggtggatcacgaggtcagccgattgagaccatcctggctaacacggtgaaaccccatctctactaaaaatacaaaaaattagctgggcgtggtggcaggcgcctgtagtcccagccactcgggaggctgaagcaggagaatggcgtgaacccgagaggtggagcttgcagtgagccgagattacgccactgcactccagcctgggcgacagagtgagactctgtttaaaaaaaaagacaaaaaaaacagagagaggattccactgccgtctccatcatcatcaccaccgtcaccattatcaccatcataaccatcacttatcaccatcaccattcaccacttaccatcaccatcaccattcaccatttaccaccaccatcaccatcaccatcatcaccgtcatcaccaccataaccatcactgtcatcaccataatcatcacttatcaccatcatcattcaccacttaccaccactatcatcaccaacaccatcatcatcaccactaccatcatcaccatcaccatccccattcactacttaccaccaccatcatcaccatcaccatcaccattcaccacttaccaccaccgtcatcaccatcaccatcaccattcaccacttaccaccactatcatcaccatcaccatcatcatcaccactaccatcatcaccatcatcatcaccatcatcattcaccacttaccaccaccatcatcaccatcaccatcatcattcaccacttactaccactatcatcaccatcaccatcaccattcaccacttaccactaccatcatcaccattcaccacttaccaccaccatcgtcaccatcaccatcatcatcaccatcactatcaccatcaccattcaccacttaccaccaccatcatcaccatcaccatcatcatcaccatcactatcaccatcaccattcaccacttaccaccaccatcaccatcaccatcatcacagtcatcaccatcataatcatcactatcaccatcaccattcaccacttaccaccaccatcaccatcaccatcatcactgtcatcactaccataaccatcactgtcatcaccataatcatcactgtcaccatcaccattcaccacttaaaccaccaccatcatcaccaacactaccaccactaccacctcacttaatttatgtatcacttcttatgtaccagacctttggagaaatcccttaaattggtcatctcctttaatctcagggggcagatattctgcctgttttacagatgagaaaacagaagtctcggtaagtaacagaactaggacttgaagccaggacttggagtccactctcatagccatacctttttatttaggggctttaaatatatacagtactgttaagattttataggataaaaggatgaaaggagacgtcaactctgtacttttgtcaagagaaatgtttgaggatgcaataattttgagtttgaagactggcccatggggatttcctttcccatgtggctggcaaatggggagagaggtacccccctcagctctggggaccagggcggctgagagactggttggctggggtcagggctggggtggggaggatggaggaggcgctgcagagagctggccctggggacttggttgcgtcacagcaggaggtggggagcaaaggggaggtgccaggctctgctccatgctggcagccctggggccacggcagcaggggagggatgcgtctggggctcttgaaggcttggctggcgggccttgggaaagaagtcaaccatgctgtcctcccaggtctcctgggctatgtgagcagcagcatggcctgttctgctgtgtgtttgtcctgctgggttgccttgttttcacatggtcagtcggagctggtaggctgggccaagtggttcatactctgatctctctgtcctggccacacagcctccaggaagcttgagctttgtttttctggcctttcatgatctcctctggctccctgtggcccatctgggactctgggtttggtgcttgactgcggtatagactgaccagtattatggcttcatgcttcttggctgagctgcccagacacatgacagggctgtggccaccagaagatggagacgtgtcacattctcctcgctgccctgcggccccactgtttacatcagttcccaagacgtttgggcctgacagatatgagtctctcaaagagcagcttttagcagatatttgtcatgcgtccattgtccaccaggcacagtcctcgccctgggacccagcatgaatgtggcttgggaaaactcagggagttgccatgacccatagggctggcccacacactcacatgtgttgttatgagaccctagggcctttgggatttgggttcgtaaccagaggagcaggcgtggagcgtcagaggtcaaggagatggacatgtcatcactagttcagcaggggaactgcgggcaaagaaattaatactgattttatttccaagtgaggctgatgactctcctttttacattaatttttattaagcattttatgtattattccaaaaccacatactatgcagagacagtttagaacacattatgggttgtgcatttcataattatcatatggcctcagtccagaatgtagaaaagaaaataaacacaatcattttccaatagaagggaatcattgataatgtgtggacaggacttggagctgccagcaccgcccatgggctctgggctcaggacccagcacaactccatgcacagcaaagtggctccaacctgtcctcctgccatggcctcccgtcctctctgtctccagcctgcaggggtcctgcttagcctggtcccctgtggcgagagttcttcctctccaccttctgctgtctggaccctatttattccctggggcaggactcagcacagaagcccttcttgctgctcagatctcacctcagagaagcccaaacccaagcaaaccccggtcacccttcgtcacggcgcagggctctgttttcatcttggcacttcctctccaaggcttctgcctagcatctgtctccctgcttcaatgcaagctccatgagagcaggcaccttctctgttcaccccagcaccccaagcaactgggcgagtgccgggcacagagcaggcatgagcagatgctcgctggatgaatgcatgcatgactgtgcatctcctccactggactgtgagctcctccaggccagggacagctctacgtggccacatggccaatgccagcatatccgtgtctaagcagaagtgtgttgagttgagtccccaccctgcacctgtgaaatcttcaactaggtgctgggatggagtttgtattagtcagggttctctagagaaacaggacccctactatatatatgaatgatatttatgtgagatttataaggaatggctcatgagattatggaggctgagaagtcccatgatctactctctgtgaactggaaacccaggagagctggttttggaattctagtctgagttcacaggaacaccactggtgtaagtcccagttcaaggtcagaagaccaaggcccagctccagcaggcaggcagagagagggttctgcttcccctcacctttctgctctactcagatgctcagtggattggatgatgccccccacactggggaggaagccctgctttactcacctactgattcaaagcctaatctcatccagagacactcccacagacatacctggaaataatgtttggctgagtgtctgggaatcctgtgatccagtcaagctgacacctaaaatgaaccatcacagagtccctcctggggacctagtgccaggctagggtctgtgaatcgttcagcagaaaagaagaaatgggccttttgggggccaagggtccagaggagtgacacttaaggactctaggggcaatagaaacgagggcctcagtgtgcactggggattactggagccctcggagttgagggaggccagagaaggatagatggcaggtgtccacacagcccccttcctcaccgacacccacctcttcatctgccaaggccgggctcagcactatcccccatttgtgatggactctgcagggtgtcctgacaggtgggcactgtgctcacaggcaggggatcctcacagggaaaggggatcctcagggggaggggggatccttgcaaggtggggggatccttgcaggcaaggggagattcttacagggaaggtgtgtcctcaggtaggagggaccctcacaggtaggcatgactagtctcattttctgccgaggagcccacatggcctggaagtgcagagcagggatggaactgaggttcgccgacttccagtccctggtgtttccctcgtcctgtctgctgcccctctggtatgtctgaagatccccatagctctcaatagctgcatgtagagttccagcatgactgggaattgttttcagttgtctgcggggcactgggcacagccgcacttgaagtcgtaggacaccattgggagaccgggctgtctccaagagaaagatgcccagtggcccccaaagccttcttgaatcgcacacttaccccagctctccagcttttccgaatccgagtccctcagaggccaggcactggggtgttcattgagcagcaaggaagccgtgaccgggagagtgtggggacttggtgcctgcatgtggctcccctagacactgacccgaggcacagatttaggtgtaaatggcctatttaggaggtcatcccagaaaacacatcagggagggtggggctccagtcagcccagtgttaatgagcaggttagcgccgtgggcaattggggcccttcagtgacagcagggagcacacctcagggtgtcccctgacaggcgaggaagctctcgtccttcatgggtgagagtcactcctgaagtattagtacctagcacttctgggcagtcctgcagtgcaggtgacctctggaagggtggaggccgtacaggtgaggcctgcagttctgctcctgtgcccagccagcagtgcctgggatgggctagaagcccatgtgtccactataggcatggccagggctcttttccatgactgcggaaggagaggtgggagccttggcttggtaaatgcagccactgaagagcctgagaaccaggaaaacttgccgaggatggacaacactggccttgctcgagtgagtcagggctgcgctgctgtcctgggaaagcttcacccacgggcttcatgcaaggctgcccctgtctatgccctgattctcttttttcttttttctttttttttttaaagaaatctcattttacaaatggttttctgcacattccaagtgctgttcccagcatttacaccctgcttcataattggcctatacaatacaccctgttcagaatttttaatcaactatggcaagttgccccagcaatttaaataaaaatatataaatgaatttagtattttaatattacagtgacattaaccttatatatgtacttagcaattttgaacagtattacaattttataaaatattcttcatttggctggtggataaaccccagagttaaaccatgggctcacttggtactgtggctcatgctataatcccagcactttgggaggctgaagcaggaggatcacttgagtccaggagttcgagagcagcctgggcaacatagtgagacccctatttctacacaaaaataatgataaaaaattagctggatgtggtggcctataatcccagctacttgggaggctaaggtgagaggatcacctgagcccaggagatcaaggttgcagtgagctatgattgtgccattgcactccagcctgggtgacagagtgagaccctgtctctaaaaaaataaaaaataaaaccaaaacaaaccatgggctctttgtgccacaaacggagaagggagctgagccagttgggaggagcacaagctgtagccaggtctgccctgagaggcctgatagtctgagtggccctgtacccctgtgaggccagtgtggccagctgtgatgggcagcacggccagacacgatgtttgcgtgtttaaggacttcagtctgtgcttggacactctcactcagagtggcccctgggcagtctgctctgggccgagcagggcatgagaaggtgccacagggcagaacgagaacacgaatgcagaggccccggctccagcttccagtgatttctgttgggggccttcgatgtcctgggcaacgtgctgaccactctgtaagcactatccctgctcaaggtcaccagcaacctgcttgtggctggtgccgtgactggccctcattccttatctcgtgggaccccattagcagcggttaacacagccactccggccctcctcccctcctcccctccgtccttcctcccctcttctcctcctcccctcctccctgaccgtcctcacctggcgtccaggacaccatggttcctggttttcctccctcctctcagcctcctcagggctcaactgtggtccccttgtctcccattgtctaccttggggctgctacagtcaggagcattgagggtccctgtggcagaggggaggaggcacctgatttcagagagcggggaagtgcaacctgtcctgcaccagaaataggtggcgccccacacctcctcactcatttcccaactctgccctttcctccctcagcgtcttctcaacacggcggccagggattctgctttcctttttaaagttattttaaattgtgttaaatacacataacggggccaggcgtggtggctcacacctgtaatcccagcactttgggaggccgaggtgggcggatcacgagatcagagttcgagaccagcctgaccaacatggtgaaacccccgtctctactaaaaataccaaaattagctgggtgtgatggcgtgtgcctgtaaccccagctactcaggaggctgaggcagtagaatcgcttgaacctgggaggcggaggttgcagtgagccgaaatcgtgccactgcactccagcttgggtgacagaaggagactctgtctcaaaaaaaaaaaaaaaaaaaaaagaaaaaaatacacataacatagaattttaaccattttaagtgtccaatttagtagcattaagtacattcacattgtggtaccatcaccatctccatctccagaactttgctatcttcccaaactgaaactctgttcctgttaagcacgaactctccatctccctatccccccagccgctggcacccctgcatttgaatttttgtctctgtgagtctgactccttttagagcctcaaatgagggaaccatacagtatttgtccttttgtgactggcctatttcacttagcacaaggtcctcagggttcatccatgttgtagcatgtgtcagaattttattccttttgaaggctgaatagcattctattgtatgaatggaccacctttgcctatccgctcgtctgcccaatgacacttgggttattgagaactatgccactatgaacatgggtgtgcaaacagagtgactcttttagaacacaggtcagtccgtgacagtcctctgttcaacccgggccttcctgttctctcagtggagaagcccaaagcctttatgatggtccccaggacctgtacaccccaccccatcacgtcctgcagccacactgagctcctgctcttgctcagacacatgggcacactgctgccttatggcacaggcacaggctgctctcctgtcccctctgcctggacacccttccccaggcggtcccatgctgtcctccaccaccctccagtgtttgccccagtgactgcaccacctgccccggtctccctgtgtcacattgcgtcataaccctcccatgcatttcagagcccctacctgtttctctcgtttaaaataacatttatcactttctgacatactacagacagtctttgacttgccgtggttcgttttgcagtttttccactgtaccaatggtgaaagtgatacgcattcagtagaaaccatacttcgaattttgaattttgattttttcccaactctagactaatggaaatgctctgagcatatttaaggtaggcaaagctatggtgtttgataggttaggtgtagtaaatgcatttctgacttaatgacattttcagcttacagtgggtttattgggacgtagccccatcgtacgtcgaggagcgcctgcgtgtggtttgtgtttttattatgtgcattgtctggctcctactctgagagggcagggatcttgtgtgttttgtttactgatgtatcctgtccacctagagcagtatttggcatatgatgggtactcaaatacttgtatgaatcaatgaatcttttttgataacagctttattgtgatataattcatatagcttacaattcacccattaaaatgtatagttccatggatttagtgtattcaggcagttgtgcaaccatcagcacaaccaattctgcaacactttttataacccacaaaggaaaccctatgccctttataattttttaattttaattttttaactaattttttttgtgtgtgtgtgacagggtctcactccaggctggagtgcagtggtacaatcacggctcactgcagtctcaacctcctgggtttaggtgatcctcccacctcagcctcccaagtagctgggaccacaggtgtgcaccactacgcctggataatttttgtattttttgtagagatggggtttcgccaggttgcccaggctagtctcaaactcctgggctcaagtgatcctcctgcttcgcctccaagtgcagggattacaggcgtgaaccactgtacccagccaccctatgccttttagctgtcactcctgtctccccgggcctaggcaaccattttctgtctctatagatttgcctattctggacattttatataaatggaatcatgagatgtatggtcttttgtgcctggcttctttcacttatcataatgttttcaagtttcatccatgttgtagcgtgtatcagtacttcattcctttttattgctggataacatcctgttgtatggattaagccacactttatttgttcattcgttagtcgacggacaataggtttgcttccacttttgggctatgatgaatcgtactgctttgacccatcttgtataatcccttttgtggggacacatgttttcagttttcttgggcatatacctaagagtgaaattgctcggtcacatggcaactccatgtttaaccttttgaggaactgccagcctgttttccaaagctgctgcaccatctgaaattcccactagctgtataggggagttccagtttctccacatcctcaggtgatattattgtctttctttctcttctttttttttttttctttttttagagacaaggtctcaatctgtcacccaggctggagtacagtggtgtgatcatagctcactacagcctaaatacctgggctcaagcgatcctcctccctaagcctcctgagtagctaggactgcaagcacatgccactatgcctggctaatttttaaaagatttttttagagctgaggtcttgctatactgccaaggctggtccttgaactcctggccttctgaactcttgtcttagcctcacacagtgccaggattacagggataagccatcttaactagacctatctttctttttgattatagccatcctactgggtatgaggtggtatctcattgtggttttgatttgcatttccctgatgattaatgatgttgcatatctttttatatatatttgtgtatcttctttggggaaatgtctgttagattctttgccaattttaaaatagtatttgtctttttatcattgtgttgtgagagttctttatatattctaggtacagatcccttgtcagagataggatttgcaaatattttgtcctgttctatgggttgtcttttcacttccttcaccgtgtcctttgaagcacaaaagttttacattttgatgatgttccgtttagtttttcttttgctgtttgtgcttttggtgttataactaagaaaccattgcttaatccaaggtcataaagatttacttctatgtttttgtctaagagttttgtagctgtagctctgacgcttaggtctttgatttattttgagttaatttttgtatacagtgtgagggagggatctaactccattcttttgcatgtggacatccagttgtcccagcaccatttgttgaaaagactctattttcccccattgaattatcttggtatcctttttgtaaatcaattggccataagtgtgagggttaacttctgaactctctatctctgtgcagtgatctgtatgtccacccttatgcccgtaccacactgtcatgattactatagcttggtagtaagttttgaaattgagaactatgagtcttccaacttcttttcgctttttcaaaattgtttgaaatcttgtttcaagactgtttattatttgtatatgggaatgcatcccatggaaaacatggggtgtgtttccatttatttccattgtctttaatttttttttttttgtttgagacagtctcactctgtttgcccaggctggagtgcagtagttcaatcttggctcactgcaacctccaccttctcggttcaagtgattatctcatctcacctcagcctcctgagtagctgggattacaggcgcgtgtcaccatgcctgactaattttttttttttttgagtagagatggtgtttcaccatgttggccaggctggtcttgaactcctgacctcaagtgatccaccacctcggcctcccaaagtgctgggattacaggcatgagccaccacccctggtctgtctttaattcttttcaacaatgttatatatagttttcagagtataagttttgcatttcttttgttaaattttcctaagtattttatccttttgatgctattacagatggaattattttcttaattttatttccagaatttttcattgtaaatatatggaaatgcaattgatttttgtttgttgatcttgtatcctgcaaccttggtgaacttgtttatcagttctaatagagttttcgtggattcttcaggattttctacatacaagatcatctcatctgtgaattgagacagttttactttttcctttccaatatggataccttttgtttctttttcttgcctaatttctccacctagaacctccagtacaatgttgaatggaaggaataaatgaatctaaatcctaacgtcatgtcagtaattatcatgtttattcccattttacagataggcagactgaggcttagagtgggtaagtaagttgcccaagggtgtgttacagccgaagagctgtggggccaggccagaattgctgtgtacagtctgcttgctgcaatgcctttcccccagctgccatcttcatatatggtaggcatttgggggaggtaccagccaacctggtggatgacatttagagtttagtgagaagctctggaagtctcactggtagcactaagctcctctctgtgtaccggctgcttcccatatgtacatgcgtaggtaagagcaagatagaaatgacagcacttgtacattccactgagggctttctcatcagtgtctcgtttcatcctcttagcaaccctgtcagataagaaagatgagttttattgtcctccatttaccgatgaggaactggcacttagagagctcaagtgactttcctggcctttgggaaatgttggcatggtggggacagggtggggcatcatgtgtgttgattatcttccctatgttagacactatgctggacagttgctgtatggcgtatggcttaatcctcactcagcattattatcctcttcccacagttcagaaaattgatgcttagagagcttaagtaaagtgctccatgtactcagctcagaaatggcagggtctcccctcaaacccaggcatttgacccccaaattctacctgctttcctcggaccacaaggcctgaggtgatcgaagaaatttattaaagggaaacaaagatggataaaagagcaattcccacgaggccagccttggcaggtgctgttgctccctgacgtgtgtctccttgtgtgttatcccccactttagggtttaactgtatcttgagaggtgggataatcttccagggaaaagcagagaaggggaccatctgctgaggcaagggacctgttcaagcaaactcctgtcttttctgagataagtctgactaatccggtccttgtgactaatccactctgagactttatctttagaaccaatgattaatttaaataggctaaattgttccatttcagcccccatacttgagtgttcctgggggaagtggggttagggcaggagggtggtgcctgggagttgtgagggtcctcgaactgttggaatttcagagtttctagcagatagggctggggccagatcccacataggaactgcagccctttctgctgacatcatgggagatcccgctttgaacgccctcgagggcagacatatgcagggggtccccattctatagaccccgtgaatcatgctgtgggtgagaatctctgcaagacgatgttggcctctgtgactttcctttcctcttccactccaagagccaatattttcctccaagatcacagaactccggctgagcgctgacgaagctgtaaagtgctctagaaaggctgctggcgaggaaattcacccatccaatcccccttcagaccttacctcctgaagacctggattggagaggctagaacccagatgccagagtcagatccctgcagctcactctctgaatgaccttgggcaaattttttagtacttctgagccccaatcttctcactgtagagctaacctagtccaacaagttcatttttcaaaagatgacattaacgttgcatccccaaagccacacaacaagtaagtgcaaaagggagggcagtgaccaggccttctgccctcggcacgccaggcccttctgcgtcattatctcatctggtcctcactgccagcctccgggatgctggctgcatccccatgggacaggaaaaggcactgagactcagatgcgtgggtcatgctgccaagccacacagcaaaacgtggcagagccagaatgggctctacgtgtgcctgattccaggccccatgcaggccctatgacacccaaggaagggtgaatctgtgggcctttctctctgctggcccttagttcagcctctggccgttgcctcacggaggctgagcagaggtctcatctgcccaggggcaggggatggtgctggctgggcggaggcagcaaggagggggacggccttctcatgttcccagcccacccttctcaacacgcccttgctttgcacacaggcctaattaccaagaggagtctggggcccatggaggctgtcagttcctgcaacatcacagcagcctcttatcttgatgggtgtgtgcttttgttatatttttaaattacagacagtgagagtattcccttggcatccagagctgagagctttgggactttgaatggtggaaaaggaacccaagtgcctctgtgccaggcttcctcccaaaactcatatcagaatagactataagaagcagcagccccatagctcagtggattaaaacagcagaaggcgttttctcactcctgccacatgctcactgcaggtgggtggccaatcagagacctggctgatggagtattgttggtcactgtgccagagagaatgtggagtcctggaggccttgaactgattagtaggtatcccagccagaagcattgtgctcctttgcagctcactgggcagaactggtcccatgcacccccaccccccagccccaccaatcaaccacagtgctacgaaggagcactcccgtcatgtaccacaaagcagggagaacaggtcatagcattaatgaccgacaactaccactggggagaagtaggaccaggacgctctacaatcggatgcccagggaggggcttcctgtcatgggctggccaccagcaggaggtgtccagcgtgtgttctgaggcctgagctgggctcctgcagggcatctgtgctgttgctgctcatggagacctgaggcagtggcctggcctctgcctggagtggaaggaggaggctgcacagttgacctccttttgcttttccttgtggttttgggctgggagttgcagacaacctttctatagctgatttggggtcaagaatccccataggacccaagacaggtcctagaggagggaaatgtgtttgttcccacttttttatggggtccagtggcgaaaaggataaaaactcacagttaaaacaggagtctgacatctgtctgctggggaggccacaggtgggggatctggatcagatgggattcgttccttcattcattcaataggtattgaatcttagctttacatttgtgtaaagtgactttaggtaagtcacttaacctctctgagccttagctctctcatctctaaaatttgagaactattccatatctcacagggatattgtggggattgagtgggataatggatggaaagtctctgggagaagcctggcacatattggatgcaacagattcctgtttaaggaacaaatgtctccgttttctcctccataaaatgagggttataagaagcgtctttatcccccaggactattgggaagaacaaaaaagagaccatttccataaagctccagcccccacagacactcaggagaccccagtctcctcctgggttccacgggtgggaggctctagggggaccattctcccgcctcctcggccatcgggctatagctccccagagtgggtccagggtccggagccttcctgggccctgtccgaggcccaagagcctgtcccctttcctgctgaggctggagcagagagaggttagccccagcctgggaaaggcctctgttgtcatcctgcggggttccagggtgagggtgcatgcaaactgtcaagcgcagtaagactgtgagacatgccgtgcgaactgtgaggtgctggatgagggtgaggtgttgcgttccgtctctgggtctggactggcttcctgctgctcccttgaaccacagccccaaaccccatctcccacctgtccagcctctgcccagtgagtcccactctgccagcctgccgtctgcatcccactgtgccttctgtcaatggtgacagttgtgtagagaaggaaaacaatactgggtggttcagatgtttctggcatcaaatgggataacataggccgggcacggtggctcacgcctgtaatcccagcactttgggaggctgaggcgggcggatcacgaggtcaggagatcgagaccatcctggccaacatggtgaaaccctgtctctactaaaaatacaaaaaaattagccaggcatggtggcgggtgcctgtagtcccagctactcaggaggctgaggcaggagaaaggcgtgaacctgggaggtggagcttgcagtgagccaagattgcaccactgcactccagcctgggggacagagcgagactctgtctcaaaaaaaagaaaaaaaaaaaaaaaaagagataacatagtgaagagttttctttgggaataaatattatttaaatatgtattatattttagcacaatcaatttcagttgtaaaaacaactatttggccaggtgtgtctcacgcctgtaatcccagcactttgggaagctgaggcaggtgtatcacttgaggtcaggagttggagaccagcctggccaacatggcgaaaccctgtctctactaaaaaatacaaaaattagccaggtgtggtgacgggcatctgtaatcccagctactagggaggctgaggcaggggaatggcttgaatccaggaggcggaggtagcagtgagccgagataacgccactgtactccagcctgggcgacaaagcaagactccatctcaaaaaataaaaaacaaaaataaaaacaattattaattgcagggaacttggaacatacagaaaagaaaagaattaagaggaaaacagggatcccccggatctcatcacccagaggccaccgtggtggacactgggttctgtttccttcccgccgccttccgaaccccagggcatatgtgtgttttgcttgtttcataacatcgggttcatattttttgtagcttactttttcacttgataccatattgtcagcatttccctcagttattaaatattctttgcaaacatgatttgtaatgtttgcctgatagcccgtcctgcatctgtcccgtcgttttctctccatatcagtgttgcagcttccagggattcagtatagattccattcgtggagccgagcccagtctgagacctagaacagattctagaaactgtcgagagctctctcttttcaccatgcatgtccctggcccttgtgagccatgtggagacctggaaggacttggaggggccagggtccaaccccgggaacgtggccaagatctcagttggtctttgttctttctcgccgcgtgagtcccctggtagccttggtgggggtcctttcaccatcatacccggaggctgtggcttcaggcctgggtctggatcccacctagcaagtccttccttgctcagggccgccttgctcaggagggctggcttaggaccgaagcccaggccccgcagggagcctgcctgctcctgaatttcccatcttcctgaccttggaatccacttttcttacctccttgtcacctccttatgcccagagttggctttgattgagggactctaatataagatggaaaaacccaagggtatgaaagtcactgcactttatagccttttaagggccttttaaaaacaatgttcattcaatttttttcttttttttttttatgagctttctggtacgtacagcacataatcctacataaaatggctgagcacgacactggcataaacagccggtgatggggtggaagtccgtgaaacgacgggtttgcctctgtgggagaagccgcagtctttcagcactgagcaggctccggattccagggctggggttgccaggtcttctgagtgctgctgacctgagggcggcactcgagggcttgggtccttggggagggacgctcaggcccctgcctgggaaggatgcctgcgtggcttgaaccctgacctccaccatcagccacatgtgccatttgggacttgtcctttttctcaccatttcatgaaaagcttgtgttgcttttgccagccagccagccagccagctgggaaagctggtcccacatcatggctttctaaatgacgccctggctggtcgcctgatgattgagcaggccatggttaaggctcttgacagcacgtccaagggccaggtgccccgtggaaagactggagcagacttgatgtcagttccccagctgttgtggggttgaaggggatttaccctgcaggagtaacgctcctattgctcgagctgttggggtgtggacgggggaagctccagcttatttatcctcataaaccatagtgctatcccctttgtcccacgagttccagtatttcattatccaaagtggatctcctaggctgcctccaaattgcacacaatgattttgtcagattttgaggtctgagttttcctttgcagaataggaagagtcactctgtcccagccttgcacctggtacatagtagcccgagtggtggggagtctgccaatgagatgataaaagactctcagaggttaaggctcttgctcaaggccacacaggagacaggctctgagctcgggggagcccgacccttaagactaaatcctcaaggaccgcgagtgcctttgaaagccctgccccgccgcctgggcagctggagtgggagccacgcaggcaggcacttgtttctgagcacagctgagctggcggggccctgccacctccttggacgccgccttccctctgcttgcctgggacgggctggggagcagcctcgtctatggtgcagccctccccttctcaagaccaccctgacctttctcagcatgtgcctgttttccaggtcaccgtttcgatttcgcttcacttcctagtgtttattctcctccgttagaagagcttcgtgtttattgattgttgtctccggaccttcaatttttgtctgcggctctggcaatctggaaatgagtcttccactttcattagccaccctgttctgaagagcatccgacctttccctaatcagttccagctaatcatggccagtggctttggatgagctggggtggggggttgggggagcagggacaggggttgccaagaggcccacaggacctcccctgggggtagacgatagtgacggtgatgatgatgatgtcagcactgggcgtgcaccctgctatactctcaccatctcccctcacccctccactcctcttccctggcgccagaggcatctgacccttaggaagctaggggctgcagtgggtcagagtgagaaccacggtcaagctgaggggcccctgcttgtctatagccaaaggccaggtccaggaaatagtacttggggtttggagtcgggggctttgactcagatctgggtggagtcctggccttgtggccctggacaggctatttaccttctctataaactggggataacaagaaagcctcaaagcttaggatggctgtcaggtgtgcggtggcaaccagtattactactattgttgtgactgttgagtcagatcaggtttctcctgaaggccctacctggagtgatgttgctgtgcccggtccctagctccgtgcctggtaagatgttcacggggcttagtgaacacgtgtctagctgagccccactgagctctgatgggggcattttgttgcttgtggagcaagaagccatttggatggggcagaggtcagctgccaggactgtgtggcctgacctccatcctgcaccatgcccagcagagtcaaggctgtcagagggattttctcccgcgggtcttcctgtgcaaatcaataacccttcaggcagcagcagggagggaagcatgcactgaggaggcaagggtcagggctgttcctgcagcttccggcaagtcctttgcagggtttttcagtatcttccgctcgagcaggtgctgcagcagagcctcagatacgtactgagcgtcgcctcagtttcatgcacaccgcttggggctccccaatccctgagtccagaaccacctggaggtctattgcattctggccccggcagctctccatggaagcagagatgaactagcagggccagaggctgctcactatggtggggtccctgatctcctatcagcaccctagtttctagtaggaatttgggaggcagaaaatattcccccttccctccaggtgaatactcaggtgcatactatgtgcttgaagctcatggccaacctcagaggctgatggggccttgtgggctttctggagagctctgcagggtcccaagtgtcatttctcccttgcccctgcttgatgcacggtttgtgagtactctctttggctggtcctcttcactctcttgtttaccatttgctgttaacaacagtaattacagtatagttgtgagatgaaaacatgactaaattatgacactgcttgtgtaacaatctcttaaaactgactcagaaggcaacagctgcacaattaggctataaattctcttaaatgaacttgtcggtggcagcagtacctgtgtggcggtgttgtgtaagagataaccaggcttaatgggcttggagagggagcaccaaggatggcctcgtaaagagggaaactttgttctttgtcataaaccacttgttctcttataaaaacaaagggctcagtgttggcccattaactccctctgtctgtcgggactgtgggagcagagcatctgcctgacaagctgacaccagggatgctttctgccttgaggtgtggctttgtttgaggctcctccaccctcatcccgaggaggcatggccagcaagaggcctgggtgggattagttagttagtagcggtcgggccagcatggccttggtgggggcccagctgagctgctgcagtcttcccagctgggctgcgaggcctgcccttcttatgctaaatgacaaacttcaagacaaaacccacgaatcagagcgccttggatgtggggctgggacctaagaaaccatgtgattcaacagagggatgatggaggcttgcttcagatgcgctctttgggaaagaagcatgtatgccgcagatctaagggggaaggatgcaactgatgaggtgttacaggatgctcttaccccaccccagcctgaatgtggccagcactgggactggtgatgctgacactgggggccctgctgtctgcctccaggtcagctcttagcagcgtattcactttctgtggctgctatcacaaactaccatagacttggtggcttaaagtgacacaaatgtactatcttgcagctccaaaggcagaagttgggtcttgattttgacatgggtctcggtgttttaaaatcaaggtgttggcagggctgtgttctattctggactctgggagataatccgttgcattggcttttccagctttcagaggtcacctgcatcccttgattggtggccccttcctccgtcgtcaaagccagcactggcaagtcaagtctctttcagagaacatcatagttctctgactctctcttctgcctcttctttatcttccatttgtaaggactcatgtgattccattgggtacatgagtacactaaggtgattgtttccatctcgagatcagctgattagttgccttaatcacatctacagtcttaattccctttcaccatgtaacgtagtatattcacaggttttgaggattatgacgtggacatctttagggggccattattctgcctgccacaggcaggtggagagtagggctttgagccagcttgacttttgtgccctctgagctgggcacaggcaaggatcagacgtgaggaagcaaagctgagctggtcctacaggaaatcagagagagaacagcctctctgttccctcccgcctgtcagcactggactcggcctgcacctcagatgtcacttgcattttctaggggctcccagtcagagacagggtgtggtctttcgtgaacaaaacccaggagtggacataccccatggcttcccagactgtgtgggagtctccctgaatgaaaatggtaagtgtgcaccctttccttcctggagaacctagcattagcatccacctttcccctaggcccctccctggagaaggtgcaaatcgggaagcctgctggtataagataaagttcagctttaacagttttcaaaataaacgaacaacacacaaactccagacgctgcacaaacccaccagcagggagtcatggccacaggttttgaaaactttcaccattctgggattgcagagcgtctcatccgcagccccggaccccctggccacctctgctctttcatcccagcctggcggagaggcagctggactctcctctcggacaggttctctgatgaatttccaggcatctccctggacctgtccacacaacagatttctggagcgcatccccagggacctccagctccaggcctattactgaagtccgtcacccagaaaatctgttgacggaaccgttctccctgaactgcaagcaaattgggaaatttgaatgtgacgcaataagcctgcaataaaacagagcctccaagaagtgcatgaagcgaatctcctcccagcctagtccaccacccctctgcagcttcccgagctgtcaccctccagggtggccacatacagtatttattttttttaattaagctgcgttgctgtgtggctcaccctccacagatgctttataaagcccagccttgtaagttgctgaaagtttttatttttttttaagcggatagtaaaattaagcagttattagtattcacgaaaaatgctcgtggcaggcttcgcacacgtaatgagaagccacctgcagttcaaagcagtacttgataatgctgtaattagatttgagatgcaaaaaagctcattaaaattaaataacatatttgtcactgttttaagaggtacagattgcctagaaccatgctggtctcttgaccttgagtattttggcagagtccttgctgccgacaattcaaaaataacatcagcaattctgcagagagtcctgaaaacatgctcatccttggttcagtttgtattgaaaaaattatatagatatccaggggaaatcacagatttgtacacagtgtgttctgggagaaaagggtggccacagtcctctctgagccagtagctcagacgctgtgaagaagagatggatgtgtgcctgtgggaggctggggcaggtggaggggtcccccataggacacggggacactgtgagggagtttgcaggaagcggcggccttgggcaccactgcttaccactaagctgagctggatgaagccacttgctcagagcaggcccagggcgactggtaatcagattgtcagtcagtgtttcccgggtgcctaccggtgtaccgggtcccgggcaggggatggtggggccgcaagtgccagtgagatttgcctcaggctgcaaaagaggtcatagcctcatcacggagatgaggcataaagtcaggtgccaggaaagtatttattgttaataaaagtagctaatgttgactgagcgtgtctttcatagtaggtagccaagcgtggcatgcattatcttaggaatcatctccatagtctgtgagacagccctgactgccccattttccttgaggttacgttgctcttgtaaggtcacttcactagtaagtaactagtaagcccagagctgagccgggttcagattcaggtctggccttctgcagcaccccttctgcatgaatcacagagtcactcaggtcccatgggcagagcagagagacccagggtgggagaggacacacatgaaggcactcactgaggacccactcttcaccagatcctgctctaaacactgcgtgcctgttcatcattgtatccccatagcaaccctgtgattccattttacagatgaggaaattgaggcatgagaaattaaataaccagtcccaggtcaccaggtagttggtggcagagttaggattaagctctgaccttgactgttattctatgtttaatttttcttgaaatctgtaaagcattctataaaggtaggatgtaatttaaaagcaattatgatgatttttgttcttggagaaagaaaatgcaagttgctttcaaggggcagagaccagaggagttttcctgggggcagagagcagttaaacgagacgtgagtggagggggccagatggagggaaaatgaggccaagttagaaacagaggcctggcctgggctccagggacagtgtgggcccccattttggaggagctgcgtgtcctccagggcagggagtcattgggaaggcagtctgggccgactgcccctcctcccggtggctggattgattttccaggctgactctcttggcactgggtccagatttagttctgtggagagctcgtctttcaaagtccagctcaaatgtcacctcctcggcaaagactcccccaccgcctgaagcaaaattaatcactcctcctccatgtcccacagcactctgttgatacctccggaatagtcttatcacatcggacacggatttatgtgtttacaagtctgtctctccagctagacagcgacttctcgagggcagagcccactctgcctttgtgtcattgtgcctggggcagtgctgcgtgtgcagtgggtgctgaggaaatgatgcatacatggaggaccagtggatggtttaatttgatttcagtgaccaagcacagagctcttactttgtgcaggtcttgttctaagctctttacatatgtgaaaggatttagcctttataaccccatgacatcagttagttctatgatgagcctgttttacaggtgaggacactgaggctcagagaggttgtgtaacttctcaatatcatacatctggtaagtggtagagctgggagttttaaacccaggcagcctggagtgaaaacatctgcttaaagtgattttgtagctacagattgtatatagtgattcttattaggggagtttctggaatgaattctcatttcactcttcttttccctaacttgtctgaatttaggaaggtttggagaaagcgattgggctgcgatgcagttaagtttcctttgttgtaagccgtggaaaccaactctagctaaattaagctaaacagggattctgttgtgaggatctaagtagcttgcagaaggagcacgctggaaggaagggctttggggaggccagagggactgacctagcgggaactgaaggacagacttgctgggatgagctctgcacgtcacgtccctcccagttcaggcgccaccatcgtgaccgtgtagggaattggggtgctggtaagaccttgggtgctgggccggcaagaaggtgcgctgcctgccgaccaccatgcgttcctgctggccattgcttgggtcctgtgttcaccctgggcccagtggcagcctgggctgagccgggggcgtgagagcccagggctctcagtcatgtttccttgacacatagttctggagtttggggcgggtggggagggtgaggcttctgaaaggaatattcactggcagtgacctttcttaggtttttaacattttgaggggattgattgaattgatccaagcccattcattctcggtctccaaaggacatgaataccgcaggaccagcccagcttgaatgtttgaaaactgggtgcaaacgaggactagactgattctttctcaccgggcttgcccccagcctctaaactagaaggggcgtctggctgggtgtccctgggaggacggccagagtgcgccttgctcagaggttgttgcagggaagccccttttcctggggagggagggaaggcgctgtgcatctctccccggcggccagtccagcgtcttccggtatggcagtcctttgccctgtcgggtcaaagccaagccccctcagcctccgggctgtccccaaacgtgtctccctcgcggtgtccgtggcgcgcaagagcctggagcctgctgctttgggcctcacgcctctgtctcatgcctctgccggggccccgatttattcaggacacacgtgtgctccgagtgccagatacatggtggaccccgacaaggcacgcaggtctcagacaacaggtgacgctgtgtccccggcctgtgcagcggggacacccacctcattttactccccccaggtcagctggtccttgctgggaggctggtccctggggcgaggggccaggggcagctggaggagagcgcctgcccctccccaccccgccccgcccctcctcccttccactccccctctgggcccgccctccgatttggcctcttccccgggcccaccctttctatagccccaccctttccgttttggttcctctctccctgccagccccgccccctcagaacctatcccgtttcctttatggacctgccctcgtctggtcccatccacccatcttgccccgcccacatccagccttcccacctggccccacccctcctttttggctccgtttcacccgccccgcccctctggacccacccctctttcctctgtggacctgcccctgtctggttccacccacccacgtggccccacccactccctgccttttatcctgcccctgccccatggctggccccatcctccatcccttttcgtccttgcccaccgagctcctctggacccacccctctttttgggcccgcacccatctggctcctcccacccatctggccccacccactcccctgctttccatccctgccttgccctgtgactggccccaccctccatcccttttggtccctccttgcctgccgagctcctctggacccacccctctttcagttggggccccgccctcatttggcccctttcacccgtctggccctgcccattcccaccttccaccctggccccgccctgtggcagaccccattctccattccttgtggcccttctcctctggaccaacccctctgtccattagggccccgccttcatttgacccatcccaccctctggcctcacccactccaccttccattttgacccagctccttggcaggctccagcctccatctcttttggctcctcctcacccgccccgcccctttggaactacccatctttcctttatgggccccgccccatctggctcctcccacccacctggccccccccccccccccgctttccatcccggccttgccctgtgactggccccgccctccatcccttttggcccctccttgcccgcgccgcccctctggagccacccctctttccaatcgggccccaccctgttttcctggccttcaagctcccgcctggcgccccgcagcggcaagcgtgatttataggccgtctgagccgtgacctataaaccctgttcttcagggggtgcctttcttggattaaatgcctctaaaggagcctctgtctcagaagtgtcatgtagaatgtttccgctgacggagaacatgacctttaaaaccccgagtaaaggaagcagagctgccaggggaagcatcgggcaaggcggcgcctcaacccgcctgcacctgtccgctctccgacccctccccagacctggtggggcgggctgctgacctggctgggggggcgcgctcccggggcctgggggctgggcgcggctcggggagctgcgctttgcggactggaggtggcgaccgtgcgagcagagacgcccctcaccatgggccaagagccctgaccctaacaatgggaaagggccagggcccttgttccacttcagtttccttccctttgtgccctgggggacactgggtcctgctaaaggctggggcgcctgtcgcagaagacccagtgtcctgggtgctctgggtgaggcacagcgtcctgggtgcccagataggggtgcagaatcctgggtgcctggttaggggtacagagtcctgagtgcctgggtaggatacagaatcctgggtgtctggtttggttgcagtgtcctgggtgctttgggtgggggcacagtaccttgggtgcccaggtaggggtgcagtgtcttgaggatctgggtaggttcagtgtcctgggtgttcatgtaggagtgcaggggcctgggtgcctgggtaggggtgcagcgtcctggaggtctgggtaggagtggtgtgtcctgggtctgtataggggtgcggagtcctgggtgttcatgtaggagtgcagtgtcctcggtgcccccggagggtgcagcgtcctgggtacctggggagggcgcagcgtcctggctgttttgtacaggggcacaacgtgatggcttctctggatgttccatctgcagtgtctcagaggatgtcatagaacttggaagaactgtgcctaggtcccaccttttatctgacactgcagtctttgtttcttgggtggaaaagccatggctgcctctctcccaggttggagaaagcatatttctggtagtagccactctgtaggtccatatggacactttatactaaggaggctacattttcttattctcttgcccccacaggctaatgtcacaagtagaaacgtgactgatacactcattcctttgtacacttttataagaaatccccgcagacgctgttttgctttggtccctttgaggtgcttagaggagtggctggattctccaagaggcctcatgcaggaagcactcagtatatgttgcttgtgagatgccgccagggattctctggaaggaggaccaggagatttctatggagagacgagtcagctgaaggcctttgtggatggaagtaggggactgtcttccaccgtgtcttttttgagagctgggaaggagaggccgggtcggctgggaaagagctgtcttgtgttggaggggctttgagccctcctccaagggtcgcagagcagcaggtagagacttagagtctgtgctaacagagagggagggtcttgtctgggagacttgcctgaccctctcttacttgggtgcatggtgctggcaaggaagaagcagggccagcggaagggctgtatttctggtgagatgtattaatatgtgaaagccacttcgggaaaagtagtgagtgtggtatgagcatgagtgtgtgtgtatgactttgtgtgcttgtgtgtgtctgtgcatgtgtgcatgtgtgtgggcacgtgctcctgggggcatgcacatgtttaagtgtgtgcttgtgtctgtgcatgtgtgtatgtgtgtgggtgtgtgtgtagggggcacgcagccagctctaacttgagcagaggcattctgttgttataaataaggctggtttttatattcccatttgaccagggagtgcaaccagcagaccaaaggtaatgcatttcagctgcctgtgggggaaggtaaatgtggtttattagcccccctggctcagagggggctgggcactggtagcagctgaagcaaggcggctctagatggagggaggggacaggttggtgattgtgtgccctggtttctctaaaggaaaaaaaatggacgtgccgcctgttagctaatcaacagtgaggagaaagtcctgacaacaagtaaagaaaacttagctggcaataaaataagggactttttatggtggtttttatgagaacattttcgctttgggagttattagagttagtgccggttgtgacaaaagctgcatttgcatatcgccgtgatgaggtctggatggagcctgaatgcggcattaactgcatatcagagaccctttcagaagccaaacaggatgacatttattgcaagctcgatgccgcacgtctggcattagttactgcttgttgtgtcctgtggaaactagattttctgtcttgggatctttctgggactggtcgcagcagcttcctaggtcaagaacaagctagggctttgggagtgtgtgggggatctcggggatggggaggggacaccatcgggagaggagaaggagttaggcttcacagggctgcgcgctggccaggtgcctgtcacaggctgacctagatgagactgccactctcagattcaagccccacaccaggacaaacaggaatttttcccacttttttaatttttaaaattacgatgtaattaacatatcacgcaatttactcattttaagtattcaattccatggcttttagtatattcacaaaaacgtgcaaccattgccccagtctattttaggacatttgtgttaccccaagagaaacccctcacttcttagccgtcaccccaaccccctcatcctccctagccctaaacgaccatacatctacttctgtctctattgatttgctgcctctggtcatttcatataaatggaaccatacagtatttttccttttgtctctggcttctttcccccagcagaatgttttccaggttcatttatgctgtggcacgtgccagaacttcattcctttttatggctgagtaatattccactgaacagatacgttctatttatgtattcatcagctgattttccctaaacacttttgaaacctttttttttttttttagagacagagtcttgctttgttgcccaggctggagtgcaagtggtgtgatttcggctcactgcaacctccacctcctgggttctagcaattctcctgcctcagccttccaagtagctgggattataggcacatgctggcatgcccagataatttttttgtattttagtagagactggatttcaccgtgttgcccaggctggtctcgaactcctaagctcaggcaatccatcctcctcagcctcccaaagtgttgggattacaggcatgagccaccgtgcccggccaaaaccttttttattgtaaaagatactcatgaaaaaattcatggttgagactgggcacggtggctcacgcctgtaatcccagcactttgggaggccgaggtgggtggatcacctgaggtcaggagtttgagaccagcctgaccaatatggtgaaaccctgtctctactaaaatacggaaggtagccaggtgtggtggtgtgcacctgtagtcccagctgcttgggaagctgagacaggagaattgcttgaacccaggaggtggaggttgcagtgagccgagactgtgccactgcactccagcctgggtgacagagtgagactccatttcaaaaacaaaaaaaccaaaaaatcagggttaagcccattggaacccacctgaattttttcagaaaatggagttctagattgagggagacatagggggttgatgaagggagtgagatggggtggggtggggggtggaactgcgtttcctctggaaaacatagagcccatgctttgcacctcccagctccccacccgcgaatgtggcctcagggctgactccaggattgctgctagggtcctgggagggtctttgttgcttgccattcagagagcattctctatctcaggggaccttcagccactaggtttgaggattcccaggggatgttggtgtggttgagggctctagggcagcttaggctggtggccacgtgttcctgcctcacatccgctcctctccatgagctctggctgtgctgtgtggttcagccagcatttgaaaagtctgggctgaggctgctgtggagaggaagcaattgtgcatttcatagatggtgacatgcatctctgctgaaggctgagagtgatattggaggaggcacagtgggcttctgcctggctcagatttagggagaatcttagggcagggggtgaagtcagaatgtcctattttttctcttccagaaaaatcggtaggatccctgggtgactcagctcttagtcttaattatgctgctatgtaaatatttctgaggtctcttggttttctcagttggcattatatcacagttaataaccagagggcacattataaatatgcaaactagtaataatgctttaactcgaagaacatcgataaattgccaaactgagctggcagcgttcagcagctcattccctttgctgtggagatagcttcctctactcctgcatcatggaacccacgaattccgttggcccctccctgccccagatggcaccctcaggagcagtcggctgtccgcttggtgtgccgagaaaacggctcttaatgtggccccgggtgtgttttccagcatctagaaatctcccagagagagcaaggcatgtatcgtggcttgccctccgctctttctgtgctgggacaagatcggaagtagagtctggaaggatggcccttgcccctctcccgtcctttatttggttggaaagatcatagcccccacggtggagataccgccagagttctcctccccgctccctgccttgtatatggcctcaggaagtcacgtcagcttcttcatcagaaattcatttatatgacaaatgtttactgtgtgcctactgcgtgccaggtgctgtgctgggcagtgcatatggtccttgtcctcatggaactgatgttagggtaggagagacaagcaggcagtagttaggattgtgatcgatgtgtgtctcggaagcacaaggggttactggagcacctgttcaggacgtatcatccattcccggtgggtcaggaaattctaccggaaattctaccgtagcaagtgctatctaagtggagatctgaagataccctggcaaaaggagacggatagagagagtggaggtgggggcttgggggaggcgggttacagggaagaacatcctggtcagagggaacagaatgtgcaggtgcttcaaggagagaatgcgggatgtgactagggagctgcaagtcgccagtgtggctgcagcatggagctagtggaggacaggtgtgctgaggtgggctgcagaggcacggggcgagggggtgtctgtctccaaggagctagtctgtcttgccaagttgagggacatttaaagggtttgactttatcgggacagagaggggccagtcttgccttagaaagctcctggttgtggtgagtggaccagaagaggtcaagaatggcagctgagatacataggggtccttgcttggcctccgtgggcattttcagtgagggctaaaccagatgccttgtctaccgcaaagggcacttgttggatcagcccgagccatgctaaatcaggcagcttctgagcaggatgcaggttgggggctctgaacttggagtctgggcaggaaggaggtggtgtttgtggtttgtggaggcggcagcgggatgcctgtgacctgagtggagctagaaggggcaaggaacgctgcagaagtaaaggcggccaggttgggggagtgagcggctaggttgggtgagggttcctgggctccagccgttggactgccgcttgccctggaacctggtccggctcctcccccggatgatcacatctgctttggggcggtgaggagggcccagatgatgtagtgggaactggtggtgcccagtgagatgagctttttcatgcaggccttggacttcaggcttgttccagctcagtgcacttttcctgcctcagcttcctcatctgtgagatgggcacctacctttggggtttctttgcaggctctgtgtcttcccatatttacaaaataaaggttggatgggtgtttattggccttcaaagccagtgtaggcctacgatttaaacttcatccacattcctcagcaatgggtgtagaccatagttagatgtattttaaactttttattttgaaatttatttattattattacaggaatttgcaaagagagttcagggggcctcatgtagccttggtctcctttctgcaatggcttcatcttacctgacagtatcacagccaggacccagatgtcgatacagtgcacatgtgcagttctgtgttgcttcatgtcacacgtgcaaatttgtgtcaccaccaccacagtcaaggtgcagaattgttccatctccacagacatcctcccaccaaccctgtgtggtcaactcaccctctccctcccaggatctctaaccccagtcaaccactaatttgttcaccatctctgtaagactattttaaattacaaatgtatttttgttataaaattatataataatcttccagaaattgagggacatggaaagaaaacatttccatttccctaccactctcagtgatttcagcgcatctctgtgccttttttggtccacatgcatatatttagtgtatctgtaatcctaatgtgtacgggaccttatgtcctgctttgcttgcacgacgtgccataagcatcctccatatgtattggagccgtggagtgctcacagacagcattccaggaggcggaatgggtggcagggagtgggaggcagcagaaggagtggaggccggtcccagaccagcatcggtgaggaggtaatgggggttcttgccaggccagggactctcggcttggagggggtcactccaagggcctggcaaaggatgtggcgacaggacccagggactccacctgaggcctgaaggataccgtgagtctgaagactccacagaactgatgttgggatgggagagacaagcaggcaatagttaggaatgtgatcgatgtgcatatcagaagcacagggggctactagagcacctgttcaggacgtatcatccagtcctggtgggtcaggacattctactatagcaagtgctatctcagtggagatctgaagataacctggcaaaaggagacagatggagaacagaacagacccaacaacctcaggagaatgaacagccaggtgttccctgaggccagtggtagtgtctgcatggaccgttgctggctgtggtcctctgcagggaccactgctgtgtctgtttccagcctctcctttcctaaaccaggccggccctgtcagcctggctccaaacttcactccctggcctttggagggaagaccctctggttcgggccttccttccttctcagggctttggaagcccctcttctttccaaaggggcttggctttctgtcacccagcagccagctccattgtggtcctaggagtgtcagtgagcacaaagcagacacagaagaaaccttgaagtaattaacagagtgagcatgagacgttcctgctggagaagagcacacgatgggcctcgctcctcatgctccccactcctgatgagtaattacacgtggctgtctgggagtgggagtatttatagcaacgcctcttttgctggagtgttgaactttcttctttgtggcagcacgcttataaaaaggtaatcaaatagcagacgatcggattgtatccgtgtcattctgctgccactttaatgaggactgagaataaatagaaatcctgaaattgtgctatcccaaactgtttgcaagcccctcagtgggggagtccggtttgatttggttttgtttttaccacccccaccctcactactaattttacgttgtctttggagttgctcaggggccaaagtgccttctgggtaagtctctaaccgaaaactagatccacaggcaggccttttattaaaaggcatttaatgactctgaattccttgttgtgttagagctgatttggggcaggataatggtgtctgtggctgggataaaaacccccatgaccatcctccatgcttattaggtaagtgattggtgtggattcctgctctccgaaggaaaaaggaaagagaagaaaaggccaggcctgcctgtggccgcccccgggtctcagcaatggcattatcactgctaacccaggtgtgacttggctccgctgccattggcgtcagcaaggcccgtcagcctccccaaaaagccagagctggcctggagagaggagaggagagcatcgcgggcaggtgctgagggttggccttgtgttctggacaggccgtgagcaggagactgatcgtcttgatgaggtgtgcagggcaggactttgtaatttgacattgttggagaaggaggggcgggggtagagtgaaggccccagaaggagaactgggtcagaagtgtcctttgcttctcattttcctcccaacaaggggcttccctgttgggaaggtttgctaaggcaggggggttattgtgcagagaagggggtgactgccctgtcaccccagtggtgagggaacttggctttatgacatctaagattgtgagcctatgtaaattgcagggaagagtaacaagtaactgaaagtcccgtgtgtgctcctagtgacacacctggccggttgcctttaataaaggcagaaaaacctccgttaagacatttactcatgcctttgagtaaattaatattgatttgacattcgacaactgtttgaatttttacttcttttttttgcatctggagaaaggatctgtgtttagtaagcacttctgtgtgctgatttctgcaattagcctttattcatcccttgcctgccgtgtgccaggctgctctttcccagcatcagggtgctgaccaggcaacacggtccctgccctcggtgagcttatgttccaggagaatggtgttgaggcaaagagggaagtcctatctggctgtcttaggggctggcagttggccagggaagtgctgattagaggggccaaagcctgaattctgcctgtgcttcctggctgagtgtggagtcagtgtagacgtctttctgtctccaaacacagcctgaacctaattgtttcttttactattattattgttttggtaagaatgctaaacgtgaactccatcctcttaacagatttttcctttccttttccttttccttttccctttcccttttttgagacggagtgttgctctgtttgcccaggctggagtgcagcggtgtgatcttggctcacggtaacccccgcctcccaggttcaagtgattctcctgcctcagcctcccaagtagctgggattacaggcacccaccaccatgcctggctaatttttgtatttttagtagagatggggttttgtcacgttggccaggctggtcttgaactcctgacctcaggtgatccatccacctcggcctcccaaagtgctgggattacaggcatgagccaccacgcctagccgtctgaacagatttttaagtgtacaacatgtgttgctatctttaggcatgatgctgtgtggcagatctccaggacgaactcatcttgcatgactgaaattttatacatgttgaacatcaactccctatttcctcccccatctagctcctgacaaccaccactgcagtcattgcttctaggggtttgaccatttttgatacctcacataaggagaatcatgcagcatttgtccttctgtgactggattctttcacatagcatagtgtcctctgggctcatccatgttgtcacatgctgcaagatctccttctttttgaaggctgaataatattctaccatgtgtatatcccacgctccctttatgcacgcatctgttggtggacatttaggtggtttccacgtttgggcttttgtgaatagtgctgcagtgggcacgggagtgctaatatctctttgagattcagatatgacttgttttggataaatactcagaagtgggattgctggatcatatcctaatttatcttgacagtggccacgattctgaacctctttggttttgtcatctgctgggtgacaccgaccttgtaaagactcagccctcacctggaccgtggcattcttggtcccatggctgttcatgtggccctgagagcgaatgaaagtatcgcctcatctcccttctacagtggctggcgggaggtggaagctagtgctgcctcctgccccaccttcccacagccggggaaggggctttcacgtttctgaatctcagcgccaaaaggaacttcctctgtcaggacccacttttgtggaagcctgtgtgaaatgtgatcctcaaatccagcttgaagctgcggttgaatttttgtggggttctcattatttaacgtttggcccagaatggcatttgtctgaagacagacagacaggctggagcttactgggggcccacacagtgtgtggagctcggtctgggctgctctggtttgtaatatattgttctcagtgccaggagctgcagcagcatctccagtgaggaacaaggagagggaggaacctgggagcaggaggggaaacccggagtcggagaatccaatttttcatacagtaacaaaacaatacagttgtgtattcccataatatcccttcagtttcttggggtctaggcttgcatctatttttaaaaacacttggaccaataattctgctttatgcagaccaactggagggtctctagcttggagatttaatgtaaaataaactctaaatggggtggcacacagcatggtggcctgcaactgtagacaagcaatttttcttaaacaagctgagggattgaagtaaatgatggtggtgttcagttctgtcccagagttgggagtgaggcgaggccagggagatggaaggtccaggcttatccaacctcctgtgcgctccctgtgaatgttggtcgggcagggaggctgctcggagggagtctttgaggaagccgactcctcttacctgccgcacggacgtcctggaagacagtctgtgcatccagactggggtttcctagcactttggaactgggctcagaaggcttcagtttggcaaagacgcattgcattttgcaggttcctttgatcacggcccaggtggggccacatccccttagaatacttttctctgtcttcttcccttgggcttagacggccttttgccatctaataataaaaaaaatttatctgacaaatatcaagtatttgttggaataaacataaggcttgctatcttccttggacaaggggaaaataactctccttcacttctgacgagtttacaagatacaagttaatttttggacagattatcctgccaacttaaattatcaataaatcaccctgccacccatggtccttctcgtgaaggaggcgccatctctgttttctgggggaggatgctgcagggctgagatgacggggcctgcctcgagtcacaccagagctggaaggtggcagagctggaagccgagcattccacactgtctccccccaccaccatcagtgtgagccttggggaaaaatagggacgttcagcatgttgtccctgctcttgcggggctcaggatctttgtaagaggaacaggagtaaaccctgaaaatttcggtaaaaattaagaagcagcggagtggcatggttagcgtcactgcatgcaaattgtcctgtggcttgctgctttgtttgttgttattgtttgtttttcatcagactgtgggctcttggggatgctcctctgtgcgctgtttgctgtggaattcccaggagggacggtcatcgtttgttgactgcaagaatgaacgaatgctacgagagtctggggagctgggccttgaaggatgggcatttgttgggcaggctgaatgcaatgacagttgttcaagctgatggggagcgtggcaggagaggaggaggtggagcctgcttggagcataataacggcttcattgagacagaattgtaggctttagatgggtacaattcactcatgtaaagcctacaattcagtggttttagtatactcacagagttgtgcagccacactacaaccaattttaaaacattttaatcgccccaaaaggaagccttgtactcctcagctatcacccccaagcccccaacttcctcccagcccttggcaaccaccaatctgctttctatctctatggatctgcctattctagacatttcatgtaaacaggatagtgcagtatgtggcctttggtaaccgccttctttcactcagtgtcatgatctgttcttccctgccgcggcgagcgtcagtactcccttcctttccgctgctgagtgacactctgcgatgtggacagagaccagagcatcttgaatgctcactcgagccaggcaccaggatgcctaaagcaaagctgttggagtcagactttgacctaattgagttggggttccaggaagatcaatctgatcatgggacaaaacgaaacagtcagtgcctggaggcagaggccccgctgagtctttcttgggcttcttggaagaaggccacaaaggtcaggacgaggaacagccggagaagtgtgactgcatgcatgtcaaggagaactcatcagcaggacctcctgctgtgtgtgtgtgagatggggcagggagacggatctggcacttctggcctggaaaactgggcctggggtgaggattgtgtggtggctgatgggaaggggagaaataggcgtttccacctgtgccttgcctttcagagtgttggcaggcacagagttcagttggctgctggactgtgcaagggggacgtgggagacaagggatcccacagaatccatctttatggaatctacctttcagagagagcagatccacgtgaaagccaggctctcgggagcagtagagcatctgtgatggaccctaggtgagtggcttgcccaggaggaaaggacatgggccaggatgatccaggagggctttctgagagggaggagccaagctctccgtgaaggatggatgtgccgagcatcagcagaggagggaagagaatattccagacatgtcaggcaaatagcaagcacagggtgatatggtttcgctgtgtccccacccaaatctcatcttgaattgtaactcccataattcccacttgttgtgggagggactcagtgggaggtaatagaaccatggggacgggtctttcccatgctgttctcgtgatagtgaataagtctcacaaaatctgatggttttataaagggcagttcccctgcacatgatttcttgcctgctgccatgtaagacatgccttctcttctcctttgcctttcaccatgattgtgaggcctccctagccatgtggaactgtgagtcccttaaacctctttcctttataaattatccagtctcgggtctgtctttattagcagcgtcagaacagactaatacacaggggcactggatgggggagaaggtcgtgtgggtcgggtcctgctgttggaagttgcaacctgcggaggacatcggagaataagctgggcaggctgggtgccatcaacagatgccgatgcccagcacaacagtaactacagctcttgccgcatacttctgttcactcggtgccagtggggttatgttggagccaagtactgggcaaagcttttttttttttttaatttgagaaggagtcttgctctgttgctctgtcacccaggctggagtgcagtggcgcagtctcggctcactgcaacctccacctcccaggttcaagaaattctccagcctcagcctcccgagtagctgggactacacgtgcgtgccaccacacctggctaattttttgtatttttagtacagacgaggtttcaccatgtcagccaggatggtatcgatttcctgaccttgggatccactcgcctcggcctcccaaagtgctgggattacaggcgtgagccactgcgcccagcctggactaagcttttttaagcatatcatgtcatttactcttcacagcagcccactgggtagattgggtgattattacagctttagaggtatggaaaccaaggtttagagagattgagtgcttagcctaagtcacgtatctaaaaagtgctgaacctgggttttaaaaaattttcctttgagtgtaaacaagccagtagtatgtggtatttatacacaacagagtaccattcagccataaaaaagagtgagatcctgttatttgcaacagcatgaatggaactggaggtcattatgttaagtgaaataaaccagacacagaaagacagtcttcacatgttctcacttctttgtgggatctaacaatcaaaacagttaaacacgtggaggtagagggtagaaggatggttaccagaggccaggaagggtagtgggggtgtggtggtggtcagggcgctggagattggctaatgggttaaaaaaaatagttataatagaatgaataagaccctagtattcgatagcataacagggtggctagagtcaataataacttaattgtacatttgaaaataacaaaaaaagtataattcgattgttttaacacaaaagataaatgcttgaggggatggattcctcattctccgtgatgtgattattatgcactgcatggctgtatcaaaacatcttatgtaccccataaatgtatacaccaggccaggcacggtggctcacgcctgttatcccagcactttgggaggttgaggtgggtggatcacccgagggcaggagtttgagaccagcctggccaacctggtgaaactctgtctctattaaaaatgcaaaaattagctgggcgtggtggcaggtgcctataatcccagctactcgagaggctgaggcaggagagtcacttgaacccaggagtcggaggttgcagtgagctgagattgcgccactgcactccagcctgggcaacagagcgagactccatctaaaaaaaatacatatatatagttaatattatatttttatattttatatattatagatatatatatatctacaatgcacctgcaaaaattaaaaattaaagtcagtaataatgaccgcatgttttagacaggatggatgtattctattggtgagtctaggaagcatctagagatgacatttcaactcaacaaacattaattgctcggtgtttgggatacagagctgagcaggacaccctggacctggaggtactggatgagcatagaagagacaaccatccctgtctgtctccacacccgtcagtaaatgcttgtgtggtggatgcatcgtgaacaggcaggtattagcctggggagctcgctctcccttgcacctggctgagtgggcatctgaacaaagacacagaggagacaggctgaggtgaggttcagtaccccttagtgagttgttggtgtggctggaggagggagtgcggaggacagcaggggaaggaaaacgagagggaagctaggatgtggctgaaagacattggggagagctggaggggtggaccaggcctggcagggcagccccatccctgcccccttggaggaagtttcctgaactctcccagctcctgcacagggtctccggcacaggggggcttcctaggtgctgctccctctcccactctgcaggcagctgccgcctcctccaactcctgggcctattttgcccagtcagggccattcaattctgcatcaaggtgctaaatgggtctccagcagctccagagaaagatccatttaaaccgtgtgcatatggggaggagtctctgggaagagcagcccttgttggattcctgcattttgcagccttctggaactgagcagcttttagaatttcaagccacaatttgtattcaaatgaaggtcatttgaaaggtgtaacatagtaaacagccattatttcattttgatggtggcactaaaattatagtgttggttgaattattttagtgtaggaccattaccatctccctaaaacacttagaggcgttcttagaacgctgctaccatcctaaaattagaagaaaactaaaaatcatgaagctgagctggtggtggtgtagctgggggagaggacccccagtgcttgggacactgtcgcctcatggtggcgtagctgggggagaggacccccggcacccgggacactgtcctctcatggtggtgtagctgggggagaggacccccggcgtgtgcaacactgtcccctcatctagctttcctggctctccacagctgtttgagggctcagcccactatgtgcgcatgaagacgggggagtctcagtgctgtgaattgtgggacatagaaaaacgcacccccatcccacctgttcctctgttattcaagtccttaaaatctcactattgagaccttacccccatgagcttttctttcagagagaagcacccttggagggcgtgcctcttactgacagcccctccaggagcacttactggagaagctgtgagtcctttgctcacctgcagctgtgctgaagtctcgcctgttgggggcctacaagtcggggtggagtcgagggcaggtgctgtcttgcctgatgggcccttaccattctgctaccattggacatccagaatcctctgtctccctccttaggcccggggctcctctctctggccagccaaggatggaagtggctggtattaggtgggctggaggggtgggatcccctttagggactctgcactgcattgaagtagcaccgggagtcacgagcccgtggagtgacagacccagagagacttacagatcttcattcttcatggggcagatctggaaattgaggccctagagggacgtgacttctgttaggttatacagtgatttggtttgtctgtgtccccacccaaatctcatcttgaattgtagctcccataattcccatgtgtcttgggagggacttggtaggaggtaatcaagtcatggcaggggtgggtctttcctgtgctcttctcatgatagtgactaagtctcaggagatctaatggttttgaaaaggggagttcccctgcacacacactcctttgcttgccaccatgcgagatgtgactttgcttctcctttgccttccgccatgatcatgaggcctccccagccatgtggaactgtgagtccattaaacctcttttctttataaattactcagtcttgggtatgtctttattagcagtgtgagaacagactaatacacacagcaagtcacagaggatacgagattgagcctagagccttgggcttcctttgctgtcactgggtgtgtggttccctcatcggaaacccttggagtcagttctgttacagaattcagaactctctggattccagaggagtaactgagggtacgtgctggcacagtctcggtggctctgagaacagcccccaatgagcaaacgcactgatatttctgcagtaagacgtaaatacaccaagtgggaccaataagggcaatagatgatgtcagttcagattaaatgtggccactaaaaggtgccaagttgaagaaaaagacattggattcctggaacttttaggatttcagaatttccaataaaggatgtggccatttctaatagtagcacgtgctccttgaagaaaagctgaaaaattcaaaaagtactttagaagatggtaattgccccacatttaatcaatttacagatttttacttatgtatttttacatagcagaatttcttactctgtacaattttgcactctaattctcattattattttatttatttttttgaggcagggtctcactctgaaacccaggccggagtgcagtagtgtgatcatggctcaccgcagccttaacctcctgggctcaagtgatcctcccatctcagccttctgagtagctgggaccataggcatgcaccactacacatggctaatttttaatttttttgtggagacaagttctccctattatgttgcctagggtggtcttaaactcctggattcaagtgatcctcctacctcagcttcccaaagtgctggaattacaggcatgagccaccatgcctggcctattattatttctgagacagaatcttgctctgttgccaggctggagtgcagtggtgcaatcacagcttgctgcagtgctgactcctgggctcaagtgatctttgtgcctcagccttccaagtagctaggataacaggtgcacaccaccatgccccactaatttttaaattgttttgtagaggcagagtcttgctatgttgcccaggcctctcttaaactcctgggctccagtgatcctcctgcctcagcctcccaaagtgctgggattacaggcataatgtatttttttgacatttaatacatgatgtatttttaattgcattagataataaatgtttttctatgtttttaaagaaacatttggatggctgcacagtgttaggaagcgggccttcttgactctcagcctggtgcttttctccctagagcacatgctgcttctccagctagttacactgtaaacccacagagcactccctgagtgttctctggtaggtgcgccgatggccagtgtctgggagatcccctaggagtcatcccagaagcctcctagagcagcaatggggagaacagtctttagggctggagatgatggacagagctcccaagctgtgcccaggaagtgacatttccctctcccatgctggccacaggcaattgggaatcccatcaacttggaaatgagggcagatcctggagaggcacctctcattgcctgtgacatggagagcgggaggaggggccagagtgggggccttcagcaggctccttatgggggtgggtggcacagcccttggaacaagtgtttcctgcctgaatttcaccctcgggaggcccttagctacttcttaagtgtcccaagtacttgtctcatgatctagcgcccttccccaaagtcacaggcagcatggccccgggttctggctccctgtccccacgcagttggcagagcatggctttaagctcctcagtgctgcctaggaccccctcctggctgcctcccccttcactccacagggatcctcgctcagccctctgtgcgtagtggctctggttgaaggtgctggccgtagaggggtggggaggggtggggagcaggagcgatcctgcctcagtggcccaaactcatagggcttggtggggaccaggccaatgcaggacaattgggcctggtttgtgggcctccttgtcactctcccatgaaggagtgagtagggtggagggaggattattgggctaggagactctggagtcctttctggagcggggagcctctgaggctgacccatgtaaacttaccttgatgattcatcctccaaaactctggggattgggaacagtcaccaggacttacagaacattccagattgtggctcctgtgtgctgtctttatcctgtgttactctcccctcaggcagattgtccaaatgtaaattccagaaagaatctaagagtatgtgcggggaaccttacattcctggaaactcattctatcttggtgccatggtcttagaaaatatattcattttcagaaagagctagtgtctatgtcctgtggagccccctctacttctacctgccttccctccactacgttccagctatactggctgcctttcagctccagacgctccaacagtcagggctgtggcacctactctccctcttcttccccttcctcatcactcttactaagtctcagtttaaatctcaaccccctaaacctacaggcacccctgtcataatctgttgtcatactatatgcttttcctttgtaatacttatcacaatttgtctttatatattcatgttaatttcttttgtattatttcatatttatcttcttcacaaagcttcatggaggcaagttctataactaatttgtttacttcagtagcccagtagctggtacagagcaggcactcaataattggatctattatttgatggaaggatggatgaatgggtgagtggatggttgaatgtatgggtagggggatgggtgggtggatagagggttgggtgggtagatggatggttggatggataggtggatagatggttgatggatggatggatagattaatgcatacataggtggatgaatgggtgggtgatagatgaatgggtgggtggatagaggcttggatagatgaatgggtggattgatgattgggtgggtgggtaaatgggtggatgggtgggtggatcgagggttgggggtggataaatggttgggtggatgagtggatagatggatggatggatggagggatgggtggttgggcagatggatggattaatgaatggatagatggataaatgggtgggtggatgggtggatagatggatgggtgggtgggtgaatagatgggttggtagatgagtggatagaaggtagatgggttggtagatgagtggatagaaggtagatgggttggtaggtgagtggatagagggatgggtgggttgatgggtgggtggaaggctgggtgggcggatggcaacatcaagtactttgggaggccggggacttctgcattgtaaaagtgcataaaggggtttctttcttttcatggagaaaatttctattctgaaaatggcagcacattgcctgttgcaaagccaacactttgggaggctgaggtgggcagatcacttggggttaggagtttgagaccagcctggccaacatgatgaaccccgtctctaacagaaatacaaaaattagccaggtgtggggtggtgcggggctgaaatcccagctagtcaggaggctaagacaggggaatcacttgaacctgggaggcggaggttgcagtgagccgagatggcgccactgcaccctgcctgggtaacacagtgagactccatcttaaaaaagaaaatactcacaaaaaacaacaaagaaatgtctcctgggtgagtaggcttcaggcaggacctgggccagtggccggatggccattgactctctctgcacgttttccctctctgtacatctgcatcgtctttcctcagctgccgatggctgggttctgctcctcagtccatctgccagacaccgagttcagacgcgtcaggtcagctacctgaagaggcgactttcagggcctcaaatccaatgccaaattcctggggacgacagtctggagtaatctattaccagggcgctggggtcacacattcggactgtgggaggaccctgcttcccagagaaaggggtcgttgtatctgccacaccagttttacgtagactgcctatgggtctgacttccagttttggctgaagttctcacatcccgtttgatgactgcctggccagatgcctgttaggtcccaggcctggaagcccacaccgattacaaggctgtcccctaagctacaagcccgggaaacctgcccatttggagctgtgagtgtagggggcgtggggctgacttgcagagccaggccaggctggctgtaggaagagaactgcagctgtagctacgggggcccctcagtaaaggcgtcctgggtttgcccaagagagctgctccctgggcctgtcagatgcccactgtgaatgggaggagctggcatctgagtctgacagatgatctctgctcctctccacagcctggctttgcaagaggcaatgtgctgccattttcagaatagaaattttctccacgaaaagaagaaacccctttatgcacttttacaatgcagaatctaatttaggtttcaataagggaaggaaccattatatcaccctacttcagtgctttttgtcattacgttatattttttaaaatactttcatcggggacccgatatacacttacaatctctctgcatttattttcttttaagaacacatataataaaactcaaagttaatagcacgaaaataatttctacaataacagttgtagcaaatcttcgaattgccagggtgaaggtggctagacagagtgaggcaattacgtctattattagcagtgcacggggaggattgatgtacagtgggctgtgtgtgagcagaagccttcagacgtgaactacattttaatagtgaaattctcatagattataacttccttcattaacattttcacacatcgctgactaacaaatgaggagagaggccttctgcactcatagatttattatgcttgggatgctctctgcacctctgtgtatgggcaggagcttcgtcttctaacctctgactaccggcgattaactctttccggccctacctgtttccttcaggcacggaagaacattctggaaatactggctttgcactttaagacttttacaaggtggttcctcgggacagcccccactggctgctccctgccgtctttctgtgcctttcccctgttgccctgcaggtgggtatcagaggacggagggtctgggggaatgagtcaggccagatttgggctccatccgtctgctgccatgtctctcaccaggagaagcagaatctgatccctgctcaggtacttgagttgctaagtggggcgaggcagctctgagcatcaaaggatggttgtttgacacaattattagatctcctattagcaagaggagtgaagtggtcttctgtcccctgcgaggcaggggataccacccaagatgtgacagagggagttttggggagggctcactgggcagagaaggggaagtgggctttgccgtcaggatccaggtgaactgactttccaggtgcagagccttgtcctaggagaggatgaacgatttacaaaggagtcggatgccagtgcccgccctggagggatttgaggttaaggtgggaaaatcttgaggaagggacagtgtttttaggtgatttgtcaaccatcgtccatggttgtacctgcactgtgaggcgagtgctggggcttgcagagaaatgccatcttctggtcaccccattaacccggggaggcttcctggaaaattctgtgagtactggggctccaagatggtggttcctggtggttgtctgtacctggtaccaagtgggttagaagggtgctgtggacgtgagttaatgcagggagcaaacctcccaggtttggagctgggcgttgagtttccagcccatccttcctgatgacgcactcctgctggtttcttttggggacacaaagccttggtgacttaggacccaatattctacaagtttgctcttgggcatatcttgtggtgtttattgggcccccaatggcatatgagaccccctagggccaggttccccagcccctccgcccccacttcccatgctcatttgtgtgtctctgagttagggtattttggtaaactcttcaacaagattgaaattgaacccaggggttttcagtcctgtctgcatattgtcatcactgggtaacttttaaaaactaatgccagggcccaccctcagagactgttttgttttttttttttgagacagagtctcactctgtcacccaggctggagtgcagtggcgcaatcttagctcactgcaacctctgcctcccaggttcaagcgattcttctgcctcagcctcccaagtagctgggactacaggcatgtgccaccatgcccggctgattattttgtatttttagtagagacggagtttcaccatgttggccaggctggtctcgaactcctgacctgaggtgatctgcccgccttggcctcccaaagtgttgggattacaggcgtgagccatcacgcccggccaaagactcttttaaatggtctgggtggggctctggcattgctattatttaagagctcccaaatgattctagtgtccagtccaggttgaggaccaccaaaaccatttggcaggtgatctggcctttaggtgaattagctggaaggaagaagttctgaccggaacaaacagtgaggctgtgggcagatggggatgcatttataaaaccccttactttttctttctgtcttttgcaacctgtagatactcgttgctattggatgcaatgtgggaggcacaggactaaatcctgtaggtcgttgaggaaagggccgctttgcttttggtcccgggaatccaggttccccttcttccccatcactccttccttccccctccatccccagcctgtgctgtgtggtgcccaccccagcctcatggtccccaggtgggcatcatccgcagcaagagccggcgtctgtcatctttgatctcctcctgtaactctgtagggcttagccagctctgcttgactccagcaccagaccagcagcaggagctgctctgcttcccatccctcttccctgggaacattatcccttaaataaaatcaatagacctgggacatgcttggaatctagaagctaatctttcctaagttccgttttcgtgtcagagttctcctagtggccaccattggctgtgcagtgatgggatgtgggaatgaatccatggggacccccagtgcagtctggggaggtggtgcgggtgcgctgggtgattctgctgggagaagggccgtgacgctccgaaagctggtgctgggcttccttccactgcacagggctccatcctgcatcccggcaccccaccaagtgttagggagtgcgggaggcagacctaatgaaaacccggtttcattttgcataatcaggcactattgaaacgagcctttcagtgctgcttgctgcaaattaacaatctgacttatatacaataaaaacccgagtattgtacaaagtgatacttcttaggtagtggatacacagatggaaattcatttaatgaactacaagtccctgaatggattctaaacttcttgtaattaccctggaaagaaccctagtagaagcagaaaaaagccttttggattcccccccaccccctacccctgcgccacggcagttggctttctccatccttcaggttgctttgtcggaaatgagcatcattctgtgaagagtacttggagtcccgtccaacgggttgggccgcatgtggatgagcaaacctcattccccctctccaggttctgaaaacagtgtgatttgtaaaggctttggtgctgaaccaaatgcatcttaaatggtatcgtaaagagtttaacccatcaccccagcatcagccagtgaacagtctggctggctgcccgagggactggggagacctgctctttgtagcactggactgactgagtctagactgagccaatccgaggcagagactcaaccctgctcctggtagttttctttgaaagatggtgtcccaatggggaggccttcagaagagttccactaggccaggagtcactttcccctttgataaggcaggaggggcaggggacatgacagggcagaagttccttgggaaaaccagagcagagccaggttccagccctcaggtgagccatctcccacctccaccaccacagcctgatgcaggagccatctgggacctgcctcttccaaggagacagttccatggaagggggttagggacggatgtggcatccacaaggagtgccacactcgataagtatcccaacctgttccatatttattatgggcaacaatttgactaacggagaatttagattaataacattcaggccagagaagtaatttcctttgagaaagcgatttacatgcgctctgccagagagagccgtggccgctctcttgtcatgtcagctcaaataatgaagttgaaaataacatggaaggttaataggtccaacttatctctttagaactgaaaaggaagatttacagtgtggaggctgttttgcatatttccagtgggaattgaaagttttttttccccaaacaagatttatgagaactcaccgttcaaggtatctgctctgttattgctcctaagtgaggcagtaaacctcttcatttgggtggatgccccgggctttaaagatagctgtcttcccccacgtcactggcaggggtgtactggaatgctggcatgggggtgctacctcgggaagagtttaactttgaaaggagagtcaactgcttctgactctaggaggtcacatcctttgtttgctaatgactagagagaggattaaacatttccattacctagacctttcaaaacatttcttggatttattttgccattatttactgaccttggggggtgagtcctgggctggaggaatagagggaaagggagctgggtcagagcaaggagaatgggggagtggggcagcaacatgacctctgcattccaggcaacaagtgggtctttcaggctctcacttgcttcttaactggcttccctggaaagctcacccaagcccttctgctaacatctcactggccaacttcatctgcagacgggctgggaggggcaatcttttgctcagcactttcctgcccgtaatgaaattggagtgtgttatttaggaagaatgggagagtggatattggtaggtcaccagcagtctttagctcaagtgtttagttcatttattttcaatctttcttgttttctgttaaatgcaaactataaattgtcctttaaatactgctttagctgtgtctcacaattttttttctttctcccaaacattatactgaaaaatttcaaacgtaaagaagagttgaattagatatgatatatccatcactttaacaatttgctatatttgctttatcccatattcatccatgtatcaattcatcaatccatcttggtttgatatatttcacagtaaatcacagctaacagtacatgtcgcctctaaatatttcagcatgcatattatgaactgtttatttactttttaaggtaaaattcctacagtgaaacacacaatcttaagtgtgccgtgcgatgagttttgacagatgtgtctacccatgtaacccaaacttctataaagacacagaacatttctatcatcccaaaagggttcctctggtctcttcttagtcaatgctctcctacccccaggcaaccaatgttttgattattttcaccattagttatttttgcctattctagaactttatgaattcatataacatgtactttctctctctctgtctctctctctctctctctctatatatatatatatttatatatatatgtgtgtgtgtgttttaatctcaatagctttttgggggtacaagtggtttcaagtggttttggttacatggattaatttggtgaaggctgagatttcagtgcactggtgaccggaggagtgtatattgtacctaatacgtagctttaaacatgtcctcttttaggcaaggcttccttcattcagcatgttttttgagattcatctgtgttgttgcaagtatcagtagtttgtatcagtagtttttttttcctttttattgagagtagtattccattgtatgaatgtaccatagtttgtttatccattcattcatggacatctggtaggtttccagtttttggctattatgaataaaactgctgtgaatattttgtacaagtcttttttggggatgtgtgtttttatttcttttgggtaaatgcctaggaaagaattgttgggtgctgtgttttcttttttttaaaagaaactgctggatgtttttttcccctaaagtggttgtaccatttccaccagcaatgtatgaggattccagttgctctccatactcaccaacatttagtgctgtgactcttaatttcagccattctgatgggtgaacagtgggatctcattgtggtttccacttgcattccctgatgactaatggtattttccatgtgtttattagtcatccatatatctccctttgtgacatatctgctccaatcttttgtccattaaacatcgtggatttcccttttgttagtgggggcttgtagtttatatattctggatacagttctttgttagctatatgtttcacaaatattttctcttagaatgtggcctgcttattcatttttatttttatttatttgtttatccattcattcatttattttgagacagagtcttgctctgttgcccagggtggagtgcagtggagtgatctcggtttactgcagtctccccttcctgggttgaagcgattctccggcctcagccttctgagtagctgggattacaggtgaccaccaccatacctggctatttttttttgtatttttagtagagatgtggttttgccatgttggccaggttggtctcaaactcctggcctcaagtgatccgcctgcctcggcctcccaaagtgctgggattacaggcgtgagccactgtgcccggcttttgtttattgttataatggtgtttctttatgaccagaattttacattttgctgaaatatattttttatgatttatttatttatttttgagctagtcttactctgtcacccaggctggagtgcagtgatgcagttatgcctcactgcagccctgacacctggggctcaagcaatcctctcacctcagcctcccgaatagctggaactacaggtgcacaccaccaggccggctaatttttgtatttatttttgtagcaacgtggtcttgccatgttgcctaggctcgacttgaactcctgggctcaagtgatctacctgcctcagcctcccaaagtgctgggattacaggcataagccactgtgcccagcctgaagtttatcacttttttccctttctgattatttctttccatgccttctctaagaaatctttgcttattgtgaagatattctcctatgttttcttctagaagccttataatgctagcttttacatgcaggtctgttgctcatccattttcacactgctagaaagaaatacctgagactgggtaatttatcaagaaaagaggtttaattggttcatggttctgcaggctgtacaggaattgtggctggggatgcctcaggaaactttcaattatggcaggagggaaagcaggcacgtcttacatggccagagcaggaggaagaaagtgaagtgggaagtgccacatacttttaaacaatcagatcttgtgagaactcacctgctatcatgagagcagcaagggggaaatgcgttgccatgatccaatcacctcccaccaggcccctcctgcaacactggggattacaatttggcatgatatttgggtggagacacaaatcccaaccatgtcaccatctcagattaacttttatgtatggtgtaaggtaggagacaacattgttattttccatagtgatgtctagttgttcagcaccatttgttaaaaaaagactttcttttccccattggattgctttggcacctttgtctaaacattaattaaccacataagggtggatctattttggtttctattcttttccactaatctatttgtctgtccttataccagtacctcactgtcttgattattggagctttataataaatcttgatgtcagttctccaactttactttttcaaaatgatttgactatcttacctctttgacattttcatataaatttagaatcagcttgtcaatttctattaaaaaaacctgcaggtattttcattaggatagtgttatagattatttggagagaactgtcatctttaaaatactgagtcttccagtccataaaggtggtatatctcttatttaggtcttctttaatttccttcagcaatgtttttagttttcagtgtggagattttgcacatcttttcctgaatttattcctaggcattttatgattttttttttagacaccattactaaaatccccaattgagataataggtctatttctctctttatttctgtcaatttttgcttcttgtcttttgaggctctgttattaggcacatgcacaattatgattgtaatgcctccctgattaattgcctcatttttcactatgaaatgtctctacttctggtaaactgtttgtcttgaagtctacgctacatagccatttccagccttctgatgtttgtggtttacatggtgtatgtttttttatctattgctttctttgtctttctatttaaaatgtgtttcttgtagacagcctatagtttggtcttgctttttcctacattctgacaatctctgtttttaaactggagtgtttagtctatttatatttaatataattattgatatgtttggatttaggcctaccatgtcgacatatattttctgtttatctcacttgtttttaattgctctttgggttaattgaatgtattaaaaataattttaatttgttcatgcctctttgcatgttttgaattttttggtggttgcactagggaatgtaatgtatattcttaacttttcacaatctacatgtagttaatatttgtatcactttatgtaaattataagaatcttgcaactatattgtttatatcttaatttcttcatgctatacttgttatatgtattatatctatatatgctataagccccatagtgtattttttctttttttgctttaaacagccacatgtgttttatgacagtaggagaagaaaatggtatcttttataatcatactttggaagatctttgtttcttcctgaaatcagagttcccatttgtatcattttcctttggtgtgaagaatttcatttaactttatttcatagggaagatttgctggtggtgaattttcttatattttatttttcttaacatgtcttcattttgccttacttaatggtggatttttcactgggtgtagaattctgagtggacagtgtgtttttctctcagcacattaaaggtgctgttctcttccttctggcctcttgtttttgataaggtgttctttagcatttgtgttattccctgcggaacgtgtcctttatttctggctcccttcagaattctccctttatctttggggttattcactttgaccatgatgtgcctaggtattatttgttttgttttgttcattttgtttgaacttcttttttttttgagacaaggtctggctctatcacccagactagagttcagtggcacaatctcggctcacagcaacctccacctcccaggctcaaacgatcctctcccctcagcctcctgaatagctgggactacaggcgtgcaccaccatgcctaactaaattttgtattttctgtagagacagagtttcgccatgttggtcaggctggtctaaaactcctgggcacaagtgatcctcccgccttggcctctcaaagtgctggggattatagacatgagccattgcacccggcccgagcttcttgattctgaaaatctatgcctttcaacaaatttgggaaaattttggccattatttcttcaaattgttattctgccatattctcattgtcttcttctgggacttcaattatatggatatttgacctcatgtttttgtttttttaaaaaaataaatcaccaaggcttgttcatgtttttcaaactctttttttttccagatagatcagtatttatcggtgccagcactattgacattttgggccagtcattatttgttgcatgtgggaactcacttgagcacatttactttagatcctttaaaatcttttttttcttttcttttttttttttttttttttttttgagatggagtctcactctgtcgccaggctggagtagtgcagtgacatgatcttggctcactgcaacctccgcctcctgggttcaagcgattcttttgcctcagcctccccagtaactgagactacagacctgcgccaccacgcccagctaatttttgtatttttagtagagacgaggcttcaccattttggccaggattgtctcaatctcttgacctcgtgatccgcctgccttggcctcccaaagtgctgggattacaggcgtgagccaccgcacctggcctaaaatctttgtcttccaatttcaacatcgttttaaaatacaaatcattattattcaagtatggtgtgactaacagatcgggagatgattgcttttgaaaagaaagcttgttacaattccaagaggaaggggtactgcctgctacgggggcacatgggagagcaccaggagtggtcagaggtggagggagcaaggagaagtatggatcagagcctttgctgtggtttctgtgagaagggcaaggccaggccaggcaacttagacaggcataagactggctagttcaaacaattttggtgggctctgagcgaaggggctgtctcttgctgcctggtacctggccctggggcaagtagggcaggggaacagtggtatgagtgagagctcaccaagggaggcgggtgtggcgtgggcttcagaatggttggtttgcacatgaaaggggcattccttggcaaggcatttgctatctgcaggaattgtctaaccctgggaagtgcggtcctttctagagttagcaaagccccaagacgtcaaaacatcagaataaacagacatcttcatacaaaaatttgtgtcatctcagagtccattgattgattgccttttctcttgagtatgagttgcatttttctgctcatatatcttgtaatttgggactggattctggaccttgtgaatgatacgttgcagagacttgggattctgttacgctattcagaataatattgagtttttgttttagcagatacttcgctgagttcaaactataaactctgtcttgtctctgctgcagcagaaatctctgtccaggtgtttaggccttaggtgggctgcttacagtctattccatgcaaacataattcagagatcagctggagattgaggcagtttatgcacagactttggtgttctccctctgtggctctttccttttagggagttcccctttcattttctagctgctgtggttaacccaagctctcctctgattctacaaaaagtaagacttcagttttctatctgagtattagctgctctgtgacactgactggggcctgcctcaggcaaaaagctatttaaaaaaaaaagaaagaaagaaagaaagaaagaaaaaaagtcacaaaccctcagaaacttacccagtcttattcccttctttctactgtccaaatcccacccatttctgcctgcctttggtctctctctattgtcctctgattaaaaaatatatatattttaaatgttggaaggttggtccaacaagagctacttctccatgattgaaagtggaattctatgtctcatgaattttgacacatagtgattttcctgtgttctaagtgttcaaaaatttcccttacgattttttcctttaacaagtatcactgggatgtcttttcgcttccagatgtgtcggtttgcaagcgaaccttttgttggtaattgtaagcattcttatgttacagtcttacgtgtggttcctaggacgatgattctttggcattcaccgaagcttcccttgtggctcagtgcatgtttaatttttttgtgaatgttctacacgtactcaaaaaggatgtgcattctctgttggacgaattttccgtgtatttattagttaaaccctaataaattccttcatctttgttttttgctttgtgtgtgtgtgtgtgcgagccatcagtttgtgaggggatgcgttaaagtctccaaccaaacctactgatttatctatttctttttgcagccctgtcagatgttactctgcattttttgaggccaaattccgaggtgcatatcttttcaggatcatgacatcttcttgtgttagttcctttcggaagcatgtcgcgtctctccctatcttacctgtcctttggctcttcgggcagcctctcaatttcaggtttttacacatctctctaattctgggaaattcttggttattagttcttcatacagattcctccattcatgtttctgtcctcctgggtctcctgtgacatggatgttgacaggtcgtcttctgttttccatatttcctttcttttctttctttttttttttttttttgagacagagtttcgcttttgttgcccaggctggagtgcagtggctcgatcttggctcactgcaacctccacctcccgggttcaagcgattctcctgccttagcctctggagtagctgggattacaggcgtgcaccaccacgcctggctagttttttgtatttttagtagggacggggtttcaccatggccaggctggtcttgaactcctgacctcaggtgatccgccctccttggcctcccagtgtgctgggattaaaggtgtgagccaccgtgcccagcctcctttcatttattacaaattttttttccatctctttatcttttttttgatgcattctggtaagctccctgttgtgatcttaacctcactaaattattctttggctgtgtactgagtgcctttttttgttttgttttgagatggagtctcgctctgtcacccaggctggagcgcagtggcacggtcttggttcactgcaacctctgccttctgggttcaagtgattctcctacctcagcctcccgagtagctgggactacaggtgcgtgccgccacatccagctaatttttttttgtatttttagtagagacagagtttcaacatgttggccaggctggtctgacctcaggtgatccgcccatctctgagcgctttcttctaggaataagatagaataagtctgcacctccagcaggcttcttcccctcatctgagtccagagggagccctggagctctgcgtgctctccgcacatgccatgccactccctctgcgtcacatgtccctctgccaccaagatctgcttttatccctgtgctcctcagtcaccagagggagcccagactcccaagcctgtccccagggagacctgccctcaaggtttctttgagaatccactccccatgcactttgccttctccatagcaccgtctggtgcaccttgcgtttcgtctctcttgccaaacgtaagagccacggaggcagcactttttgtctcttttgtcctgtaacatatccctggcatcttgctgtggcgtctgacatgcggtggatgctcaataaatatttgcaaaattaatcaataattatactgtagttttattttacctatcatgtttcttttcataaagctaccttttattggacatctatgttcaaaagcagtgttaggatctttacatttatgacattatttaaatattcatttattcatttctttctaccttttttgtattgtaaaatacacataacataaaatttaccattttaaactttttttagtgcacagttcaatggcattaagtacattctcacttttgtgcagccatcatagtctccagaagtttttcattttcccaaactgaaactctgtgcccacaaaacaaagcaattatgtttctatagccagcgtttccagtggcttcttcctatgactgcctcttcccactctgtgttcccagtgtcttccctgatctctttgaggatatctgcttattttgaattcttgttctggtttgcctcttaattctgcttcctgatataaacatagggtttgtctttgtgttacgttgttcttgcactgagataaagaaatgcctgagactgggtaatttataaagaaaaggggttgaattggctcatggtttggcaggctgtacaagcatggtgctcatcacttggcttctggagaggcctcggggagcatttatttatttatttatgagacagagtctcactctgttgcccaggctggagtgcggtggtgccatcttggctcactgcaacctctgcctgtcaggctcgggtgatcctcctatctcagtctcccaagtagttgggaatacaggtgcatgccagcatgcctggctaatttttgtgtttttgtagagacggggctttcccatgttgcctaggctggtctcgaactactgggctcgagtgatctgcctaccccagcctcccaaagtgctaggattataccgtacccggccgggtcttttttcttagagcggttgtactccttggatgtttggttatttttccctgtgagccatagctgccttggagggtcatacaggtctaggccaggggcagggcctgcaccctcacttgtgctctttctggtgagttctagagaattgggggtggggagtgaggagaatacgttggtgataaaatctggtcttgatcattccctgatttcagtctgctttttcctccctgtagtgccctggccaacctgaccctgacaggttcttttctgagagctgccagcctctattgcaagtcccccaaccaaggggtggagaaagagaatcgagtgttcaggggccaccctgctgccaggttccactgtgatagactgtctgcgttgtctgggccctggtaccagctggtgctgggtgaggggctggtgcttctgctcttctgtggtcctcgctctagggacaggatgggagatgtgtgtccagggcaagatggagtggggagctgggccaccgaaagctggcttccttgcagcctgctcaccctggagctggcgcctctttcacttcccggtcctgcagccccctgcgtggggaggacccactcatgcttgtcttccccaggaacttctcaccatttctacccaagactttcctcttgtttgggggcatctctaaaatatggggaaccagcccctgcgtcagccactgtcttgctagctacctttgtcttttgaaggccacagggcaggggagtaggtttaaaatggctctgcttaggatgggaagttgaagaggcaggacaggagcgaggtggggagcatgtcttatggagcggggcctggaaaacaagcagtggaacagtctggctgtctccccacagcctgtggagcaggtcagcttatggggctcctatcctgagagggagcaggtgccttggcccgtggaagtccaaggttctgcatgatgtggcctctcttggctctgactttgggtgcttctgacttgtttaccacatatgtttcctttcaggttcattcttccacattcccacccttacctgttgacctcccccaattcctgctcatctttttgtctaatgagcttctggtgacttctaatgggcaccttatgttttaaagtggtcagatttgtttcagagagagagactttgtgggaagccacagacatgtttttatagaatcccagtgtctttgagcagaaaggggctttagaggtgacaggtcccattgctctcagattatcttatatttgactcactaattactcatttaagaaacccagttcccacaccgataggaaaaaccctaccctttctttcagttgtcacttacatatttataattgtcgttatatttttaatttctttagttttaaggccatgagtatcggagtaatggtgatgggagaaaatttgctggggagttcttaatcatcgtgaaaatcccatgttttcaaagcacttctcaccacttcaaaaccaccaactctctaaactccattttcagagcacttctcaccatttcataatcaccaactctataaactccaggaggataggagtttgtctttgtgttcactgctgtctctccaggtcccaggacaatgctctctacgtatttgtcaagtgaacaaatgacaccgttagtaaccctacctctgaatcccatctcttagctccaccctgcacttgaatattttcagagctgaggagctcaccactttgcacgctgacctgctatttctgcaatagtataaatggtcagcaagttcttgtttctgctgagtgtaaattattcaccttgaatatacattatcagtcctgcttctgtcccctggaaccacagagaattccatgaattcatctcatccatgagggcgtttctgatattgacgacagccagtgtggtctccctaggatgtctccaacaagcacatgtcccggatttcacgtcttcttcaaaggatgctggtcttcaccacctttgtcatccttttgggagtgagcccttgtttacagcactgattttatatgtggtaatgacaactaaacactgcatcaccaacgtggcttctgatcagagcagagaggaacggctgtgccaccttccttcttcttgacattatccttgattaatgcaaccaagctaatgccttctgcgtttgcacttaattacaaccctttttctttctttcttcttcttcttcttctttttttttttttttttgagacggattctccctctgtcgcccaggctggagtgcaatggcgctatctcagctcactgcaacctccgcctcccaggttcaagcaattctcctgcctcagcatcctgagtagctgagattacaggcgcctaccaccacgcctggataaatttttgtatttttagtagagatggggtttcaccatgttggtcaggctggtctcgaactccagaccttgtgatccacctgcctcagcctctcaagtgctgagattacaagtgttagccaccgcacccggactaaaacccttttccaaatagattctcccctgttctgtaccccaatcaggagtaaaaaccccatgttttgaaccgaggtgcagtgtcctatacttgcccccagcactgtgggatacgggagtcaggagacccacctgcattacagactggtgatggtgatcacataaaacagcgcagtgggaaagtgctttgaaagccatgaagaagtctaaggctgcctattattgctgtgtagctggtttattctatcataaacccattgaggtctgtttaaattgtgtgttggcccaccagaatatcagcatccttctcagtgttgttattcacggggtctaataagaatactttctatgacttcatttaagccattgatagaaatgaccgacaagacagggctgagggcaaaggccgtggcacatacttgtggggtgacttggatctatcatatcgctccatcctttgctagttcagttactcaaccgacagtgcatctccttgattgtactaccatctagcccatgtgccttcatcaaatttacagggataacatgatggcctttgctggctgccttgctgaaatccagaggcactgccgtctatggaaatgcaggttctatcaaaagagggaacgtgccggtttgccatgactcactcttgacgatgctgaacaggctcctggaggccacagcttctccctaagcgctccccaaacctgtaatggccagcatttcagcacagaggacagcgcaaagaagccatgaggactccttgaaggaacatggtaaagagcatggtaaattgctgtgctcggactcagggtttctgaaccttggcactattcacattctggtctgggcaattctttattttaagacttgtcctgtgcattgcagggtgtttagctgcatgcctggcctgtgcgcaccagatgccaggagcaccccttgctcagttgtgacaacaagaaatgtttctaggcattgccaatctgggggcaaaattgcccctggttgcaaaccactggtctaactaaaggagaaggggccagaaatatttagaacagtgatacctgccccaccaccactaccgcagtttctgggtgtgccttcagaataacatagatttgttatatctgaattgcattttgcagaggttagtatggaaatggatttgtatgctttgattctgctctgtcaatgtagagtaatgtggcccagaatcatgtttggtggcagcaggggtgccaggcagggaatgatccctgtagcatagatggctatgttagtagatggtccacgtgagaacacgtggaattcgacacgtcggcttagggaggtgctgatggaatcccagcacttaccagtacatgcctagagcgagggagctcctggactttattattatggtctggagcagcaaaactaaaaaagataatctctcctgggtgtctggttttaaggaatcactcatgcaggtaggttggtgatcatgggaggccacagaggtactttgttcagaagttattgtttccattagaaagagtaatgattttcatataccagcaagaaaaaacccatgttatcataggccagggatgagaataacaggaaatctccaagtttacggaagtatctggtttatgccctaggaggtaataggagttgtgagaggtgggtcaaggcctgccaacacatgtcagacaagagattattcatcattgttatttttgttttgaaaattaactccccgaaagggtcaggttgtgctgtgcctctcgaaggtgtaattccactttaaactgtaagctgttctgagatgatttcagcacaagaacgcgtttggttatggaacatgatttccccagctttccttgaaataaaaaattgcccaacatgcttaggaaatgggaattatggtggacacaatattattttctaggtggatcaccttataaacgaaagttccgtcatccagttaatggtgaaaaattgtctatttgaagagagaataattgccaaggagcagggaggccagtgttattgttttttcttttcttttttttccctcaaaaacagggctttgatatccattgcatttcaattgcatttagacttttgcatgaggcagctaggatcccagccaaagaacctgggtctggaacctgaaagtgggttatgaagaggaggcagctgctctgggttggcttctggaaggttgagctggggcttggccaatcagctgggcagagctcaggtagtcccattttattgctagaatgttctcataatcccacggagccttcagaactatgtgttctgcttgctttttttctttctaatttcaagtctgtttgttgtgaaataaagcatatatacaaaaaagtctactaaatggaaatatgccgatccatgaatgaaagtatgaaaaccacttaattcaagattatatcatgccagcacctcagaagatccccttcatccttatcccccatcctcctcaaagacaaccactatcctgatttccaacattatactttttcaattttttcaatgtttcctatttttaaattgtatttatttatttattgatttggagatggagtctctttctgtcacccaggctagagtgcaatggcacgatctcagctcactgtaacttctgcctcccaggttcaaacaattctcatgcctcagcctcctgaatagctgggattacaggcacatgccatcacacccggctaatttttttttgtgtttttagtagagacggggtttcactatgttggccaggctggtctcaaactcctgacctcaagtgatctgcctgccttggccttccaaagtgctgggattacaggtatgaaccaccatgtccggcctcaaagttttttagtttgaaaaagttgtaaacctacagagaagctgcaagatgattacaatgccacctgtctacccttcacctaggtggaccaactgtgactatttgccacatctacttgatctcacctgggaaattcttagccacccaccttggaagctggcttttgggccatcaagtgacactctggccggttttccagacaggcactccatttgctaaaatccagctggttctgagtggccatgcaaagactcctggtaaaatgaggagggctacatccctttggaacctcccaggagtccaggttcagttctttgggaaaaatagtttatcaatccatctgtgaattcatgtattaatttctccccctgcctttccctcccttccttctgccttctttttcttcttgcttttccctttcaagaaatactttctgatcactgtgggcctctgtggcaggtgctgaggatgtgctcgtgggtgagatgggcctgtctttgccttcaccatctatcttctgggtatgggggaaagcttgattaatatctaggcaatgacaaaaagtggtacacaaggaagtatgggatacaaagggaatacataggtatttcctacgtacgtaggtattccctccagtctaggatggcttgggaaggcttcctcgagggagggaccccagtccagaaggacacaaagaagagaaaaggggaaaagttgtttctggctagagctactttgagtcctgtgtacttgagtaccaaatggatgcggcactgaaacacatacagccatttgcagaatccaagtggctcaacagggtctggaggggtggcccctcagtggagggattgctgccccagatctggctgtacggagttggtgtgggatagaccagggcagggtctgttggcggattttggtgttggaagaacagagaggacagggaaggtagcattgggtgtggagcatttggaaggatggagaagcagggtggggtctgtgccagtcacagtgtctctgggtttagctagatgtggaggaaaatgggaagggcttcgtagacctgcccatagtatttgggtttggaaattttccagatttaattctagtctttccctgggcaatgggatatcttcagattctcccaactctatccttaaaatcctggatggtaagatctggtaggcagagagatttttaagaatagagtttacttttccccattaaaaactaatatatgcttattacggaaaatttataaagtacataaaagcagaaagaagaaaataagaggtggtattttactggattgtggattagtcctagaaattctatggaatggtgggtggccagatttattccattcattgtttatttgatgggaaaaaaacccaagcagcccaaccctgtactgttttcagaatcaccccaaggcctgggttcagaatattagcttgttaattatcaggaaaatgatagagctgagaagaaattcacccatctctaaggccagctggagaacccagttgaggtgggctgagatggaaatgaccttctccaaagcactgagccccatgaatcatccctggggcacctattagctgtgagctccattcatccttcccggaggactgtccccacctgaccggtcacagctcaccccaacccagagcctctgagggctggagcctctctccatctgagccctaagcttccttttccccttgttcccacactaacattctatgatttcccccttaacctcttcatgacatcaaccagtggagaccttgtatgatttctagagttctttttttcccggttggaggacttacttatttactctggttgacattctgctttctttcaggaaggatttgtgagagcctagcacaaaattcactttcttaacaagaatgtcagatggtagtaaaaaaaaaaaaaaaaaataagaatttttggatacggtattaataatgttacggaatgggctttcagtttggccacaggtgtcctggtagtcagggccaaggggatggatgatggctcgtggttgtttggtgggcaccatgctacctctgagaagagaggtgctctgctgctggctgcggcaaggaactgatcacataggatctcacgtggggagcatcgaccaggagaggggtccacattgtcacagcagcttggagcgtggaagcacacatataatcatcacttaactaaagctgaggccagatagaggagacttggaagtgagggacccgaaaatgggaacccttgctaaggacacaggcagctgtacgccagagcctgtgggccaccccgaggaagtgacccctatgagccagccttgtggggcaacagaatgtcacacccaggtccttccctcgcctcgagaaccccaagcgaattcccacttcccacaggaagtagttcagacccttgggatacctggcgtggtcctcctgaccggggctcagtttacctcctgcttcagcccttactcgcctcctccaatcccaaactcctcccatcctcaggtgacctggtgcttgacccagactgccgaggggtggccgggccctgtcagtgctgcggaggtgagctccttctgaaaggaccccctgtggggctcccggggcgtcgcttctgcctcttccagtgctttccgaccctgtgcttttctaccgacttctgggccgggtcatccactcctccagaagagaggccagggagcattccatcagccccacctctccagaggcccggcacacagtaggcactcaatggttgtaaactgtatccacctacaaagcccctagagcttgtgagacccgggaaacagcgttccatacaattgagtgacagagccctgcgtggaaagggaggcccgtgttggtgccctgtcctcatccagtgggaggggaggagagacctggaaggaagatgggagtcccaccccagcctgcgtgtttctctgggaaacaggtttcaagtgcagggaggtggtggagggctgacttcatggccagcactgtcctgggcaccgtgggtcgtggaagggaggtggagctcggttttccgtctgggcctcaggtggactcagaggaggttcttagagaaccatacagggcatatcaggtaagcacgggtacacaatgcagagaaacagtgcttgctgcaattagagaaagcagagaaataggagctggagtggtcactaaaggcacgaacggccttgacggtggagtggggagaggcagacacattgccggcacaaagagcatgctggatgacaggtttcgtggcttgtttgttgctttaattgatgtggacaggggattccaggtaggagaatccaggcaggctaggaaggagcttggctctgtgtggggcatgagaagacgtgctggtcttagcggaaggtccccagaggaggggaggctcaggggccggcaaggtggctgagcctcgagcaccctccacagagcaccgtgccaggggcctggggcgcatgttgtaacctggctgtctacactagatgaatagaactttcacaggttagtggcttcatcttgattgtttaaatttcataaggcgttgggaccccttacgagtagctctgaaagggaatggattgctaataaatgcaaactgtaaaatattcatttgagatgattattttatattattgcataagtgcaaaatgaatgaactttctgcttacttatggtggaatccacaaccatctgagctatttagtgaatgaaatatttaacctaatttctatgccttaagtgacctaaggataaatgttatggtttaatgttttagtgttagagaaggaactaagggaaataaacagacttcgaggcctcctgctggcttccaatggggaaggagcatctcctgggccaggagtccttgggagcctccagcatcttcccgcccctcacggagggtcagcggccatgcccagccatgctgccaggacctggggagagcagtaccctcagccctcactctcaggagctcagggctggggaggggacagcaggggccttggccatgtcccttccctttctgggccccgtttactcctcagaacaaggcaggctcggaccaggaactcctggggctgtcagctccaatgtggcagagttgtgagtgctggaggctgctgggaggtttctggggggctaggactaggatggctgccaggacttgagggtggaggcagggacagagattccccagaggcggcatcgtgggtgggaaggcaggaaacccgggtctgtgtcctcctggggcagtgtggttccaggacccaggtccagctcagtggccaaggaaagcccttgcctgcctgggcctctctgtgctgcagtgtccctgtccggccccctcttcacttttgcatctgatgcatctgcactgccagggctgccaggcctgttttgctgccaggtgccctgtgttgccgtagcccttgaagaaggaccaccgcagcctcagaaaggggcaagcatcacactgcggcatcacggacacctgcagctccaggaagctcgggggcgagtgtgagccctgctgcttctgtcccccagagccccggtccgggctgcactcccaaccttgcctcccagcttgacgtgcactgctgatgagttggtccgtgcagagcctctaaggcagcttggacatggggagctgtgggtttggtcctgctttgtgcccagggctctgggttcaggtagccagtgctgagccctctgtcactgcagcatggggctgctttccctgcggtcctcgtgcttgggctctagcttggtccaaaaggctttcctcagggagctccccatttgagctctgggccttggcagggattggagcaccatcccttggaggtgttggcgctgtccaggtgccggccagtgtggaaggagctggctgctgaggatttaccagccccttttggttaccaggctcaggcacttgccaggggttggttggtttgtttcttctggatttggatttgtccccaggacagacgtccttgggtcttaccaggaaccatggcctgcaggacactgctgcgaggagggcttcctggagcttggggaagcttcagtccagagaagacagaggacttgactgagctcatggtcagggagtgtcagaacgaggaccaggaccccagggccggctcctgggccgccccctcactcggcgtccagtgctcaggcctctgggctctctctggcccttgcttggttgagctcagctgtgctcagtgactttgggccacgggctgtggcgtcacatcctccagagccttctctggtcactcccaggtcatgtcagtcctgaggatgccaggagacgctttctgaacacagtctgcgtccttccttattttttgttatcttggctgtttgacaaatagactttggaggtggaaagacctgagttcaaatctcggacccactactgaccagctgggtgacgtttcattatccataacatagagaagatactgagagtccatgagacaccacacagaaggctcatagcatggggcctggcaccgaataggtgctgtttacgtgatagcttgtatggttggctctccacacccaccctcactgccacccccagccccagccttcctttgtgcccgtttctgagtagtaagatttcttactaacagtttcttgtactcagcttccccatcaccttccttccatttcagcagaaccctctggagtggagcaagcgatgggaaatgctcttatcaggcacctgggacctaagcaggtgccctaaccagcagcagctgagcactgagccctgggaacacctgtgcccaggtgcaggtgctggtgagggtggctgccgctgtccagccctgatctctggggcaaatgaatgttccaaccccaaacatccccacagcggtcccgacagacgcctactggtttggcaagcactgtcgtgcgtgggagctctgcttactggcttctgtcttggcatggtctctgcagaaggaagccactgcagacttggtggctggtcttcgcattgggttgaagggtgattcagtgttccagtttggattgtaactgctttattttttaattgtttttttgagacagagtctcgctcttttcgccgagactggagggcaatgctgtgatctcggctcactgcaacctctgcctcttgggttcaaatgatgctgggattacatgcatgagctactgtgccctgcctggattgtaactactttaaaaaacccttccaatgctcctcagtgcccctagaataagcttctagaccctcagccctgccggcatgcccattcccatctttctagcgccctctgagacccttcgccctcctatccactctgaagatgcggaggacctaccttgaccttccccccatgccatgaacatggcgggggggccctctcctcattccagacccagctctggcatcactcttctagaggtggtcccagagcatccgtgtcaaaaatccccgtcccagttcccagcttcatccctgtctacttccttcatgacgtttatcacagtttctagctattttattatttgttcctttcctttttggtccacgtcccccactacagtgtaacctctacaaggcgagaaactctgcccacctgtcactggtgtgtccgcagtgccagctcagaggctggcaggcagagccgctcattaatatatgctggctgtgaccttgccattcccagtagttccgatacctccaaattccgagattacaaacatcccactcttcaaataccacatccaacatgtctctccgccccactcctccaatttcccctgatgcccctgagactacaagcccccagtgctcagggggccccttcccaatcctcagactttctggccctgtctcagttcatcatgctcactgggggaaaccacaatgctggggaaacccagcccttgccttgccccttgtccatacctgtgcagccggagagacacctgcgggtgtgctgatgtcacggttcaagtttttaacctcatgtgggcccatgatactgcccggtcaggtgctggtggtccccgtccacgcttcccattctccaaggtgactcttaagtaccttcaccctctctcaagcccccaacactcctcccgccctctctcttagctgttgaccttgccaggtagagataattgaaggagaacttcctccagctcctcctgccagatctgccactttctttctggtccctgtgaggccctggctctgtccactgctgctcttggtcctgcctcctgggtttctggcaccggtctttctctcctccctggatcttcccgtcagcatacaaacatgccacgatttctcccatcttaaagaccctctctagacctctccctcctccaagccaggccccctcctctctttctcatttgcaggcagactcttggagagccgtccacagggctgagtgctgtgggcgcttctcagtcctcgcccttgcctgtcggcagcctgtgacgtggctgattgcccctctctgtgacgcacttccttcccttcgtgccacctcacactggcttcctttcctctcaccactggggctgccctttctcttcctcagtttccccccactctgaattctgtcttgctcctgggctctgtccttggattccctgtctgccacttgtgtgcagactcacatctctaaatgtagcttcccgccatgtgcctgcgggctggacttcccgtctgagctcccaactcaccgtccagctgcttctcgggaacctccacttgtctcgggtatagaacctgagtgtctgtaatctctccccacatctgatctggctgctgcttcccagtaatgccaacttcatcctgctagtgtcttgggccaaaagccttgggatcatccctgagtcccctctctcgtctccacacgtccagaccttcaacaaaccctgtggccgtgacttcaaaacacactcgtccctcattgccttgtgccgcacctcctccgtgccagcacttctcgctggggaagttgcagacccttctaccattctccaggccctgcctttgcccttcttctttttttttttttttttttttttgagatagagtctcgccagcctgttgctcaggctggagtgcagtggcacggtgttatctcactgcaacctctgcctcccaggttcgagattctcatgccttagcctcctgagtagggattacagaagtgtaccaccatgcccggctaatttttgtatttttagtacagatggggtttcgccatgttgaccaggctggtcttgaactcctggtctcaagtgatccacccacttcagtctctcaaagtgctgggattacaggcgtgagccaccacacctggcccctttgtccttcttgagtcttttctcaacccggaagccagagccattctgctaagatcaggcctggccgtcctcagtgcttaggtaagcagagtgtggctcagctgtgcactgttcctggctgcaggtggcagaggtggagtcagggatggagccaggagttgaactttggagtgctggactcaccgcccccctggtgtggacaagcccctctgtgatctgctggttctacattgtgttcttggtgaggagggcaaggatacttttgcaattctcaacttctgggagctggcggaacttcccttcctgtcttgcctccactcctcaaggcctcaaactatcccataatgctcggcttccttgtgactcctcttcttcaaccccaacgacaagcagccagctgagagcctcctccaaagtcagagacaaggagcttggcagtggacctgctgccagaggcaaggccgtgatcttggaacatggaagcccagcacatttgcttgtcctaaaaatacagttcttaaaatagaccagtccatgtgggagatagggaacctgtcgagtgcggttctgaagggcttgctctgccaaggggaccggctggctggggcagcgcctgggcagggctgtgtgcctcagagggtgccctcagccgtggcagaagccacagcctgggtttggggtaccctgtctggctcttgttcttcaaaccccatccagaggcaggccggtctcttacctgctcgatgtctgcacatagggaaacctgagttgaagccgagccttgggttaggccctgcaaaagctgcaaacaacagtttgtgtttggggtgtgaggctataaacagcccaggagtcctgagggggttggagagttggtcaaccgtgaacaagctggagactggctccttcttcctggggatcccagcgcccactacaaaggtgaactcctttttgctccctgccccagcctgccccattagacagggcatggtgaggcgaatggctgcagggactgaggcctttctgtaactaaagcccagcccaagtatagggagcaatggccgagcttctgttttaaggcagcaaaacagcgtgcgagcttggtcccttaacacggagtctggaattgtttctcataacccaacgcttggcttggtttcaaaaaggaagcctctcctctcgggtatcatgaccaggctcctcgtaagaggtgggactcagccgagggggccagtctagaggttacacattctgagctacctttcggggtctgtggaccctctcagaccctgcagcatgtcgggggccgggtgggggagcgggtggtggcatcagtgggtttctgatgaatgcctggagttgtttgtataattggggctctgtgtgtctttttttggaggaagagcttctttcacattccctgactcaaaaaccacaagctaaatgatctgtacattgtcctccaactctgagagcctctgatcctattattccaagtcaagaaattttgaaaattacaggatagaattctttctcagaacagatgctagggatttgtaagtttccattccctgtgctgccctggtttgctggatggacggatgtcttggaattttcaagacctccagtcctcaaagaggttcttctcacctgctgtcctggtgagctgcatgggcctccctccatggtgactgtgttgttggaccgagtgggatcagttgagtgggaggcgctaatgaccggatttcctacgttgtcccctgctcccctgactctattcctcactgagccagacagactcaccgcttccagtgtctgtggcatgttcccactgtccaccctcacggttcacattttctggaatgttctgctcttccccctgtccaggtcctgtgtgtcttcagggtctggtcagatgtcttccggtgaggctgcagctaaacttagcctgcccagcctgcctctcctctgaatgcacatagtgttgacatttttttcagtttaaaaaattttattttaaaaatgatcttacagttaaattgacgtttttggggctgtgccgttccatgacttttaacccatgttagcactgccacaagtaagggacagggcagctccaccacatcctgcagtgtattcgtctgttttcgcattgctataaagaactacctgagactgggcaatttatatagaaaaaaggtttaattggctcacatttctgcaggctgtacaggaagcgtggctggggaggcctcaggaaacttaggatcgtggcggaaggcaaaggggaagcaggcatgtcctgcatggctgaggaggcctcaggaaacttacaatcatggcagaaggcgaaggggaagcaggcatgtcctgcatggctggagcaggaggaagagggtgaagggacaggtgctgcacaccttcaaacagccggatctcctgagaactcactatcatgagaacagcaagagggaatcctcccctatgattcagtcacctcccccaggctcttcctccaacattggggattacagtttgacatgagatttgggtgggacacagagccaaaccatgtcatgcagccacaccctgccccatcctaaccccccgaaatcactcatctctgctctgccaccatgggttggtctttttgagaatgtcagatgcaggctggcttctttccctcagcctgacacccgtgagagccgtctgagttggtgtatgtgtcaacagttggttcctttcagtggctgggtacgcgtcctgtcttatccacatgttctcttggtgaattttgcctcattgtgtgcatgtcctatgtcactagatgcagggaggcaagggcagcatgtggttcatttttataacctttcaaatgctctgcaaacagtaggtgctcagctgtcgaatgggtgaatgaatggaccacaatgggtaacaggaaggggaaattaattttacagaattttgtatttcctatatcctaaaaaatctccagtaaacataacccttaatttcctgaattaaaaatgattcatgctgggcgtggtggctcatgcctgtaatcccagcacttggggaagccaaggcaggtagatcacttgaggtcagggattcaagaccagcctggctaacatggggaaaccccatctctaccaacaatacaaaaaattagccttgcgtggtggcagacacctgtaatcccagctacatgggaggctgagacaggagaatcacttgaacccaggaggttggaggttgcagtgagctgagattgcaccactgcactccagcctgagtgacagagcgagcctgtctcaaaagaagaaaaaaaaaaggaaaagaaaaaaaagattcattgcctctctgtattctgttagtagccgagacaggagaaaaagcaatcaaggtaacctaataacagggatttccttctccagactccctccctgcctactcacctttctgtctctttttctggtaagtatttccctggccatgtcctgggacctgtacacaggtgcccacttcttacaccccaccactgggagtcttcgacagctctcacacagaagaggaatactgtggtcctggaagttgctaggtaggccccgagtcccagttgtttcatttctcaggacctcctggtgctacagaagaatgaaacaggccccagactggaagttgccacacatgccttgtgatgctggctctgatgggccttgctgtgtgatcttgcttaagttgcttcccctttctggtctttattttcattaccttattttgtacccattgattaaaagatgaatctgaaagagatggtttctgtagtctcttcaagctctgaaacaatatgattttgtgaactcacatactcatacagacataaacacaaggaggatttgctaatgaacttcttcgttctttgctaaatataaatgccttgcttgtgaccacagaggttcaggtgctccgtcagcgagtatttaagtacctactatgtgtaggtttcaaacttgaggctttaagtgtttgtaggaaatggaaacactgtctgatgtctttctagtctttaaatgaggagtggagaggtaaggaagaggtgcgtgttatcatggccctgtctcatttgtatgcatcagtcctctttttcttctgcttcctttcctgggatcgccacattcttgttggtgtcttacagacaaacctgttcaggactgaatgaccaagtgccccagaaacatgggttggtgtgggtggtgcccaagcctgacccctgcctgttttctcatacacggttcacgttgcccccagcagaagtggagagtaaggggctcactggctatttctccaaaatgcgttggttggtgtggaattgggtacaacctggtactttctgtgagtgttgagggcctgctcctccaggccatgggccatgccttccaaggttttttgtttttttttttctgagacatggtttcactgtcacccaggctgtagcacagtggtgcgatcttggctcgctgcagccttgacctccaagggctcaagccatcctcccgcctcagcctcctgggtacctgggaccacaggtgtgcggcaccacgcctggctaatgccagggctttttaacagatggtctcaggagtctcctttgtggaggttcaggtcactctggggatggatggagcgggggcttaggactcctctctcgactcctgggtcagaaagtgactccatcaaacaggcatttttatggtctcaaatgggtttaacaagaaagaagtcatggaggcagtgaatgaagacacagatagtgagggacacggacctactggtggctcgcagtgcttatgatgtaggggttgaatgtcttttgtctccagcaggcttgccttgaggagagacaccattttgccatcatctttacccccagaaagaacaggtggggagatttgtgtaggactctttttccccatatggagaactctatggccattttacaaacattccccatccttccaaatcctctctcccgcttctccttgccaagtttacactgccaattatactagactagcaacaaggagcttggagagaagggctgcttttagagatgccattccaagtgccaacaaggtgttctcgataaccggaatcagcaccgctctccttcctgtcatgtagccctggtaaccacagagcatgtttatgctcggggagtctatttcccgttgttggggtcggaaccattcctggagtcatttcttggttttaatgctcatcctttccctttccagccattaaagcttctggcctagaaaagcctgtctggctagcctgacctggtgctccgtttctgttatctctgatcagcagcggggagggcactgtggacagaaacatgttagagaaggcccgtctgcagaggggcccgaagagacccgaggacaccctcctggctgcagggtgcctgttccttccctggttctgtgcacctccatcctggcaagagggccttggtgggcggggtggatgcccgcatgcctttggtgctaccatgacaaggtggccctggcccgggagtggagcggtgcctgggttccgcgaaatgcctcagagccatgactttctgcttctcacagcttctttaactcagtctcttagtcttcccctgaactcgcggacactcgggttctctgaccagcatgttaagggttgggctgggcagcctctgcaaaggtcttctttactgtcaacttgaacagtttccataaggttgtgtcggggacacctagaaataggttcctttgaacaacagtatgctcgttgactaccaagaccttccaaaagagtgagagattgggttggggatgggatttcaggctgtgtgtgtaaattcagcatgatcctccatgtggagaggagacacactggtgagggcagctcctggtggtggggcaggggtcacaaagctctgaaatgaacagtgaagtcgtggaggggccctttagcagaacccaggattggggcaccagcgaccctttccttcccagggggaaagtggttcactgccagaaatgctttagaatcgttagaggacaggagatcagctacacagatgatgaaactgaaagccagggtctgtttgttctgctgctgagcaaacttggtaaaaatgttcatcgagatggaaaacaagaacacagacacactgtgagccttttgacctttgcctttgacccggaaatgtgactgtttcctggagaaagtgagttcacctgtgtccctgtgcctgtgcctgccacagccccgcccagctccccggcacctgctccgactccagctctcatggaagcagtgttttgcgatgaagtcttggaagccaacagctctcctttctcctctttcccatgtgtggtgtttgtgattccagaaataagttgggctccaccctcagagtggcaagcattgatggtttctcattcaggggctcactggggattgcctgaagccaatgctggcatggctgggctgcctgtttctccaggagggccgtgatggcacatttgtgtcaatattacctgcagaagaactttccatcttttataacaggcaattctgttcaggagtatgaattggagccaattagggctaaaagtagattccaaaatatatacagttatatggcatattacgatgttttggtcaacaactgattgcatataccacagtggtcccataagatgctaacgctatatttttactatatcttttctatgtttagatatgtttagatacacacatacttaccatgtgtaacagttgcctacagtattcagtatagcaacatgctgcacaggtttgtagcccaggagccataggctggatgagtctagcctgggagggtaggaggctatcccctctaggtttgtgtaagtatgcactttgtgtaagtacactatgatgttcacacaatgacaagatcgcctaatgacacatttctcagaatgtgtccttgtcattatgggacgcaggactgtataggcaacaaacagataaattgacaaatgatttctgaccaccccctactgtaggctgagggctcatgcccctctgagggctcctgtaggaggctctcctgcctctgattcagtgctgggggcagagggggctgcaaattgtgggcttagccttgagctgcgatatggggcaagatgatgacatggggaaggaccatgatcagagacagagctggagagggaccagggctgaccccaatgccacaggaagtggctggagttgttctaccctggagggaccggagctggggcttactctcaccagggtgttgtacagaggcaggtgatcccctgattgtccccactgggccaccaggcagccctcacctgtccttgggctagaagagcacttcttctccatcccaggcttaggcagtgcttgtgcatcctgcaggggtgtgggccaccccggcctcggtgcaccctgcttttgaccattcttcgtgctggaggcgaggagtgagtctggggacctgcccgggggctccatggctgacacagctggccatacaactgcaggtgtcagagatgttttgagaaactcccttcagggcaatcaagcccttgccaagtggaatcactctgcatttacatgggtggcttctgaacgtggccgtgatgaattgtgctccggcagggcctcggcagtgaaaaatggggcggtgcgatggagtaggaaggtgcggggtctctgctgggctggagcctgcacctgaaccgggagtctggagccactggaaacagtgggtgcctccaccagccccgggggaatgcacagatgtgccctcatcgctcagcttctctctttgtctgtctgctcccttcatgtgcatcgtctttttctgattttccctctgtctctccaggctgaaatgcagcatcaaacacacgctctcctgctttcttgctttgtctctcttacacttctcttcccttctttcttattcgatttttaaattataatcaaaaccactggacagtgagcacgggcaggagggacattggatgagggtggatgtgtcactgtcttgattgcggtgacagtttcccaggcatgcgcatgtgtcaaaacttagtgttgcacacctcaaatatgtgcagttccttgtgtgtcagctgtaccttaataaagctatatttaaaatcccccactcattttgagtaggaaagcaatgagaagatgtttttgaatatttaacttttagaaaagcctgtattctgcttccctgtaaagtagagggagacagagacccagcagggggcatttctttctggggtttgagcactggaagatcattattaacagtgcaacagccaccgccgttcagtgagtggtttattcggtaggacaagcctatgcaacagcccttgcatttgtcccagagactcagggagggtaagcaaagtgacctgcccaaggccacgcagctggtcaggggcaaagctctgcttcccagcaggtctcccgagcgtgactcccctccagtactagttgtgggatgggacagatgcacctgggagtggctggcagagagtgtgttggcaattgtttagcacttacccttgagatttagtttgagattgaagaaaagatggtctctgcttctctggctcacaggcagtcacccccttcctttcctccctcagccacttatgcattcccagcagggtacctttgatgctgggggaaggactctttatgatcccttccctccagactttggctggctggctgttgaggtgagtggaaaggccacaggatgactctgccgtgggtattgggtgggccagtggtaggggctagctgtgcaatcaagaggctatgaggagtgaggtttcctcttggattggccttctaattagtctaggatgacataaagaagcctctcttttaaaaaaaggcaaatttggtcagttcttggtttccagggttttggaatgtccaggcaaaattgccttggcaccttctgaaatcctagagaggtagtgtagcccacttgctggggctgacttctgttgccagcgcctcacctccatctgattgcagggtattggttggccatatgcttcagggatttgaaggagggttacctatgtctagggcttaacgtgttcttggagaatattgggcaagagtatgattccctgagtctgggggaaggaggagctccagtggaacttccagtcaagatgccaactatgcatatgtgggaatctctgttctctcactctaaacccatagaaatgttggattagttataatagcaacaaaaacatagctgaattcaaaggtgaggttgggagatttccaggtgccggaagccaggatgaaatttagagtgcaagtcgagtggccttactggagtttccacagtaaaccccttaagggctgaggtttcacaggccccagggagctggaaccaagtttcttgtacaaaactgggaacaagaagggactgtcttttctgtcatcaaaaaatagaaaaattcttcccattggctcaggaacacggtataccccagtcccccaagccgtagcttctaagagtttccttcaagaacgagggataccaagcctaagctgtatatagatatgagaccaaatcctgcactatcaatgtgggcagaaactccgagctgagaacctaacataaaatttggtcccgaattagtggtacccttaaagctgtgtcagatgtaagcgtaaaacttgttatgggggatgattcctcaacacaaggcacacatgagattcccaggggaaaaactgggggactcccaatgtagataagcccttaggcaaaaattacaaagcagactagcaaattgaccaccacgggagataatccacaaatgctgtgaaaggagaatttatgtttcagaaactatagacaacagagcaatctgagaaggctgttagatagatcagatatgtgtaaaatgtttgaagagacaagaaataaaatccataagacttgaataggagataatgggatgaaacaagtggttttttttaaaaaaagaatcagttattctagaaataaaacatgtaataattgcaatgaaaacaaaacaagatgccaaaacccttctaatagatggggataaacaaaagaatagacatatttgctaaagaatgagttagttaaggccaggtgtggtggctcacgcctgtaatcctagcactttgggaggctgaggtgggcagatcacttgaggtcaggagtttgagaccagcctgaccaacatggtgaaaccctgtctctactaaaaattcaaaaattagccgggcatggtggcaggcgcctgtaatcccagctactcaggaggctgaggcaggagaattgcttgaatctggcggggtggagcttgcagtgagccaagattgcgccacggcactgcagcctgggggacagagcgagactctgtctcaaaaaaaaaaaaaaaaagaaagaaagaaagaaagaaacaaatagttaagcataagatggtcctgatgagatccaccgaactgtggtttagggaagtaaaggcggaaaatgtgcacatgaaggtccagcacatatctaatgggcatctcagaggagaagacagagacaacaggagggaggcatgcttgaaagcaatacggctggaggaataaagacagacgtaagccttcctactgaaaatgaacatggaattgcaggtggaataaataaaagcaaaaatccatgtgtgggcacatcagggtgaaactactgaacaccagagataaagagataccttaaaaaaaccaccaggaaaacagcgacagtgagacctcattagtttgggtaaatataaaatggggaaaatgcaagataggggctggcctgctgtctgtattttagtatgtcttcctaaaggaataaatagggtaaataggatacttttggttcttcagtctgcaatcagtctgcactagcagtgtgatgctggcctttaagaacaaaagcatctgtgtgtatctgttccagtgtttttgaagttattgttcacccgatgtgtttctagggccgtgtctgctccatcgacacctttctgggatgaaccttcaaacatgggctgtgggcctgggatcccctcgacaggtgctgccaagaatgaaaatgtgatctttgcagggtgcttacctcctattaataaggaaaaaagcaaactaaattagtcttgggaagtaaagtgccatatgaatcagctttcctcactccgaaaataacttgctaagaatttatgatcccctaagttctgctgattttttatattgtttactttcctctccaaaatatcaaataattcacaggtggtatgtatggtggctgtatggataatttgaaatgagaaatggacagcaagagaaatttccttctagggggtcagtgctggggtgactccctaagactaatggtgctggattaataacctggggctgcttcagtattcatggcttgttccctctgaaggctgggatatttcccacttttatgtcctgcacaaaactgtaaagcaaagatggtttcattgcagctatgtgcgtaatgagatgcgcaagagctgctcttgcccattaatcagcgtttgggggaggcttctggaagcctgacctattgccgcggtagctgatctgaatgcaatgatttttcccctgtgggagccgaggctgcaggacctgagagctggctctggcagcctgggggccctggccatgaagttgtactgcagagaggaagggtggtcccatcatcagggcgcacaggcaaatggctggggtttctcagatgaaaaggctgcagggccttggaaggaaccataggatatatggtttgcaagagaccacctatttctggggtccatctcgccagcccctctggccttactggggtgggggaggtagaggagggtggatgtagctacattcaacagggatttgagtgcaactctgtgccaggcactgggccagatgccggggagagaaagctgaataattcagacattccctctcccattaaggtgctctcaagggtgtggggggaggcaaactgctgatttcaatgaactagactggcgaggtgggagagatgtgagcagcacacaggtgactactacttaccagctttggggatggagtgggggaagaggggcattgtggtttgagaaggcttccgggagaagtaatgtctgagctaaatctaaggagtaattaatatttggccaagagtctgggtaaaattgctcatgcctgtaatctcaacacttcgggaggctgaggtgagcagattgcttgagcctaggagttagagaccagcctgggcaacaacatggcaagaccctgtctctacagaaaatacaaaagttagctgagtgtgatggcggatgcctgtggtcccaggtacttgggaggctgaggcaggaggattgcttgagcccggaagatggaggctgcagtgagttgtgattgtaccactgcactcaaacctgggcaacagagcgagaccctgccttaaaaaaaaaaaaaagaaacaaaaagatttggccaagagcaggagagcaggcccatgaaggtggaagtgagatgtttatcccagcaagggacctgcaagggatgaagctggtggcagcacaaagagcgaggcgtgaggcaggcagcagtgaggcctgcggagcctgggtagtggattgctgctcaggccctgtgagaattctgacttcatcatgatattcctatatgtccagggggggagtcatccgtggcacggcctcatgtgtgattcagaatgtattgtgggagtggcagccccggtgggagaagggaaatgactcaggagagcaggtctggatttcctgctacctgtggctccccttgccagaattctgatataaactaagactataagattagtttcaaaaggttttagagaccttcatgggggctttccaataacaggaagataaggaccgtgaggaacatttctctaactttagacccagaaactaagggctgggaggatgggtggctgcttttttttttttttttttttgagacggaatctttcaccaggctggagtgcagtggcgcgatctcagctcactgcaaccgccgcctcccaggttcaagcgattcttgtgcctcagcctcccaagtagctgggactacaagcacgtgccaccacatccagctaatttttctatttttagtagagacgggatttcatatgttggccaggatggtctcgatcccctgacctcatgatccacccacctcggcctcccaaagtggtgggattacagacatgagccactgtgtccggccagtagctgtttttaccttttccggcatgacctttttctggctactttaatgttccttcccaaaaatgtcttatctttatggtggtggcttttcttgagacgtggcagagtcaggcctgggctggactccttccctgggattcatgtgaaccatggttgaagtctgtgcttcagggctcctccatccttcttagatggcttgagaagagggtgggaaaacagttgaagaagggtcagtgatacaacgttatctttctcgcctctggagataaagtagaaaaaaaagaaatgtcttcggtttgtatttggatacacacatcactcactagctgctgagatccatgatagcatcatgaatatcagcattaaaaggctgctttgaggatcaatagcaatgcttgcactgcatttaaatatctgcaattaaggtcgaagcctgaaaacacgactcctgggaggcccacgagacctgggggaagggacaagttgaaccttagttatatatttcaatgacctagagatcaatatatgccagatcacattttctttcttatctgttctttaaatctcaatcttcacttgggtccacattttcagggtactccatcagcttggtgtttttggtggcagatgcggtgacgccctggctggtagtgtttgaacctggcctaaaggacatctgagtgagagttcaaaagacggaagcatggcggggatatctgtgctgatacacagagggggaaaattggcacgacccctcatgcaaagctgaaaaatgtgggatagatttagtctgacagtgggcgtggagggagattctagcaagtctttaatgtgggatgcagccatctgtcttccagagttatgaaggttgggcatggatacaaagacccttagactttttatttgttcccttcagtagtaatgcttagatgttcttttactgccaaccagagatattatttctttttctttttcttttctttttttttttttgagacggagcttcactctgttgcccaggctggagtgcaatggtgcaatcttggctcactgcaacctctgcctcccaggttcaagcaattctgctgcctcagcctcccgagtagctgggactacaggcatgtgccaccatgcctagctaacttttgtatttttagtagagacggggtttcaccatgttggtcaggctggtctcgaactcctgaattcaggggatccacccacctcagcctcccaaagtgctgggattacaggcgtgtgccactgcctgaaatattctttagtatatttctccctgacacttttctgggcccaagtttatggcagaaactaagccaaggagaaaaagaaagagctgtcaggcatttcattgtcttaattgcggagcacagatattagtgtcagtgagtctctgcgtggtagagctggtggtcagagtggacctaaagccagaaatcacagcatgagccaatgaaactgctgaatatactcagcctcttggtttctccaacttctgaggctgtctctagcacaggtgtcttcatgaggtccctggttgccctctgaaactatgatttgatttcctgcatgttctccttcttgctgccgtccatgaatccgagacctgctttcatggttatcctttctcctgatgtttctctgatcatcataactcttggctgccatgccccactctggcctccctggagcactgtccattcacatgcccaacctgttgaacagaggatccttggtattattgtgagtcattttctgaccccacagccctgctttagagtatttctttttgcctgtcctttgcacgtgctcagtaagtgtttggactgtcagaggtaggtggataggcaaaaatctctgcactcatggtgtttatattctaatggagcagagagacaatacgcaaattgtatattgtacaaaaatgcgacatgttgtcagataagtactaagaaggaaaatatagcagagtaaaaagacagagagtgatatggcacaatttcagagacatttgaaagtggaaagtgttattgatttggaatgaggtctagattcaaatcctgattcccttaccctctaggacaactaacttaacccctatgagcctcagtttccttatccgtaatatgtaaatcatgtttattctttagggttgttagagggtaacaaggattatagtttgagtatggtgcctgaatatgggcgtaatgcatgtgagccttcattgctcttatgagcaccattatttttgtcactataaaatcaagggctcggctgggcacgctggctcacgcctgtaatcccagcactttgggaggctgaggcgggtggatcacaaggtcaggagatcgagaccatcctggttaacacagtgaaaccccgtctctactaaatatacaaaaaaattagctgggcgtggtggcgggtgcctgtagtcccagctacttgggaggctgaggcaggagaatggtgcgaacccaggaggcagagcttgcagtgagctgagatcagtgcctgggtgacagagtgagactctgtctcaaaaaaaaaaaaaaaaaaaaaaaaaatcaagggctctactggtcagctgcattgaacaggctattctttagcttggaatcttccagtgagtttgcaaatatcaagaaatctctctctctctctctcttttttgcatagactatgagcaactcaacttctctagaacaatgtttcttgaactttttggtctcaggacctctcttacactcctaaaagttattgaggaacccaaagagcttctgctcatgaattacagctatactatttactgcattagaaattaaaactgagaaattattaaaatatgcaaacttattaaaattacagtaataaactcattttatgttaacataaataacatattgtttaatgaaaaataactatactttccaaaaacaaaacaaaatttagtgagaagggtaatgtttaacatttttgcaaatttctttaatgtttggcttaatgaaagacaattggattctcatatctgcttctgccttcagtctgttttggtatgttgaaacaaatgaagaaatttagctttacacagatgcataattagaaaaggaagtagtattttaatagccatttcagagaattgtgaatatttctctttgttactatatcaaaaccctacaagcggtactttcttagatgttagttgcagcgcagaatctgatatatgctgtccgcagaagcccaccttaaataaaaagacaaaaatagtatatttttttgtatacagttacattaaaatccattggcctatccttttttcaaggggatatattttaatgtggatcttggaaagatcttttatcctggcattttgtcacagcagttgttttgaaaatattggttccctgagttatgcagatcttccacatgttgacacgttttattatacaataacccccaccccaaaatggctttgttattatcagtaccaaagtcctcagaaaagtctttacattttgcaagttgtcaagttcacaatggtgagcacaagtttttcccaattctaattcttacttaaaaactcacattttatcattggcaacaaatatggtcagttgaagtgatagtctgcccaatacctgtctgttattattaataatttctaatttaattccattgtagtcagagaatatactgataaatgaattcctttttttgtgaattcatttaattcttttaaatttattgagacatattatggctcagaatatatgttggtaaacattctgtgtgcatgtgaaaagaatgtgtatattgctgttagaatgttctacaaatgtcaactaggtcaagttggttgatggtgttgttcaagtcttctacatccttaatgtttttttttttttgagatggatccttgctctgttgcccaggctggagtgcagtggtgcaatctcggcacactgcaagctccgcctcccgggttcacgccattctcctgcctcagcctcccgagtagctgggactacaggcgctcgccaccatgcccagctaattttttttttttttttttttttttttagtagagacagggtttcaccgttgttagccaggatggtcttgatctcctgacctcgtgatccacctgccttggcctcccaaagtgctgggattccttaatgttttatgtttacttgttttattgattattaagggagggatacggaaatctctaattacagttgtagatttgtctatttcttcttgtatttctatcagtttttgcttcatatatgttgaagctctgttgtttcataaacatttgtgactgttatgtcctcatgactaattaacttctctataattaacttctctattatgaaatgactctttttatctgtagtagtattttttgttctgaaatctgctttttgtgatattaacatagccattgcaaatttctttttattagtgttgcaatggtatatcttcttccattcttttagttttaacttatttttgtcttttcatttaaagtgggcttctgtagataacatatagtttggtcttgctgtttaatgcagtcttgcagtctctgtcttttttttcttgagacagactctcactctgtcacccaggctggagtgcagtggtgcaatcttggttcactgcaacctccgcctcccgggttcaagtgattcccctgcctgagcctccagagtagctgggactacaggcgcgtgccaccatgcccagctaatttttttgtattttttagtagagacggggtttcactgtgttagccaggatggtgttgatctcctgaccttgtgatctgcccaccttggcctcctgaagtgctgggattataggcatgagtcaccacgcccagccaatctctgtcttttatttgaagtagttagaccacttatatttaatgcaattatcaatatggttaagtttctatttgttttctgtttccccatctgttgtttgtcccccttttctcttatttatttatttatttatttatttttgagatggagtcctgctctgttgcctgggctgaagtgcagtggcatgatcttggctcactgcaacctgtatctcctgggttcaagaaattttcctccctcagcctcctgagtagctggtattacaggcacccaccaccatgtctagctaatttttgcatttttagtagagacagggtttcaccatttgaccaggctggccttgaactcctgatctcaagaaatccacctgcctcggcctcccagagtgctgggattataggcgtgagccactgcacccggccccttttctctttttctgccttcttttggattaactgaacatttttttatcattccattttatctcttttgttggctggcttatctataaatctttgttattttactgcttgttttagagtttttagcgtccatctttgacttatcatagtccactttcaggtgatgttataccacttcatgtatagtataagaaccttattatagtataatttcatttcttcctccccatctttttttaaattcttctcataccttttacttatagatttgttataaaccctgtgatttattattttgctttaagtagttgtttatctttttaatagatttaaggaataaaaagtctttatatatacccacatctctaccatttccagtgctcttcatttctttgtgtagatccagatttccatctgctatttttttcccttctgcctgaatgagttgctttaatatttcttgtagtgcatgtctgctggtcatgaattctttcagtttttgtatctataaaaaagtatttcacttttgtttttgaaagatattttcaatggataaagaattctaggttgatagtttttgttttttctcttagcactttaaagaagtttctctatgtcttctggcttgctagcataatttctgatgagaagtctgcagttattcatatctttgtttttctctgtacaatgcatccatttcctgtggctgcttttaggattttttctttatcactggagttaatcaagatgattatgatgtgccgtggtgtagttttcttatgtttctggtgcttggggctcgttgagctacttggatatgtggatttatagttttatcaaatttggaaaattttggctgttagtttttctatttgtttctgtcccatcttctgcatagggaacttttacatatattagactgcttaaagttgttgcagatactctattcagttttttctttttcctgtttcatttcctgtctttcagttcactaatattttctttagtggtgtctaattgtctgttaattacacccagtgtgtttttcacctcagactgcatcttaggttttcactgcagtttgcatctttagaagttttacttggatctgtttaattctcccatatctctttttaatgtttaatcttcatacccactaattttatcagtgtataatttctggtttggttgtgattgatttttcttcttattatgaatcatattttcctgcttctttgtatgcctgggaattttgtctttgattccagacattatgaatttatcatattgggtactgtgtacatgtttattcttgtaaatattcttttttttttttttttttttttgatacagagtctcactctgttgcccaggctggagtgctgtggcggtgatctcggctcactgcaacctccgcctcccgggttcaagcgattctcctgcctcagcctcctgagtagctgggatcacaggtgtatgccaccatgtctggctaatttttgtattttcagtagagacggggttttaccatgttggccaggctggtctcaaacgcctgaccccaagtgatccaccccctttggcctcccaaagtgctgggattacaggcatgagccaccgtgcccagcctattcttataaatattcttgagcattgttctggaatgtggttacattatttggaattagtttaaccctttcacatttcgcttttatgcttttttaggtgggtacagaacatcattgagttcagggctgattttttttacccactactgaggtaaaactctactgagtactctcccctatgccccatatattatgaagattttactcttgttagcggaaacaggcactatttctggtccaagtgtgagtgacagtgattgttgttttgtttatttgtttgtttgagacagagtctcgctctgttgcccaggctggagtgcagtggtgcgatcttggctcactgcaacctccacctcccaggtttgagcaattctctgcctcagcctcccaagtagctgggattacaggtgcccaccaccacagccagttaatttttgtatttttagcagagggggctttcaccatcttggccgggctggtcttgaacacctgaccttgtgatccacccgcctcggcctcccaaagtgttgagattaccggcgtgagccacgtgcccagccgattgttgtttttaatcctgttaaaaggtgttacaaggcctgagatagtttcctcatacacgtgcactgatccatgtctatttgactacttgaagcagcctctgcacagctctggagttctctgtgtgtctttttccaacactctgccctgtgacctctggctgccttggccttcttacattcttagttccttctcaactcaggaagattgctcgacttaggatgccctcctgtgccatggtttggaaactctatagcaagaaagctggggcagtcccggggctgacctcgccgttcttcactcccagatgtctgatatctagagaactgatgtttcataaatgttgtcgttttttagttattttaagcaggagaggacctctagtccttcttactccatcttggccagaggcagaagccctgccaaatacctgcatctaaagaaccatagttttaaaaaaaatcagttgttttttttaaaataaaaattggcattccatgaaaaaagttgctcatttagcttgtaactcagtcacacaaatgcttttcttcaagacaaccatcatactttagattgcagcagaagtgttttaaaagcacattagaagtgatggtaaagaccacagttacttttgcaccaacctaaagaataaaagctgtcatttttggctggaggcggtggctcatacctgtaattccagcactttgggaggctgaggcaggtggatcacctgaggtcaggagtttgagaccacctcatcaacatggtaaaaccccatctctactaaatgcaaaaaataagccgggtgtggtggcacgcgcctgtaatctcagctacttgggaggctgaggcaggagaatcatttgaacctggaaggcagaggttgcagtgagccgagattgcgccattgcactccagcctgggcaacaagagcgaaactcggtctcaaaaaaaaaaaaatcttattttgattgcttcattaaggaattctaaagtaaaactggcaaagcgtgtgtgcatgtgtgtgtgtttttctgtaagcacatggcaatgaagaatatgtgattaccagtacagttggttgctactaccttgatttgtggtgaggccccagcagttttacccacggttgcttttgctccagcagtgcaaatgccaatacagtgaaaaaggcaaatcaattcttggtgttttacaaaaatggttctgacctctctgtctcccaaaaggatctcttaaggatgcccgaagggtctgcagaccatatttggagaactgctactctacagacagccttgtatctgtgtacagagacatgagcaagaatgttctgtgttaacaacgtttacactaatagaaattcggaaacaatttaaagttcatcagtagtagaaggggcaaataaattgcagtattcttatataatgaaatagtatatagcagttgaaatgaataagctaaggctgtgtgtatatatgtataaagatcaaaattcagtggggaaaaaaacaagttgcaaaaagaaatgtacagcacggtaccatttatataagcttaaaacgtaaaaaatatttgttgtttatggacgcctacgtatatagtaaataaaaactaaatggaagatagcagctgcctctgagagggagggaggagaatgagatgggcaggtacagagtagctgcagttatatctgtaattcttttttatttctaaaaaataaattggaggatatctagtgaatttttatgacagaaaatacgattggttggcacgcaggtttttattagattatcctctataggttttggaaagcttgaagtcttccataatcatcatcatcatcactgagaaatagagaagaagagagaatgtgtgaacacatgatggattctcagttctacgtgaaaactgctaaatgaatactagttggcgagcccaccacgattattatcatagtgctaacagctgccattatggagagggtgcgatcagccagggacctcacctagtttcatattcagctttattatcacctatgaagtaggacttacgatcctaattccacaacagagacgactagcattcagaaaggttaagttacatgctgatgtcatgcagtgagtcagttatgaagtcatgattggaaactaggccttttgggttcaaggtttgtgctttttccattccgctaacatctgaggtgattggcttgttatctgaagttactctgtttttatttctctttcagctcttcttccaaacctattttcgggcatagtttgttacgtttctgctaagcgagttggctctatcaattacagtatttttgttgccacagcaacaataatgcagccatattattaggtatcactactgttttgttctgctgtgagcttcagccaggcaggtgccctgctatttgcagaggtctctcttcgtggctgtggctttcttgtcttcggggttaattgcgtggaggctgtgtttcagtgaggccttggaagttcggggctggtactacagcctgctataggaagacttcttcatcggttttataatgggatcatttataatgtcttagatagtaaaacaaaagaaccttttgagtttgttgatgataatatcctacggacacatcaagcattgtctaaagatttacttgaactaattgagtagatgatggaaagagagacgatacacttgctcatttgtttagttctttctacttgcagctgtctgataaagaaaaacggaggtagaatgcttgagattgcatgaatgcttctgggaggatgggttgggatttacagagtttaaaaacagaagtttgagagtttcataggcatgtttacctgccagcatcactgcagaaccaggaggggtgcgtgaggcagagaggcaggcggaggagcagggagaggatcccacttgaggtggcacgttggcctttccctgtgctccggctggaatcaacgaggcatttgttccctgcccagccccaatctgtgctgctttctctctctgctgggttcttcgcattgggctttatgctacttcgaaaaatggacagtgttttcgttaagttttagataaatttaaaaacaggccgggcgcggtggctcacgcctgtaatcccagcactttggaaggccgaggcaggcggatcatgaggtcaggagatcgagactatcctggctaacacggtgaaaccctgtctctactaaaaatataaaaactagccgggcatggtggcaggtgcctgtaatcctagctactcaggaggctgaggcagtagaatggcatgaacccgggaggcggagcttgcagtgagccaagatcgcaccactgcactccagcctgggcaacagagcgagactccatatcaaaaaaaaaaaaatgcagctttgggaaacagtaactgacacacactgttactaggaatatatatattggtttgatctttattttttttttttttgccatattttaaacacaatggttaaaattactggcttcggagtgaaattgctattttccagctgtaagaccttgggcaagttacttaacctctcgaggcctcagtttcctcaactataaaatgaggctacgttagtgcctacttaatgaagttctcgtgaggagtttacaatacatgaaaagtgcttacaggagtgtctgcacagagtaaatgtgcagtgggtgttgctgttattattatatattaaaagtcaaagtgttgattttctttaagtcaaattcatatttagaaatttttcctataaaaatgtgatcatgagcattcaaaggcatatttacatgcatattcattgtggcattgtttgtcattgcaaagtaacctaaatgtccaccagtggggacatcatggtgcacccataaaatggaatcttgtgtagtggttaaaaaggatacagagatcaatgccatatattaagtgaaaaaattagtttttctgccatttcaatttaaagatttcaaacgtatttcaaaaatataacaaaattgaaagagttttgcaatgaaacccataaacccaccaagtagcgcctgtggctagcatttcattttacctgccttatcaatattcacccttctgttttcatccatccatcttgatattttgattcatttcaggaaggttgtacacatcaatacactttctcccaaatatttcaacaggtaggaatatcattcattagagttcacagtttgttcatatttcttttgaaacattagtttttataacaatacagatattgtatgtacccatttatataaataacaaaggctgggcgtggtggctcacgcctgtaatcccagcactttgggaggccgaggtgggcagatcacttgaggtcaggagttcgagaccagtatggccaacatggtgaaaccctgtctctaccaaaaatacaaaaattagccggtcatagtggcaggcgcctgtaatcccagctactcaggagactgaggcaggagaattgtttcaacctgggaggtggaggttgcagtgagccgagatcctgccactgcactccagcctgggtgacagagcaagactctgtctcaaaaataaaaaataaaataaaataaataaataacaaagatgtttctatatgccaagggtcatagcaaaccacttctggtggtaatttgctggaacagggttactgagcaatgtgacttttactttatgctttatatacttctgtgtgaattacgccatttaatatactgttggagtgtggcgtcatggctgccaccttcccacttttcttcctcctcctcctcctcccttcttttttactatcatcatcatcaaacctagttatacaaagctttgcttcccttgcaaagctacaaaatgcccaggcaacccttgtaattcttgaagcacaggggacagaaatggagcattctttggattagagagacttgtgttgtccttaattaagtctggggtcctttctgataccttggtttgaggactctgaattaaaattaatagcgcttcctttcacatctgaaccattgtccaagagcctccctcattttagtgagatattgaaaaacaaatggagatatttggaagacgtgtaggtatgtggggcgatttatctcaaggggcgttctattctgtgaaatgctcgaagctaattggcatgtggctaatgggaatcgctttaaagtctgaaaccaaagttctaaaaggcagaaagatgaggcgcttagatttgttgcaattaggtatccaagcacctaaacccacttgataattttctcttcatttctgtgggctgtggagtgtgggaggaaaatgggtaacctataggggagtgggagtgtgagtacagacttacatataatttactttcctggaaagatatagacaagtcatttcaattgccttttttctgggggcgtgtaccctacagattctgcttggagttggttggagtccattagaagtggcaaaacatttttttttttttatggaggaattcaggaacttttagagctttgcagtgcatattttaaaatatgttaagtgctatcagaaggcttggatacttcaatcttctttaaataaatggattttacaattgcaaagtggcgacttttctttttttgggtggcaactcaccacagccccacctttcaagtgaaattttagacacgctaactgtgatttttttttttttttggcttttagcattttggaataaagtcgaaagtttcaaaagctgccagcatatttcaatttaatctgctgctgtgttgtctcttgatagcgtaatgccagggctacagagatgttttcacgatgtaaataatttgtgtactgtaagttgtctaaacacggcatgcgtgtgatccggtgcaatcagattgcttggatatggctttacgtgacggactgtaatggttgcttcggagtcattagagcctagtatgtaaataatccacattttaaaattgtcttaaatgtgcttagacaatggatgaatgcctcctctggattcattaattccatcaagaattcacagttcacagcacctgaaggcatcagcctgcttcttcccaaatgagctcttggcactgtcagcttgcccgtctcccaggtgtacccgtaagcagggagtcaggggtcatcttttcaccttgacatgtgcaaggtcatgaccacagccaggtacaatacagaataaaaccctgacctaggactttctgccttggccatggatctccctctttttttttttttttttaaagacagagtctcactctgcggtccaggctggcgtgtgcaatggcgcgatcttggctcactgcagcctctgcctccctggttgaagcgattcccctgcctcagcctctcgagtagctgggaccacagatgtgcaccaccatacccagctaatctttgtttttagtagagactgggtttcaccatgttggccaggatggtctcgatctcttgacctcatgatctgcccgcctcagcctcccaaagtgctgggattacaggcatgagccatggtgcctggccctccctctgttttttaagacaggtgcgtgtgggcgcaggaggcggagggcccttatgctgccctggcattttggaggagcagggaaatgagataaagctgcaaaatgactccctaaaagttggccccaagccagtgcgggcgacggtgtcagccacccttggttcattttctacacgaggccccacacggccccggagctggagcttctaccgaagggttgccctctgtccccttctcggcttcctctgcagaggggctcagagccagtccagtcagacctgcgaggcctgggctgtggctgctgtggctttgccagcatctattgtctaagagggctggggaagctcactgtttgaaacacacacacacaacagaacataaatcagaggcagaatcttttaacatttacagttttaagtgaaattcctgttgagagtctcttaagctagatttatatctgattttgcattgaactgtgtcgttatgtggggctgagaaactcttacgaaattaagcataatgcgaaaacatgctgaaaagacagttctgtagaaatgtgaaacattattatgttatagaatattggagtgaagaaatacgcataaaggcacaattaccatggacattttccttttaatgatccttgtacaatccttggcagaaaggtttgctgacgtctcctcgtagataaaggaaaattgagacgatattgatattctacatccgttttgaattccaaagaatatcaggagagcgaaccagtctgtcttcatattcaaaacagcaaggcctagactatctcgataccttgggaggatctgtcattagtgtttggggatttgactgaagcctccacactatggacagaccaagtggtggcaataatgtgtgcaggggttaacgtctgaatgctctgatctggaagcttctagaagctcctagaatgggttgaggttgttggatgcttgtccctggagagtttttagggtttaaagcatctgtctagaatgtcttgagagtgtccttggggatagggtgatagaggtgcttgcttgtgctaaggtttgttccaggataccctgttcagctttgttttccacaggagaattcccctcctccagcctctgacttctgctgccctggcttagggctaaggggatattgatcatggcccctgggattttatctttcctttcagtctccagaatgactcccaaagcagatgctgcttctcttgcctcctcgtcccccttccctgggctgccctggcaccatagcctgggtacccagtgtaccatggagtgtgggcagaaacgctgtttcttcctcttgttcctggccgaccttcttctcttggctgggacttgtgattccagtggggggaaaggagcccagtttccctgcctctccctgttcagccctggagcagctggagcagggctggtggtggcgctgagatcgcaagccttccagaaacccttcctccccctgagctcatggcaggtcccctggcagggggaaagcttttgctaaaaacctccctgagcccgtgccctctaagcctggcattgagatgccaccagctggtcgggggagggggagcagcagccgagatgccgccccaggttggagcgcggaggcctttcgcatttgctctggaagcatcatctgagaagccctagcgggttttgctcagggtcaggtgacagccagtctcctcccttcagtagggctggcagcagctcccgactcacagttccttctcttctgctcttctcagaacctcttaaaggacctctaggcgtttgttacctagagttgcttgaaattaagctatttaattctaatttggctgtgcaatatctgattcttgaccaccagaggtcactgtaataaggtagaaagcaggtgtttctgagagtcttcaatgtgtggttgcctcaagaaaacaaaatgaaatcaaccaaaccaccccccaagtttcttcactggcctgggtgtgctgcagtgtgctctggggcatggacacgcagccccagctttctcacttgtggaaggtctgcccagctgtggagcctggcaggacgggacaggtggccacttagggaacatttgactgccaaggccgctggcacaggcctctgggcaggcttgctttcataggatggtgggtgcatcggggcctcactcagaggcaggggccctcctctttcccccaccctacgctcaccctgagctgcattctcaaagtccatttctggcagcaacctggggttagattttcttaggttaattaggcttgtctgccttacctttctgtgtgtgcacttgagtgtgtgcatgtctctgtgtgtgtgtgtgtgcacgtgcctgctccgtcaggtggggtcagtaatagtgctgtccacctacagctatttggtgttaaaaggagatggtgcatgatgtcgggtgcttaaaagcacagggcttgttttccagctagtgtccgggaaatgtgagccatcaaaattctcatccagaggctcggcggaaaacatttaccccgttgcagaatggcttcgactctttctcagacccacccttcctgtcctctttggttggtcatcttccttatatggtgacgtttttcagtagaacgtaagaaacgcctgcctttattagcagtggctcctgaaggttggttccagggaagctgttttcgtcttcggtgggtggctcacgggagaacattagggccttgggggtgcagtttggcaggctttgcatttagcaaatactcgggccctcaggctagagcttttgtgagactgctcacgcactggtttctcttccagctctaaatccccgagttgccggaacacagagaaattagagatgcatgtgatctccgcagggggccaggcagccaggggagagggtggttctggatgcaggagctcacattcctcactgggaacatttggaggatataggtctaggggagggtgactgtattacctggatcctccagagggccattagggctgccagcggaggtcaggagcagtgatctacgggagatgctgccgccatccccttcagtgggaatttctcctggatgtctctgcagaaggcacgtgggtgtcacatatgcacacacatgcatgcacagcgcatggctggggctgcagagcaggcgccccagtgtcatggaccctgtggccacagctgctgggcctgttcacacacggttgggactggccaagggtctcacccagactagacgggaatgggggagacccagagagacgcagagcagtgccgctggggaccccggggactcagagcagtgccgctggggaccctggggactcacagcagtactgctggggacgccgaggacgcagagccgtgccactggggaccccgggaaagcagggcagtgccactgggacccagatcatgcccctctgcatgtaaccgatggcacaaacaccaggccttcagcagggccataagcatctgaggctaggaaggcacatgcgtgattagcagatgggtgatggggcctctagcgggcagattctgtggtggcgctgaaacaggagacgtcctctccgaccttggagacctggcatttggagcctgaatgagccagagacaggaagcctgtccctcccctctctgggcgaccttccgaggaggcatcagctcttcccttgctttggggagggaacttaccctgcgtgcagtcctcctgcccccctgcctggcgcatctttccccctcacgtcctctcccccactccctcctcttcccgcctgtggttttctttcccattcctgtctgccagcagtgcctcctctccccattaacatcccgccattttgattaaaaaaaaaaatcccccaaaataaaaactcatacttgtttctatgggcttcctatgtttctttggaagcagcctcttcataaacccagtgaataaatctcttcaattgttgagactcctgtaagagagtctggtgaagtatagcttgtacctgaacactgcgcaaatgagtctatcctgtttttaatcatgggccagaactaagctaatgttttatgtgcttctcttttaaaatcctcctaaggaccccgagaagccagcactaatatcatccccacgttttagacgcaaagcagttcaaagtgtttaaaagataacttggtggtggtcacccagcgaaaggtggcagaacccaaaagcttgctccttatccactgtgacttggcctccagggatgagaccaacctctcctggaagggcattgctgttgctagccacacctgcccgtctggccccctcctgctgtagttggaagcatctttcctgttcattctgtcctcagctgaaatagcaaacagctggtcaccatccggcaccaaatacccccaatacctgagactgcatgtctgactagtcattaatttgtaccccccagcaggccaacctcaaactctttaaactttatatatatctacatttgaaagattatttttattccattagagccgttacatccttattgtagatgcccttagcaagaagggtttctggaaggggaggccctagaaggtgactatcggtactgaatcctggttcttttgattccagatatgaaattggcttttagagcacattgtgctgattaagcccaaataacaccacatgagtagattttaaaagtctcctcttgaagacgtcctctagcatctgttgttggattgtgtggctgatacgggcttggagttaagcacatccttcctcgatactagttctctctttccattaaaaaatgcaaatgcagaggcctcgaatgtgcccgatttagatgttttgatatggaaaggtaatgttaataagggcatttggcagtgatgcactgaagaaaataaaacagacgcatggtttaggttctgctgttccttcccaaactgcttttccaggcatccaaaacccagctcttctgaaagggcctgggattctccagtgggtgccttggttgggaggggaccccttcatgagaatctccctcttctctgacctctctcagtagaagtgcacagaaagtctgatctcagatctgcctctgcatattaatagcaatattatgtttaaattgaaaatttcatttttcctgcctggtgtgcaggcaaataattgagacctaatttactttatttaataagctagtagccaatgtagttaagcccacactgataaaaacttggagggcatttgttgacaacctcccacatttttctggctggcttggttggacctggaacagcaggaggccaggataccagagcctcccaagtcccagagaactcccaaagggtctcccagctgccggaggcttccagagggagggagtgccacatgggagctgtccgtggttcttgtggctgaaattggcagggctccatggtgctcactggcaagggctgcagcagcctggggctgccgtctgtgttccatcccggatgcagctgatgtgctcactctgcagacatttcttagtgcctaactctgctggccaggtgaacaaggccctgtttttcccttgaagatctcatggttcagtgggagagacagtgggagagaggagaaagtgactaactccacttaggaatgtgtgtggtttaggggcaagagtgtgagttttggactcatgttcttaaatgctgacctcaataaatatgtttaaattctttgagccttgatttttcttatctgtaaaaatgcaagtacagatagtagagcttttcttccagcttgttaaaaggagaaactataaaacctaatgtgaaatgctgccatggagcagtgaccatcacaactgctgccggagtagacatgggagatagccttagcactgagagttgatatttctgtttttcctcctgggtgcccatggtggaactcttcctccctgccccctttgaagttaggagtggttgtacaactgactttggctcatgcagggtgagcagaagtgacatgtgtggtttgctatgtgcccttctcctgactcagtaatcagggctgcttgtgctgaggtggaggctccagcagcctggatccctgagtgactacatggagtggagtctcctcccccacaacatgcaggggatgtgtggtgtgaacaagtggctttttgttgaagccactgaactgttagggtcaattgttattgttactgcagtataacatcttgtcctgactaaaggttcaggaggatagattttctcccttcggtgagaaggagggtactccacagacaaggttacacttcagcacagtcttaaatcaggactctgcattctctagatgcaggaggggataagggaattccagatggaggaactggcacacgcaggacctgaaggataaggtctctggctgtcaagtagatttacatttctccattgtccctcctctcttccgcttacctttctttctctcttctccattcctgtccccacccttcttcagcttcctccctttcattctcttttcttgccaggtgtcctgaggctctgagtgaccctagaagttgccctttaactggccagtgtctccaaagtggttgcatgtctcgaagctctttgcggcctcatttcctcctgctcattggttggctttggctttctctctctctctctctcttttttttttttttttggaggttactaggattagagattgaagctgataagtgcagcttctccacttggtgggtggtgatggtggtggagcgtcatccgagcaggggatatgcctggatgtcatccacccaggctgaatgccttcccagcaacagagctctgtgacttggggtgggttctgtataaaccctgaagcttctatcaccaggtgactttttctagtattcattgacaaagaagagattttaggacatctctcaccctaccccctagctgattccctgtttagccagttggtgaagtctaggctgagtcattctgagagcagaggaagcccttggtcataatggtgcagcctgtctggccaggcgaggggaggggggtggtcatggaggatttcagcggggagggtggaggcttcctggacttgtggggatcaagattttctcttttgctggctggctggccctagagctgtgctttattaagatcatttgaatattatggctttaggaacagaacctattaataattgtgacaaggagaaattgtagagcgtggaaaaaaggggaaaaagagtcactccaaggtaaaataaaccaccacaattggaaagtccaggtaactaccagagtgagacaaatactacctagagagtcacagtgggagccatttgaaaaacaaagtacaattaaaagtttaatttttgatggaattagtaaattaaaagtttcaggaatgggtcttctcaggagaggggagcgtctgctgttggctttggtgtggctacgccagctgggccctaatctcagcctttgcccggagagattctgcagcacctgccgagtgagcagtcatcccatttgagctctgtaagagatccagcgttcctctgggagtgtcctgagcacgcccaccaccacctgtccctgagccttcccttgcaacagtcttgccttcctttcattctcttctcagctggtcttgagtccgaagtgagcggcttcctttgtcgcttgggagctgcagcttgcaccgcactcaggtgtaaggacctgcaggtgtgtgcagacacagtctgtgtgttcctcagaaggaatgaccacttgaagcagagctttgtgacgaggccttccccaagtgcatctgagaacgttcacaggacttctgagactctaagatgagccgtcaacctgtgttgcaaatctcctccagctttaggaattagtttaaaattaaacttacagacaggccaaatctccccagactcaggccgacttaggaaagtacaatgcgtggcttcattttaacaagtagttccctgatacggtacatgaggaaaatgctgctgaacgtcagctagttaacttgaggacccagcatcagccattctccggactgcgagctcagcttgtttcaagtctgggggttcatgtacgaactacaggctggttctggggtctcagcctaagctgaagatccggcggggaccaatatggacaaagcatagaggaaactgcccagtcagaaaggcagtgagccagaagccaagatgttccttaggaacacccagggagggggcagcgtcaaggccagggggtgcagggcctgccagctcacctgtctcccaccttcacgtacatcctctattctgggaaagtgtgatcgatcctgctatgcatattgttgcattccatcttcattttgtgtctcttgattgttggggttttttgtttgtttgtttttttgttttgagatggagtctcgctctgttgcccaggctggagtatagtggcacaatctctactaactgcaacctctgcctcccgggtgcaagcgattcttctgactcagcctcctgagtagctgggattataggggcccaccaccacacccagctaatttttgtatttttactagagatgaggtttcatcatggtggctaggctggtctcgaactcttgacctcaggtggatccacccgccttggcctcccaaagtgctgggatcccaaagtgcaagagattacatgcctggctctcttggttttaaagaaacagcagctattaagttcagatgcttttctaagtgtttattcatcccatgacttagtgtgtgtcaggcactgtcctggacactaggatgtggtggttaaagcagcccagagtctctgccttcaaggagctgatgttctggtgggaggagggcatcgggggatcctcagtgaggagtaaatgtcacgagcccagtgggaaagtgaaggagggaatggggtccagcgggggaagggaatcccagggacatctgggcaaagacgttcccaggaggggactgcaagcgcggtgtccttggggcgggattgcactgggagtgtttgaaggtcagccgggagactgcgaggcaggagctggtggagagaggacgtggaaggaggtgaggccggggaagtgaccggcagggccacggaggactcaggcggctgttcccggcctgcaccctggtcctccatggtggtgaagggctgggggtaggaccacagcctccttgtcttgccttcctggggagatggggcaggaagagagtctgtagataataagctgcctgcaccctgagctactccagagacggcatctgtctgctccggggccagggcggagaagcctgaagctgagtccctggggtgcagggcccacactctggctgctcattgccactctgggtcccgaccgggtgtgggttcagatgaagactctcaaacaggccttggctgcatcaaacacatcgcgggggtgtggagtctagggctgaagtcacggggtagacttcagacttctgcaaacgtcacctggcagtgcccagttgagatatctgtctcggcagtaccaggctatttgaacatgtctttgtaggtttatcaccaaggtagaagagttcattgtctatttcttaggtgagggactccaatttgtggaggcaatggtgggggtagggtgggtggaggagagagtatggtggggaggggaaggagccccagggggccttggcctccacgagtttctagtccttgtcagggtgaggcaggcggagaagaggggactctgggaaggagaaatgggaacatcacactggggtatttatgggagccgtgcacaggagcgctggccattcgtcttgaggccccactgcagggagcagcgctggaagcccggccctctgtactgtgtgttcccaggcacagggagaatgactgtgctgcctctttccggggtgtaatttgagtttgcatgtggaacgaggccctggcccctaagtcagcccctttatgttttggtcgtgattggtgaggcgctgcggcaaggtgcccacgtccctctggtgatctggagacacggtgaacaatgtcgacattgaatatgttgccaggagtgcttagcggaaggttgatacagcacctcgggtctgaacgttctctcccagtgcttatgagctgaaaatctcagaattgaggcaggcaatttctgagttcattcagaacgcagtgagctgtttgggagatggccacgtgcagaggcagacggcagctgacgcaggcttctccggtgacacagtgaccgttcagccccaagagaaggcagtagggagattacctaccgctactgcagactccttcccaggcagacacttccagacccactcttcgctacatcctggagctgcgtggggtgggcaggtggggctgcacggacggagacctctggttcctcttggccctttggcctcccgctacccagcgctgtgagtggggtcttccagtgggtcctgattgccaggtcttgagctgcttcaggtgcccccagcctgggtgtccgaggttgctgatgcacttgggggctcagttgctgttggtgctttgatagactgtcccttctgaggaaacatccctgccaggacagactcatccctgtttgccaggacagactcatccctgtttgccaggacagactcaggaccagcctgtgacagaggctgctccctctggattgtattcattcgaataggtggtcccgttaaacccaagatggtgctctgtggtgtcccagtctacccttgcccctggactccagttcctgtagggctctgtacgccccctctcctgaccctcccaccccagctcctggaacattctgtgtttccttgggaacctgctgcacttagcaaagccccctctccgcagcctcccccttcttccgctcaggggctctggctctgccgtggggacactgctgcccttcagccctttcaagtggaggctgtgttctcctctcggcctgagtgttactgggccttggcatggggcgggggggtgggtatccttggtccccagggccacttctagttcactgtccccccttgtccttgagtctgcatcttcggctgcttcacgccccactgctgcttgtggggccacccttgggccctggggccattcttttttgctccctgatggtcgctggcgggttcttgtccagccctctcctgtgttgtggtgtttcgtgtcgttctctccgacgacaccttggtttctcagttcctgggctttctcccctctaaagacctccttgttcagcgactcatccctaggccctgggtctgttctctgtggcttcctgctttaccatctcaggttccagaagcccattcagactacctggccttctctgcccactcctcccagtgtctacagtccagccacgcctcaacaccagaatccagggaccctcggtgtctttgtgctgccccagccattcctggtctcacaccctccccgactcagctcagattccacaggtccctcctcgcccacgtgccttctgcatcgggcccctttcccctcgctcacatgaccaggtgcgtggctcgtccagctctactcatacctggttctcctcttgggctgtgcccacacccgcccagtacctggttctcctcctgagctgtgcccacacctgcccagcagcctgactggccttcagttcccagcaccagcatcaagtgcccccttggctctgtctgattctcctccgtgctgtccctcgaccctcctccgtgctgtcaatccatccctgtctggctctctggtctcttgggccgggccgtcccctcttatccctcctccaccctgctcccctccccgcactcctcgcagctgctgacctgctttccatcgcccagagcagaggagacaggggcagtcagaacaacactgacactgccctggcttccccctgccagcctcgcccggccactctgctgagggaatgggaaagagcggacacagccatgcaggggaggagggagctcgtgggggcggctggagggatggaccctcatgctccttgccaagggcaactcttcactcatgaacttgaccctgtccctttggccagttccaagtgtttgccgccgcagcgtcccttccctctcctgcggtggcagcttcttttccttccttcctggttctttcccatcagtgtctgcgtatgctcccatcgcgactcacttccctccagttctgtttctagtttttccttcacagcagagcttcatcgaagctctatgcccaccatcattagttccgctgtcttctcgcggcgaggtgtgatgcgggagcgtggcagccccctctctggtctcctgcatcactcctgcctctgcgcccttgctctagaaccttctccacgtggccacccaagaggccttgttagaatgagcgtcagatcatggcacgtctttgctcaaagcctttcagggcccccttctcactcaggatagatgctgaagtcctcactgtgacaggatctgcacccccacccgccagggcccctctgagcccatccccttccccttcctccctcactccactctggggacacaggcatcttggccacttctcgaagcagggcctttgcccttgctggtcttgcctgcaatgcccttccccaggtatctgcctggctccctctcactcccatagaaaggaatttttaggttttactgtgtccccagcgcccatagcagggcctgggacctggtggttggttgctcagcatgtctctgtgaatgaatgagtgaatgaatgctgcgtggaatctggagtcttcctggtgggagacagcccttaaagcagtatccctggcgctgtctcctcctctgttagccttacccatcctggcctgcccttgcccattttggggacttgctgctcctgctgcctctgctgcacatgtgtcctgggctggggggtccctgtgggtaaccctgtcaccacttagcacagaccatcgtcctcactgccagcccagcctctgacttaattaccactggaacttgggttgcacaaacaggggtcccctgggcctgcccacttgatttcctgctgggagaccagcaggggctgttcttaccctaagtttagctgggatgtggggagtggtggcttccctgctggcccatggacaactctccttggggacagctcatgtcctcccccacaaggaaggaaggagaagagaggccaggccgcctctgcatgtctgggtttctatgacgagaagcagcctcctgggtctttctgagcttgagaagcactgatgggtgaattcaggcttcattcctgctggtgcacatcatgcacatcttcgcctttttttgattctctatttttctctttcatttttgcatggctcagtggaagcagctaatgggggttcagcagcaagttctctcctcttaaagatgggctgagcctgacctgcagttgcttgaacaactggacaagccctggtggggctgtgcatgccggtggtgagggggtcgtacaggagagttttcagaagggatgcctcctggcagagagcgactgaggggaacaggcagtagcgtgaccttggagtcgggctgtgccacacttgagttacacggacaccacttccggctctgtgacccgggagagcagcctctggccttcagtgttctcatctgcagtatgggatggtatatgagtccactctcgcactgctttaaagaaataccctagactggtaatttataaatacaagaagtttaattggctcacagtttggcaggctggacaggaagcatagtgccggcatctgctcagcttctggggaggcctcaggaaacttacaatcatagcagaagatgaaggggaagtaggctggtcttccgtggctggggcaggagcaagagagagagtggggaggtgccacacactttaaacaaccagatcttgcgaaactcactcgctgtcacaagagcagcaccgaggggatgccactaacccattcacgagaaccctacccccatgatccagtcacctcctaccagaccccacctctaacaccagggataacaatttgacatgaaatttgggtggagacacagatccaaaccatatcagatagtaatagcacctagcttgttcagttgttaggagattaatgagaatgtgtgaccagcacatagtattaactggtagctcttactaaattaaggaaagccccagaattaagaaccagagccttccctttacagcagtgttgagcatctgtgcacagcacctccaagtcctgggttggtttggctctacctctcagtggctccagcctgacttagcatccctgagtccccagttcttcctgcaaggaaagggggctgtcctcaggaacagatgaaagaacacacaaaagagactccctgaactctaacacacaatacacgtgttagactgttgttacctattcttattgatttcatcagcaagcattcactgtgtcccttctgtgccggatgccatgggaagtgacagtggcctggatggagacctggcctcgaggtgggtcacctgagtgtcctgtgataccttcacctgggtggcttggcccttatcaggaggctgcggcagcatcacagtgggaggccctctgtctcccgccagtgggccccagtccgtttgctcactattttctatcccggagtttacctgcccaggcacactgggggcccaggccacgttctcccctccctgccatgagtcttgatgaagtacttcagggctcagcaaattttggtcagaggtgcccttctgcagagccctctgagttacagcgagtcccctgccccttcctctgcacaaggagggctggtcagaggtacccctctggggagtcctctgagttacagcgagtcacctgccccttcctctgcacaaggagggctgtgtcttcctctcacctgaagatcctgtgccttttgctcttctctgcacgactcatgtggggcctgggattctcactacactcgatatgggtgggagatgaacttataatcagaaggacacagagctggtccccggggccagaggctaggagtgacagctcaggtgatgtgggttacacagctttaggctcagtcctcatctggagtcagccaagaaaatcgcatttcacacacatgcacagttttatggcctcttttgatgtttccttggtggttttgaatatttaaatttatattttcaataatttatttttaacccctcaagtaactgaacctgccacgagaagatgcagcccccaggtgggaagggggctcatgagctgacccatcaggctgaggccttgtgggatcacctgagaggcgttttggagtaatttcctctccatctctttttattttaaaaaataaaaaatgtactctgttaaaacagtgacataagacaaatggtacagaatgccagctgtgaggattcattgatggatgaatttaacccatgtttatggagtgtcatgtctttggtgctgggaaaaacagagagggtgacttagtctccctcctcaagggaggagctcagagtcaggggatggggaggcagacccccgagggactcccagagcccacccttggaaaggagagatgagttggtggtggggggtgggtgccaggagccttgggagatggggcctgcactgctgggaaagtaccgaagcttgtgatctttcaaaggagttttgacaggtgaccagacacagatagatggtgtctttccctcccaaagctataggggccatgagagccgatcgtctcatctctgggtggttccgctgggacacccctcagaagactcttggttatgaaccccagtgtcagcatcccccgcactcatggttcactggttcttccctagaccatgacctcttctcctcctgtctgcatggcatagggccaggcacttcccacctgcatggcttagggccaggcccttctctcgggtggggaggaaagtgagagagaccgagcccctggccctctgctcttctccaccaggcctgagatgggggtctgggctcctttctatgtgtttgcaatccaaggtccttttgggaattcacctgtttggaagatgaatcctatctccagttttgcctttgggtttctcagcttggagacacatgtgcgcggcgagctcccgtcccggttcccctgggtcctgcagtgtgcacaggagcagccctgggatggatctttcgaagcacctgcgtcgcagccagaacagggtttttaaaaaatcaactatacaggtatttaagcagggactagggtggattttatggccctccgtgtggcaggcagcaggcttggctgattctcagggcggcggggtggcccttgctgcagttcaagtcacagtctgttgcggctgcattccatttttcccagagaaaaggccaaatgtcaggggcctcctaggtgcctgggaagatgtccagctgcccaatggactagtctgaccccgacaggctgagagcctgtcatcgggctggaggcatccaggtgaagtggtccacggagctggcatttcgtttacacttatgtgaggcctttctttgagcctcttagacagttagtcctgacaacatctgggttgaaatacagatgaggttgtggcatagcaagtcccctggcccagatatagtcacggtttgctgttgatccagttaggagacctccgctttggccatacagccttcccttctgagctgggatggtccaccaacttttggagccacagctggtaaggagacttcctatctgaggatgcccccttctctggacccccagatcctgacaccaagccaggccaggccaggccattttggtgttgcagaatgtgtggtggggagtaagagcaaatttctgttccagaggcagggaggggacacagagcacaatcctggctgatattccctggggtaatgtccaggcaggacggagaccggccccttcctctctttcccctcacaccagatggctatggccctgccagacattggggctgtgggctgctcaggaccctttccccagcaccccgcatcacgacgcatctagaatgtccaggacacgattctcctgcggactccgatggccacccccattccccctggggctgagagagttccttgccgtgcagatttgttttacactcaggatgtattccttggtcagagatgggagacggttttctcatttctgtctctttttaagagaaaaagtggaaaaagacatccaagcactttgttcgtggaccactttcctgcctgtggagtcgtcacctggcatccttgcttctgggctggtagaaaccagacgcaactcattgctctgagttggtgcgactgcttgaaaggccggggcaggtgctgatgtagtttcttggtgcagagtgatgcccagtagatgtccatggaatgaatgaataagcaaagaatgaacaagtgatgtttaatgagtagggaggagggggtgcctctgtggggtgttggagttccaggcacagaatccactgaaggccgggctcccctttgtcagaggtgacgtctggatgggcagatttgccaaagttctagggtctgaacatagaggccaggacttattaaaatctgctcctttccttaaactagcacattctagctgttatcctggtgccatagaaggatgaaaaatatttctgagaaatcagacaacttccagtgactaaagctagtctaaagaatggtgtacacacacacatacacacacacacatacacacacacactctctctctctttctttcctgttgggtgttttcaggccatttctgtggctctgtaggccaaattctagactctagtgaaaaacccacagacctgagttcgtgggctggcaagctacacgtttggctcatctgaggtcctggagggtgcaacgtctgggccaccatccgggttcctgggctctcctttccatcctcaccaggctccttgggatcccccagtgccttcctttcccatcccaggctgctgctgctcctctcattcccagatgtttctatctctctagacaggtttgggagaaggacttctttgaagttcctgcttccttactgacctcagagactcaagaatggttcattaaaataattttgtcaaggaggtggtgggtggaagaggtgggggtaacaaatctggggaagttagaggagtttaagaaatcttggcggggcatggtggctcacgcctataatctcagcactttgggaggccaaggcaggaggatcacttgatcccagaagtttgaggccagcctggacgatataccgggaccccatctctacaaaagatttttaaaaattagctgggcacaacgatgcacacctgtagtcccagctacttgggaggctggggcaggaggatcgcttgagcacaggaggtcgaggctgcagtgaactatgatcatgccactgcactccagcctgggcgacacagcaagaccctgtctcaaaacaaaacaaaaaaaatgaacaaaagcttatgatatgatcaccgtcgtggtacccttgtttcttaagccttgttcgaaggatgacctcttttcttcttaggggaactttgtactatttatgcctgaagcaatcagggaatcaggtgtgttgaaaatagaatagaaatggtggtatttattgaactttttattgtgttgggcacttatgcttagtgctttaaagatataataggatctaaatctcacaaaatgctgagaatcagatgctgttattacccttgtttagagaggagcaatctaaggctcagaccacacggcagatgtgctgaggaacccaggtttcagcccaagtcaccaaccccagcctgggcagccgccacagctgcccctagaccaggccccagatcccttgggacttctggcgtaacttttatgtgcataacctacaggcctgtgagtcttaagtgggtaatttgcatgatggggaccttaagactggcaaaatcctttcctagggggtggtatgagtatgctgtggctgccataacaaagcaccacaaacaggacgtaaacagcagaaaccaactgactcacagccctggagcccagaagtctaagctcaagacatcaatagggttgggctctcccgaggcctctctccttggcctgcagacggtgtcttcttgccctgtcctcacatggcgtttccgctgtgcacacggctccctgatgtctctctgtgtcctcatctcctcttcttgtgaggacaccagtcatattggatcagggcccacactgatagcctcattttaacttagtcacctctttaaagactgccgtctccaaatccagtcacatgccgagatgctgggagttagggcttcaacatacacattttgcgggggacacagttcagtctgtgacagttcagtcatttgcttcacataggcggggtccccttagggtggttgcttttctgcctgtacacgtgtcttagaccccttgggaaaagcacaagcccagagctgccagtgcaggcgcccctgaggtgctcacggccctgcggcttcctgtcccttgactttttgccccacctggagcagcagacattctcttccgattgcggaaagttttgaggcctcttgtataacataagacaaggcttctgcattgaaattgttcaagaattgggttccaatttcccaggagcacggaaagcgttgccaggaaagcggagttgctggcgatttatgtcggtttttctgacataacgaagatttccctttgtttttttggaaccgactggagcgtgcttgccaaaagagcggcctcaggaggagcagatcattttctcttgttcttcctccttctttttttattccctctcaatttattttcaggtcagagcttcatgaggtcgctgaagctgtgaaatctgacagactcaccatctgagcaaacagactgtccaggaacaggttttatttggctcgctgaggagatgtgacagtctgggaaaatcctcggtctctgtattttgtctttgcccaaaagagtttggttcggtttgacaaatgttaaccaagctcccccctccacgccaggggcgatgccaggcactgagacccggtcctgcccggagcagagcagagccgctcacccttgaggggtgccctgtacaactccacaaatacgtgtccaccgtcctgctggtcgccagcgcgcacagttgctaatccgttgaaatacctctgtggctgctggcgagcgggtgtcacccgagcttccagtgcccatgctgcgctggcctgcatcattctgagtagcggcgtctgtgccagaccagttgttaaacattctgaatgtcacacctggtggagggtgtgtggatgagaggggctcggttgagtaccaagtgttggggaaggccttttggagaggtcaagaccaggccagattttgagcaggagctcagcagacaggccagggaggaacaggcagatattcactgtcagcggcggaaaccagctgtgcaaaggccctgaggcagggagagcagggtgggtttggtggggtggtggcggcagaggagggggtggggtggcggggagaaggggcagtgccagggtggagagagaggctggagtaggggcagtggcagcagagcagggggtggcgctggcagaggagggagctgggaagaagagcaggactcccttggggctggtgtttggtgccaaaggccatgaagagtgagcagagggctttaatttgacggtgtatgaggtcctattatattaaattttatttttttgagaccgagttttgttctttcatccaggctggagtgaagtggcacgattttggctcactgcaacctccgcctaccgggttcaagtgattctcctgcctcagcctcccgagtagctgggattataggcgcccgccaccacgcacggctaatttttgtatttttagtagagacggggttttgccatgttgaccaggctggtctcgaactcctgacctcaggcgatccacccgccatggcctcccaaagtgctgggattacagacgtgagtcaccgcccccggcggtcccattatatttttaaagtatatatattgatttatattccacctttgtctagaatgggtttagattcctgagacatagataatattgtgtcatgagttatatatttagggtaaattataaggaaacatagattacagtcagctaatgtaaaagtttttagtgtaaaaagtgagcaagaagaagatagaatgaggcaggatcaaaacacagaatgagtgacagggaatgggctgcccagcccgggggtgagtctcgagcggccggtgccaagaaggttgcacaatggctgggcgccggggagaggtgtggagaaaggggctgagggcttacacggacaggcacaggctccaccgagcagccgcgctaaggagctgtggggtggggagccgtgggcccgggtgtgggggctgcagaagacggagggttgcagggcgttcgtttactgccgtctgcctcagccatgaagtcccataaattgggtggctttacccaacagaaatgcaccctctcatagttcccgaggcccgacctccaagtccaggtaccggcagggccaggcttccgctggggctccaggcggatccttcctcgcccctcctagcgtctgctattcactgcctgcagctgcttcactcccgtccctgctccatcttcacgcggcctcccccaacctgtgcgtctctgttttcacgtggccttcttgcagagacgtcaatcacattggattggggcccatcctactccgttatgacttcatcttaactagatgacatcgcaaagctcctatttccaaataagggcacatgcgtgggtacaggggttaggacttcaacatatctttttggggaacacggattcatttttctcacttccctaacaaaatataaactgcaggaggcagaaaacgtcgccgacttactcaccattgtgttcccagcatctctggcaggatgctgatcggataaccagtgcccgaaaaaatgtggttgttgaatttgctcccactttcttcaccccctaacatcaggtcaaatccggcctagaattcctagtggaaagacagggacgactcttccgcaacacctctcagacccgtcagtgtgctgaggcgcagcttcccagagggaggtgtcatctgcagcgctttgcttacccgtttgaccacgacaccaccgcacctccctgccctttatcttagcagggcatctctggagagaatgttccacggagcacacctcgggaaacactagtttagctgcattgcagattggaggcaggggcagactaccttctagacagaactttccaactcttgaaagatttcttctgaagaattatggctatatctcctcccctgtagcctcccctgctctgccctctgcttttggtcttaaagctattttagatctgaaataccttccctggacctaccatttgcatttggacttagattattagacattttcttcttataaaaatcagcaagttgtacctacaaagtgggagcaaattcaacaaccacactttttcaggcactggttgtgcgattagcatcctgccagggatgctgggaacacagtggtgaataagttggggacattttctgcctcctgaagttcatattttgttgggggagagagaaaaataaattcatgtactagtctgctcaggctgctgtaacaaaataccatagactgggtggctttaacagaagacattgatttctaacagttctggaggctgggaagtccaagattaaggcactggcagattcgattcctgatgatggctctggcctggctgccaggtggctgccttctcatatggtgggagcctttgccttcaccttctcctcctcctcctcctccttcttctcctccttctctccttccctcctcctccttcttcttctcctcctcctccttctcttcttccctcctcctcctcttccttcttcttctcctcctcctcctcttctttctcccctttcctcctgctcctcctcctgctccttcctcttgttcttgttcttttcttcctcttgttctctctctctcactctctccctccctccctctctccttatgaagccattaatataatcatgaggacacctaccttcatgacttgtctcatattaattagcttctgaagatctcacctccaaataccatagcattgggggttggggcttcaacctattaattttggggaaatacaattcagtccatagcagtcagtaaatagataaagcgaatttccctggtgggaagtgctgcagaggaagaagtgctgggaggagggtgatggttggggagggagggggtagtccctgaggaggcagcagtttaagctgagatgggaaggaagagaggaaggtggccagtggagggccaggaaaggaggattttgggtgaagagaacggctacagcaaacagatgggaaagactgaagcatgtcccgggactgaaggaagtgggggctggagtccagagattgcagagcatgctggtactggagggtgggggaggtggcaggagtcccattcggggcatggtgggggctgtaggaggacagaggagtccatggatgtattctgaggtcctgttggtctaggagctggttgggtgactcctgctgccatctaggcaagacatggcagccacttagatgaggatctgggaggggagaagaagagaagaggacagcttggggatgtccctcagagttagaaccaacagagtttgtaggttttcagcttcagtacctaggtcaccagcagtgtcatctaccgagaaggcaaagcctggggaaaaacaggtttgaggaggcaaataaaaaaatctctgttgcacacgttacatgtgggatgctctttatacagccaaatggggaggccacataggctagcagatcctgggccaggagctcccagaaggacctaggcttgagacctgagtttgtaagtcatcaacaacatctggcagggctcaggcacttagagggcaggggaaggaggaggagatggtgatggggcagaggagaagggggaaccagttgttgcaggaagatggacagcccatgaggtttcccagagggcctggccactgagaagctgagataagagaatggcgtcattggatttggtgacctagaggttcagagtggccagcgggaagttttgtagtgaatatagaggagacgaaaaagaatggggatgggaatggaggaaggagagagggctggaggaagaaaggaagagaaactaattttgactgggcaactatgcagaagaaagcccgctttaggagtgaggtcctggaggaggggacaggagatgggatccagggcgcagctggagggattctacctggagcaggtgggggtgcttatttcatggccataggagggaagagagaggagacagctgcaccttgttggagtccatgtcagctgattggaagaatccagaaaagggagatgggtccgtggataggtggaagccctaggtcaaaatatctgactgcagaaaagaccagtcagggaaataatgatttttctttcaacctggtaaaatagttttcttctgtcaaagagcaagtggcctttaaggcatgtttatctattcccttacattgtgaaagagtaaagcagtcttaagactgggtgtgaaatggagaagaacgcagcactggcttaaacttgactgtgccattggcgcttgctggcagcagctgagcctcaggcaccctgagcaagcacaaggcggagaaatgagacctgctggtgcttacaccagaactgactggcaactgggaggggctgagcctgggatctggggccacttgagcttgacctcatacctgtttatgtcctaattgcttgcttccagttcagcccctcttctctgagaccatcctctccgaggggtcttttctctctggccctttgatgctctacaaatcgtctcctttctagtggttccctcttcttctcccagggcaacagcatcacaggggcatccctggctcctggggctgtagctgttggccttggcccatgcttagggccttcccaccctcagtgtctcatctcaggtgggctggctatgcaccaccccgggatctacagtgtgggacaaggcacacacacttttgattgataaacagggtgtgtcatttaaagaagttgagacagatttttctggtccctggtcaacactgacttagaaagatctaagaaaatctatagatcagattttactgctttcaagataaacgtgcttacattttcgacacagagcatcagtaacctctgaaaatgaaatgcttcccctctttcccatgttctggatggatttggtagaacttgcatcaggctgcaaagtgcatgaagttgaagctgactccttgcttaaagagaaaaccttaaatattaaatgtccatttgtctgttaagtaaacagttgcattctttcagaagtcctgatgctaacaacatctgcgacacgggacggtcagcttcccaaatggctgtgttagccccatgttcagggcctggacttttcctgaataataggtaaagccaagggaaggaaagttttacttcctttctgggctaaattgtcatctgggaagcatcataggctcagtttagaggaacatggcattgtcctttacccaggtgactgtatttgctattttacattggcttgattagatcaaggcaggacatttgttatcgctgactctcagcctggaagcagcatctaatatgtaagcagttgactcctgctggatgggcacataaactgggtgtcatgttattaagatgtggtgaaaggtagacaccttccctgtgcttggaatgccccagtccccacacggggcacccccttacccatagcactgtctcatcagaagttggctggagtgttgggaattggaagggcagggaggttgttggtagggctggtaaatctatggcatggaaaaggtggaagagttatctctgcttcctagggacgaaggcctctcccggggctgggaagttcctgtcccttgtactcagggtctctcttccctggacagtgctagacaaataggactcctttaactccttaggaagttccctgtctttaagcattgtctttctttaaacaggcttcaatgcaaccaattaggttcttacttgctgaattcttcttcttcttcttctgcttctctgagatctgagggggatttgaatgatcttgactctgttcccaaccagcctcttggtttaattccaggattcattcattcaacaaatatttgagtatctgctgcatgctgggaaccatgttccttgcaaggcatacggcaaagaacaaggtagataagttcctcgcatttattgtgtgtctatttgtctattttaacccagaacatcttctgagaggatcagttttaccaggcaagggcaacttttgatggtttccccaatagcattcccgtcttatttcttgccgacaggaccttgactgtgttcaggtgtcagtggccaaattcttggggagatgccagggccctctccagtcccaggggataaacctagatccgtctaagcccatcatggtcagtgattggtttaggggcggcctgtaactcagttattgccagtgagatggctaggcacttctaggacaatttcctggctcttaaaaaagggtgtatgatttctgtcttctggactttggaaaatgtgatggttatgggaggccgctatggtcaccttgcagccatgtgggtccagcccaaggtcatagcatggttgagccgagagaaggaacccagctgacatcaaccctacctccagacttcttgtgacatgagatggtacattttccttcttctttaaggtaatttaggttggattttctgtaattttgcagcccaaaatatcctacttgaaagcaaaagacatctgccctcgtattcatgcagcggtgtggtcgctttagcctttctccaggctcattgtgttgtgctcagttttgtacacaagtacgttcttttctaaatggcaagacgcttaagatgcttggatttcctcttccaccgcctctctccagcacagcactgagcttaatatcttgtatgtcgtgggatatcaataaacgcttattgagttgaatttgagttttacggacatgagtttaaatttggtgactacccacgggcttctgagaaattattgaaagccaatctatggcccaaagagaggacggcctgatcaaggcatgtgctgttgggccaggcagaccacgatggggatgaacgtgccctgtgtgaggtgccagagaaaatccatcatgcatcccgagctctgttttttattgaaaaatccatttataaataatctggacaaataaagtaaaaggcactttattgggattcagaaaaattcatggctactgaacatccggccaattcagctcccagctcccaattagcctgccagggcctctctcagtggcaggggccctgccagccactcgaaaggctgccctgggactatgagtcattttcttatttcttagcatgctgggcgtgaaaatcttctttctctttcttattacatgctagcacttaccgggtgctttggccaagcagatatatcagcatgtttttgtgcagataattgacagtggagcaggaagacactctcctctaagttgctccctctctttgttcactcgcttgctcgagaacccagggacggtgggaggaatggccaagctggacgcaggcctggcctccgcagagctggcgagcaggaaaggcaagtttcagacacctcctgccatgcccttgaccctgctgggcccccggtatcctaggagtgttttcccatttccggccatgtctttattttatgattgttcccttaacccaaaggcaactgggaaagattgtcatccttcaccacgaagaggccgttgtcatttagtgagtacctactgcatgccacatgctatgcagaaggtggttgttgcttcgtctcacctagccctcccagagaccctccaaggacaaatatgagactcagagatgttaactgacttgcccagggtcacacagcttgtaagtggtggaaccagaattagaaaatgcaattcctttttttggagcctcacctccttccatcgggatcacagtgatcatattttccaaactgaaaatgggatgcagggggcctggcacggggcaacggggcaatcagtagttgctgggagaataaacacacgaattgagccaagggtcagccaacgggacaggtcttttgtcagcggaccgtttgggccatctggtcccagggaccacagggtctgtctgcctctccgtagggtgggctgtgggtagtggggtgcccgtgaggggagaggaacaagagagcctggacagcaggctctgggggtgctgtggcctctgagagtggagtgggaacaggggactggcagaggagctggtagcgagggcttgtgtgtggctgctaactggatccatttgccaaatcagcaaagtttggagctgagactccagacttaccctgggcctaacttgggaaaatattacgcagtacaaaataaaattaaacagtattaaccacaggcccaaattgcacctatattttaaaaagcattgtgcagctgagacttataaagcccggcaccagcgtgaggccatcttggttaatgagagctctgcgcctgctactccttgccgcggcctctggttcacgtcctctcgccctcctccgctggggatgtgcggggcctccggtgagccgcagctccctcggaaggatgcaccctttgctctctggagcaggacgggcttttctgagaggcggggcccgaagtgtccggagccgccagcctcaggggctgcactggcctctcctttcctctgcccacacagagaacagcagcatcagatgggggcgggctcaaaagggcttcataggcgccccgacatcgcagctacggaggggccagaaaggaggcgtggatattgtactgcactttctggactttcacgggaattcatgaaggagcctgaatatgcagcagccacatctgggtttatttcagcttggacactaattcatgttgggtcccgtagtaaatcatttttcattcagttacttgtttttcctcacttgaaaaatgggcgtgatactggtggtcgctgttgtcttcccgcagcgatagaatgaggctctgcagtgatttcttttccttccaaagtcgaaagctcctctggctttgcacaaccttttgagcacgaccttctctctcatcacggtgatgcctgttgccccctagtggtcaccagcaaagggagtggttgagccgacgatcccaggttgcaactcagacccaggcctggccctgaacccaggtcttcctgctggttccgaggcatctctgggcagggtgggttatagggaggggaccagagagggagtcctcccagtcgcctccaccaggcagccctccagcttgtcaaactgtcgccagcagtgttttctcagcatggagattgtgtgtgagtgttaagtctagaaaaatcactcaggcaaggcaaagacttgctttggtgcaggggactggaaagcagatgtgctttttctggctctgaacactgaggggaagtgagctttggaagagaggcgctgacttggtgtgtgttttggggcaagaggaagtttaaagagggacagtctgagcttgctctttgcaggggcttgcttggaggcccacaggctggctgagcatgagagagagtgtgccagtcagagcccgcagactgatggcttgcttaggagtatggactggagcgagcctccccctcctcctcctctcctcaaacaaggtcatcagtgacaaatgcacaggagatggtaaaggtggattggggaggatttggacgtgtttcttctgaccttgatggggccatgtcccctctatttgtaatcttgagctagaacaactgacaaatggcctgataggtgacaaaagcaaacaatagactcacttgaaagatacagtgaatagaatttaattgaattttttttggtacagacattgatttcaccctgtaagatgtatggagtaaatcattaggggaattaatatacattaaaatgtagtttattatcatgaaacttttattgtgcttgtagttgtgtttttaattattattttaatgactttctatatttcaaatcgtgataaatctattttttaaaaataaacggactatagttttacaaggtgatgtgtagtgcagagctgttgatgaatattgctccttcattaatgagaaccaacagattagaaagactaaaaatggaccgatttacgcactttttaaaaagccaattaatatctaaccattaaacacaaatgttatagattagtctcactatcttatctactctctgggctcctattggatcattcagagattgactctttaaaccaagtaagtgaaggaggctctaaaagtggaaatgcctgggaccaattaaaacaaaggatttgggccataatgtgctgaaaatacccgtgtcctcctgcctggggggccattatccaaatgagcaaagaggacggaggtgtttgtccaagctgtctttgagggatgaagcagaggttggctctgctggtaggatcagggttttgggtgatttccccagtggtgaagatggactcgtactggcttttctgcattgcatctcctgagccttcttggaatcaagggcaaatgcttgttctgtgctttgtggggctttgtgggtaccccgctctacatggaaatcagccctatgaccactctcaatgctgacctatcccagctgagctgaacgacacgtggttttactgtcatggcaatatgtcctcagttttccaattcaaacatcttatttcagatacttggttccattagccacatgggggcttataccatcttcctccctggctgtgtgctggttggctatttctgacttttgaggttgtcaggcaacatgtctgggcagccagaggcaggggagtatggatgcgaggtgtgtgggctccggaggcacgcatcccaaatctgaaacctggcaccagcatttattgtgcgaccttgaacagatttacttgctcattcattcatttatccattcatttcttcattcaatatttatgaaatctgggtgctgttctagggattggagatatagcagtgatcaaaatggagaaaaatctctgcattccagtgaggactagagaaaggcattcaacaaatagtatagcaagatgcagagtacactgcagaacgtcaggcaggactatcgactgtggagaaaaaagaaagtggggtggagggccaggcagtgtgtcaggggatgttgctatttcacagggtggttagggaggccttacccagaagggaccatttgagctgtgacccagaggaagtgagggagtgaaccgagtaggattctgagggaagagtttcttctaggcacaagggatgcaggtgcagaagccctggggcaggagcctgctgtctgttcagggagtagcaaggggactgtgtggctgagtggaaggagtagatcagaggaatcctggggccagatcatgcaggacagataggtcattgggaggaccttggctttgagtctgggtgagatgggcactcctttaaagggtccccctgactagtgtgaagaagcaagagtgtaggcagggagatccaaaaggcagatgcagtcatctagatgggaggaggtgctggtagcttgaaccaaggcggcagcaattaagatgggagaagtgttggattttggccatattttgaaggtagagtgaacagatttgcttctaatgtttccaaaggaaaggggacaaggatcagtctcagatgtctggccagagtcactggcagggtggtgctgtcatctactgaggtggggggaagctacagaaagaaggggtgtgagtgtgggtgtgatggtaggttcatgtgtgaagcatgtaaagtttaagatcctagaagatatttggatggaattgtttaataggcagctggatataggagcctggagttcagagggagaagtttaggctgaaaacataaattttggggtagtcagtgcagagatgacgtttaaagttctgagtctgggtgagatgactggggagggagtggagatggtgaacaaggcccaggggagatttggggcaatctgatgtttagaggacagggggatgaggaagaaccagcaaaggaaactgagaagcaacagccagagaaagcagaaggtcaagagagagtgagcttgttagaggctaagtgaagatgacgtttcaatgaggagagagggttatcaaaagatgctggtagggcaagtaaaattaagattaagaatttgccatgggctttggcaatgtggaaatcattgatgaccttgacaacagttgtcttgatggaatagtggaggtaaaaatctgataggaatgggcttgggagagaatggaaggagagaacttggaggcaggcaatataaacactctgcaaaggaagtttgctttgaaggggagtataaggatggaatagtaacgtttcttaactcttaaaattctatttcctgatctgtaaaatggagacaaagacaacacctctatcacagagttaccaggaagattaaatgagatgttattggaaactcagtgctcaacacatagtaagggcttaaaaggtttgctggtactgactgctgcctgtctgattgaggagtgggcaggaggatctgccctggtgtttctgtgtcctgggtttttgaaggtaatctctgttactttaccctcctggggttggaagtcaatcacaagtttgggtaaattccccattttggcagttgtgaaatgacagaaagatcagaaagtcagaaatcccacactcctgctaagtggtggcttatctgtatggctgtgcaaatgaagcacgctgcttccctcattcctgtattcagttttattgcttgtcttgcaaaatggcacatttcaagattaaagccattttgactttgagttactgtctttgaagtataggatttcctaattataaaaacacatactaattgtagaaaaataggaaaatagaagaaaatatgcagaaaagaaatttatctaaggcctcctacccaaatccaactgctgttaatgttttagtgaatttgcttccaatacttttatgaactctttaaaaacatatttgagataatactgttatatagtgttgtatcttgctttttctcctcaatgttgttagtgtaagcattaagttcttcattaatgtttttaatggctatgtgccagggaatctttacattttccatctcaacttatatccaagtgaaatggtaggaatagttaacccttttatagcattcactggattccaggccctgttttaagtactttacataaattagctcatttaattctcataactaccttctcacataggaacgatcattattcccagtttacagttagagcctttaacacacattaaagcctttcattgggtgtgaggaccaaggatgaagggacagacaccctttagcagacagtgttgccttccatgtgagggctctggtgagctggcatgcagtcatgttcttcttgaaacccctgtggagctggaagtagagctggagacatgcctcctacttcaacttttcaggaaaaatatccaaacagttttggtaactgttaagtgaaaacaataacaacctattcccagctctcccttcacaatctctttgtggttcttattctgtatttctcttgatttacatcttgtgttctctcctaccgctgattcttggtcacaactttggtcataattcctgcaaaaagtggtcgggagtcttcagtgtccaagggtagaaagaagaaactgggccctagagcaatggtttgccaaagctatgtccttagcaagtcgtcagaaatgttagttcatgttataacccagaacacatatacatatattcatttatgatgataatatctggacagaagtttcaggaaacaatgttacctatggtgcactttgatactttccactccactccgttccatttgattaaaacaataccaatttccactttaaattggtttcaggactcactggttaccacaaactgcagaagtcaaattgctgccctggagcacagcgttggttcagcaccaaggacagcagcccatcgctcccttcccggccctgtgctcttccttccctgctgtcacattttggttccttattctgacttctccagcctgtgttgacctggctcttctttgacttcccgtggtgcactttcaatctcagtgattttttttttttttttttgagacggagtcttgctctgtcatccaggctggagtgcagtggcactctctctgcttactgaaacctccacctccggagttcaagtgattcttgtgcctcagccttccgagtagttgggattacaggtgtgtgccaccacgcccggctaatttttgtatttttagtagagacggggtttcgtcatgttggccaggctggtcttgaactcctgatctcaggcgatccacacacctcggcctcccaaagtgctgggattataggtgtaaaccaccacgcccggcccaatctcagtgattttagaccctaacttaggtgcctggtcttcgtagatcataagcttattggagagaagacctaggttttcactatggcttatgttccctttaatgcttgacccagatctccagggaattagtggaactttaaagatgaggataaggataatgcatcagggttcctctcctgggagtgttgctggctgcagatctgctgggactgactttgtagactgtcatcacgttggacaagaagggcctcgttttattggaacctctttctttttcacaggactggaaaaaaaatttagtcctcctcctcttgctattgctctgttgtaaccctttgaaaagcaagctccctttttatggctttgacattattgcatcgctgaatcacaaggttttcaggaagatatatttgattgtgttttttccctgcagcccatgctgctcttcaggtgacacaatatgagcttttgcgctccttatctttcatcttactccttgataacattaacgagcaagagaagaggaataagatatctcttcttttctttctaataaaatctgaggttctaaggatagggcccatctggttaaagggaagactgatatagacttatcagtggtcagtttttttgacacatccaccaattttagtttgaactaagtcctcacgtggacccaggctcatgtctttgggaatggggcactggcgtgattgattaataatatgtgagtgttggagcccagtcccattctgctttcccaagcagtggcaacatagcagcgggtcttctgagtcatgtgtcagctaggagggctgtgttcatgcatatgttaaggtcttctgagaccgacctctactcctcttcaaagcagggtagaacaattacctctgtaaaattcatgaattctcctcctgtttactcttcaattccaaatgctcaaagctgggttgcttgtttgtcatgtgggattcatgatcacaggtgttagcaaataaaggtggtgactaatctgaacttgtcttatgaaggcaggttatgaaattcaaacactattgaaatccaaacacctttcatctattaatggccaccagtggcctataatcaagtcacactctgttagctacacaattaccttgtttgtttgaagtgtgaattaaggatttgaggcatttgctaatgaatcttacttgctccctactttggctgaaatccctgtgttttccaaatgcaggcagttctggaatttaaggaaaggttttttttttttttttttttggatcctattttctccctgtatgaaagaagcttctgttttgcttttgcacagatggaaagaagcaggctctcacaccctcctttcccactggactctgccttgatttcattctcagttttgtaactcgtggaaagtgcctccccgttgctgcagttctaatggctctctctgcttgagtgttgtaccccttgtatgggagcagaggggagtggtggagtctccccgtttgccagcctcctttgattctctctttgtgactcttctctggaacgagtttcttttgtagataatgggattccattatgggtgttagggcttctctggagctgtcagctgtgagggaagataggaggttttgatcaatggtttctgcttgtatcttggatgtgttaattttaagatggctggcttctgtttttattagttttattgggtttgtgttgggggaagggttaggatgagcatcggtgtttttctgcaaggaaacgtggttgctcggagttaggtggctctgctgtacttggaggctggaagggcctggagcgaggcaaaatgcccacttctgctgtgttcctgtaggcaccagagctgttgtctgctaccatgaaagccttttctgacttctttgaatgacttacgacccatttccaaagggctgtattggttaatgttctaaagcagaggtgttagtggagcttttcagcattgtgggtggggttatttatgggtgggaagagcttgcgtgcacacacacacacacacatacacacactctgatataaattcctgatttatttagccatggattcagaatttatctcaaagggacgtggctacacaaagaccaagtggatgcagcatatttttgcatagcttatcccttgtccttagttcttaatgggagttggcagtgtgtggctgtcagtgacactttctacgcacatagaatcctgccaaggttgaagaagaagccaaattcttgcaacactacttctgttttatattcaggtttatatcactgttctggaaggacttataacaacaatctgtgctcttttaggctcttctgattcttgaactgaaccttcagatcagcaagtctgcatcttcatctgggggtagaggtgaaggagggttggtgttaaggaaggcagaatcggtattgagtcgtcttcagacactctctctccctctcactttttgttatttgagaaaatctgtatctctacgggcttacgatagcctgtctctgagacaacaatgacaccctcaaagttttaaccctgtttctttaggctggctatgtccttcattgaaagattgctgacctctcaaagaataaaataaaagtctaaaaatttatgatgagacttttgccactggctgtgatggaataactaggactagattcatcctcttgctacaaacaatgataaaactggataaaacctgtgaaataaatattttcagctattagatgatcgtcagagtaggactgtggttgctaagagaagactgtaaaccatacaatcactttgtatttctgcatggaggcatttcaagactgtatcttcagggaggtattccaagaagagtacagtgatcttgttgagctgaggagacagatatcagagtttggagaggttgatacatctagaatttgcagggcagaatatcatacaggagaaggcctggcaaagaaagtgctctagaaacttttatggctctcctgggatgttctgttgactactaaaccattgatgagtgaggtgaaaccccacaaaactggacaaagtgcacataggggctataaaattcacagagctcatacaggactcggaggtatttgcattctgaccagcccgactggggagctgtccttgaatatttgggacattcagtagagactccggaaggaagaagcaataatagtagggtaacaacatttctggagtaaaacgtgctgtagacccacctttacagagattaaaaataagccttgagagggtcaggctgatccacaagtaacttaaataactgccagagtaaagcctaaagcctaatgctctttagttaaagatataattgctgacagttttccaaacttgacaaaagctataaactcactgacctgagaagctcaacacaccccaagcaaggtaaatacaaagaaaccacagaatggcacacacagtatgatcagatttcttcaaattagtgataaagattttttttttcttttttaaagacagaatctcactctgtcatccaggctggagtgcagtggtcagtcttggctcactgcaacctccacctcccaggttcaagcgattcttgtgcctcagcctcccaagtagctggaattacaggcacacaccatcacgcctggctaattttttttttttttaagtagaaatgggtttcaccatgttggccaggttggtctcaaactcctaacctcaagcgatcctcccacctcggcctcccaaagtgctggaattacaggcatgagccacagtgcccagcaagaaaaaatcttaaactcagctagaagaggggaaaaagacaaattatagacaaagataagaatttttgcagacttctcatcagaaatcatgcaagctagaagacaatggaatgggatctcttgagtgccgaaagggggaacagtctgtcagtgtaaaattccgtatagagtaaattatccttacatggtcctggaaattgttttacatcttgaatatggtgatagatacataatacatttatgtgttaacatctactggactttacatttaaaatggggtacattttattgtatgtaaattatatctccatgatgctgattgaaaataggttttaatccctgaaatatgggataacacaattgtagtaaatgaagtaatacctatagattcatggcacacattagaggaaactgaggcacagagctatcatgtgacttcccccaaatcatacaaccaaagggagatggattaactttttctattctaaaagaaatgtttttttaatctctcaaaataggtggattcaggtcttctcacaaactaaaaggtaggacatatattcctccagtgcctttcaaactatgatctggctggcatctaggaaacttgctataaagacctcaatacggcaatttgatatctcctcccaaatacatgctgcttctctttcaggtattttttcattctccctctaccttttagtgtgttttctaggattacacatcagtgagattgtaaacatcttcagcactgtggatttattattattattattatttgagacagagttttgctctgtcactcaggctggagtgtaatggcacgatcttggctcactgcaacctctgccttccaggttcaagcgattctcctgcctcagcctcccaaatagctgggattacaggtgaccaccaccatgccaggctaatttttgtatttttaatagagatggggtttcaccatgttggccaggctggtggattattcttatatcagtcaggatcctctcaggagacagaagcatgtttggttatttgaacagaaaatttaatatataaagactttctagctagtagaagggtggttgattactaatggagataaaagagaattctaagtgtttccaaaatatcaggggtaaagcagcagctgctatctctaggctgaggaaaagcagacaacaaatcaaataaggactagaagacccttcctgacattggccaaaattcagacctcttcaaagagtgcatggctaccaaaggaacaagctgcctgccaaagggcctgggctggaagtggtctgtagaagtggctcattgtcacttgcggatgtcaattagaacagagctggtctaaagcagcctgccagtggagggactgtctcctgagggtacagctggagctcatcttcatggccactggactccactctgaataatagtgatgattataataataatgatgatggtaagaggtctgcaagggatgtgtctttgccactgtcatcttgcaggttcacgtcgttgctgtctattgacgaagcttcacattctgctatgccagcaaaggagaaatatgtacagggtccagcttcagtatcacaaagaaggacaaagaagggtgaaattggaactcagagataataataaactgacgactggaacaatatcaaaatagaagttggggcagtcttggatctggcttcatcagtacatgtcactgtattaaggggcaatgagtgttctggttagcattgcactgttttaaaatctatttctttctggattgcctatattggttcatggtcttacagtgcacccagtttccaatgccataaatatcagagtaggggccccaaggtcaagggcctacaaatccaagccggccatgacagtggagaaagccagcaggttgaggtggtggtcctctggagctctcaggcccatccaaatggacagcagcttctcagcgccaagcagtggttgctgtgcagcatgtgggcctggggttgccagactttatttttcaagagaagctggaaatccctgaccttcaatctttaaacattggcagataagccaaatgggaagaagactgtgtggaccaagcaggcacatctctgggtggagtcagtccttgggccgccaatttgtgacctttgcttctgagatgtcctcactgcctctcatttccccagccatttggtttcaagccccatttaccttgcttttgaaaacattcagctttgttccattttccccactcccatggccttagtgcaggatcctattgcctctatcctgggctgtaatcatggtctccaatcagcggcctcttctctaccaggccaccaccagagtgatgtttctaaaaagcacagctagccagccgtggtggctcaggcctgtaaccccagcactttgggaggctgaggtgggtggatctcttgaggtcaggagtttgaggccagcctgacaaacatggtgaaaccccatctctactaaaaatacaaaaattagctggacattgtggtaggtacctgtaatcccagctactcaggaggctgaagcaggagaatctcttgaacctatgaggcagaggttgcagtgagccaagatcatgccgctgccttccagcccaggtgacggagcaagactgcatctcgaaatagatagatagatagatagatagatagatagatagatagatagatagatagcacagctctttgtgtggctcccatctacttaaaagccttcccctggttcttcgggataaaactccattgcctggcattgaattcctccacagtttggtgcctccccctccacctggctttgagttctgcctttctattccttgtcctgcggactctcattactttatattactcagatttccctgaacacatttgctactcccattttcctgctttcacttatgctctttcccttccctgataccttgaccacttgtctgctgggcaacctactcactcgtcaagacccagttgaaatgttagctccttgacacaacccttccttctcttctcagtatggacacatcgtccgtgctgctaatttggcactccttgtctgttttgcacttgaatgtgatagccctggatcctgcaccccatctgtcttcccagctgtatttcccagggccgttactcatgtgtctttgtattgttagggcctttcatagtgcctggcatattgtaggtgctcaataattcatcgaatggttgaaccaatgagtagataaatgaatgaaagaccgggtgaattgcttctttactgactctggctgtggatgtttctgtggtggctcattgtttcttcactgattggtaatttgatagtcataagaatgctttactatgtctcaataacagacagccagtggggccaggcttcatttcagaagtccaggctgttaggaatttattctgaattgctagttaccattttgtagacagtcctccagacacccttggatccttacagtcttaaccactgccactttcataaactgtcagagtagagctacgttgcattccatgcaaataaaaaaaatataacccatttttctatatgctaacagttgatggcaagagttggtcattttgaaagcaagattggggatgttggtttagacctgtgggtggggggtccgggatatcctgtgcagggtgttggcttggccagctgggtgcttgggaagtacatcagtggacagggacaggaatgttcagacgggagccctgccctgttggacctgggttggactatttatcatgggggagggcccgtcggcttcatgcacaggtgccctggagaaagccggtggggaagatgccactgggagagggcagggcctggttatttatttatttaaattaaggccaattattttttgtcaagtgcagcgagtggtggattctgggaaaacttgctttcaccgtaaacatattggttagaagtcattaatatgacattcacacatccctaataaagtacataacacagagatctggcaccactgaaatacccagaggacattaagtatgagtcttaaaaccaagaggattggaaacaagatatttttacttctcgtttgggagtaatataattgcattttgtggctctagcagatgctggggccagctgctaggggagccttggctttttttttttccctttattccccctcctcagctttggtcccttacagataaaacccttatgcagaactctcataaaaaccaagctttaagaaattatactttggttgaaaatccatgtttctatgtgcaaaatatatctgagactgtatagactatagagagatttttattagttgaactcaggagatatttgtataaatacatatatatatataaatatatgtacacacatatatacatttgttgttttttgtttaatttgttacagtgagcactaaagacctttctccctccctgacattgagcctgtatcttgaagacagatggaggacggactgtctgagagacctatgggggactctgctttttctaagggctgctccaggggaagctgtgggaggggaggctgatctctctgggctggacccttctatggggttgagacaaagcacagcctgcagtgcatagctccttctggggagggagtgggggcagcagagagagccggggctgagaagttgaggtgaatccagcccctctgagaattgcgtagccctccctgcacagacgggagcctccccacacactggaggggacacggctcgtcacctcagaggtggaccgaggggggcagggggccctgctctccttgaagcgtgtgctatggaacagcttccttcacatgtgggacgcggagggtgcagcggggtggctgccgttggctccaggaggcatatgtgtttgcgggttcctgtgatgtctgcatctagagctggccatccagtacggcggccatgtgtggcatcaagcacctgagacacggctgagcccagctagaggggctggctgtccgtgggaaacacacagggacttagtagggaaaagagtatgagatagcttgtgactactttttaaaaaattagtaaaatcatactctcttggatatattgggttaaagtataaaatattattaaattttcttctcttttaccttttaaaatgtagcttctagaaattttaaaaatctttttatattttacttttaagttctgagatccatgtgcagaacgtgcaggtttgttacgtaggtatacatgtgccatggtggcttgctgcacccatcaacccgtcatctaggatttaagccctgcatgcattaggtattgcttctagaaattttaaaatgacacacgtgccttgtgttgtggctcaggttctatttccattggacagtgcaactctggcactcacagattggccagagctgcctcctgaatgaggggcacttagaggaacagtgctgtgtgacctctcacgtagggcccgagcctcgatggcaactggacctttgtgcatgggagcctcaggcatgggctcttgaggtgacatcctttggaagagaacttcacaatctctccttcagctctgctgtgtcagcagtcatcttcagacacaggaactgtacggggctctacagtgacagacggactgagacacacaccctccctgaagactgaaaaaccaggaagggagaaccaccacccacatagagctagcaagagaaagtctgagcagtgcagccattgctgagaacgttccagaagctgcagtgcactgtggagggagacagcaagggagactcccctgggaggggctgggcgatgaacaggacctgacaggttatgtgggcagagctggcacatgggcgctgaggcgtgaagggcaggagtcaggttggcacagcaatgcatgctcacctgccagcccccatggggcagcctctgccgtgaccctccagccctgctggctcccagctggctggctcctgacatgggctttgcagtcctctatcaaaacccatcagcttggggactggatggtgggtgaccattgcctctgggtggtggagatggatgcatggcagcacggtgtgtgaccaggcagtgacaccaggtgcagcatcgcagtccccagtcctgcccaggcctcccttcctgatgtgtcttgtttggggccttggggaagggcccacctgcctccctggtctgcaggcaccaaactgtatctgctgaacagatacagaggggcctgtctgggaccctgccagtttgttctccaaagcccctgcagcacatagacgccataccttggcggccgtttttctacttgaacgtccaaaggacaaactaaacatttaaaatctgcaagctggacagtctttgctttggagcctgcagcaaatttcttcatcttgacagtcgagtcattcttctcagcatcgatgtggtatttaggatccgggaggaggaggaagctaagggagccagggcactggggaggccgccgggcacgcacacacgtggtccttagggctcaggggctgtctgcgtgggttggatggctggaatttccttccccctaatgccacatctggctggatgttgatgcctccttcttctttttatttttattgtggtaaaagacacataacataaaatttaccatcagtggtcattagtacattcatgaggatgtgcaaccatctagctccagacattttcatcaccccagaaggaaacccgacacccatcagccataactccccatcaccctcttcccccaacccttggcaaccactaatctccatgctgtctctatgaatttgcctattctagatatttcatataaatggcaccatgcaacacagggccttccatgcctggcctcttccactcagcatcatgttttcagtgttcattcatgtagtagccggtattagaacctcattcctttctatggctgaataacatgccgttgtacgtctgtgacacattttgtttcttcattcatccatctgcagatacttggggtaggtccacctcttggctactgtgagcgatgctactgtgtgcatgtgtctgtgtttttgtttgagcacctgttttcacttcctttggccatgcttttgccccagcctcctatgaatctttcaagccagacttgtgtttgaggggctgcaagtgcaggggaaggaacatgcacgcccggagagtgaggagtcctggcctggctccgccatgaacatgctgagcttggacaagtgcttttctgttctatacctcggtttttttcctctgtcaagagagatagaccagacctgtgttttcatctgccgcctttagggtcctaggtttgtggacctctgggggaagagagagaggccagacaattgagctaaaaacctttcttttcacaactccttcccctcgtcggcgggagcatctcccgctctgtgtgttgctttttccctgcttcctatgatgttttaagcaaagggctccatggagacaaggaattttgcctatcactgaagtcgaggatcttatgagttgaactaggcttttggggtggcaataagcttgatcctgctggaaggagagaatccccctgaaggagattcagtctggactcctcctggtccactgaagggaggtggggctgggaagtgaccctgggtcagtggggagcagggagctgtcagcctgggctgggaaaagttcagttcctcactcatccaagcacactgtggctgtcccttctgaaattcagagcagtggtgcagaatgtgagccttggagccattctgcatgggtttgggttctggttctacaggtactggccatgtgaccttaggcaagtcacttaaccactctgtgcctcagtttccacacctgtaaagtggccatggttcctatttcatagtttgttatgaagattaaacgagatggtcccacataagtcctagggcagtacctccaccaccttagcattggtgacattgatggaagcaatgacacagatggtgaagtccttctccccacaatcactctgaatttggatggcttttacatggctccatgccatttagcaccaaatactttgtgtggttttcgttctttagcgaatctccccaaacgagttcctgagcttttgcagggcgggctcacctgtggtctgcccatctggtgagggggtggcctggggaagggccatgggctgggaaggctgggcaacaggggcctggcattatacgggtaactcagacatgctccacccagccaggttcatgcagcagcatgggacagtcgatggcgggtgagtccatctttggggcccagccaacctgagcacaacagagatgggagcctgggcctgtgcatcagcttcctcggaaaggcttctctcagaggggctctgtgtgggaggtgtcctggattgggagaagcaaaatttacctttggggtggaggagggagtggcgggtgatgtaggtagttcttacatcagcgtgatttcctgggacctctgcttgcttgagagaagctcattaaacatgacgtgacccctgctaagtttggccacagaggtgaccccgtaacagcacttacacacactatcatgttgacttgcctgtacccatcgctcgactgtgagctctttaactgcacgcttcaaagtggtcctgttccctttctggtatacagtagatgctcagtaagtgtttgtagagtaaacacagaaggcagtaagtagtgccaggagtttttccccttcggcgggccatagcagtaggaagccctgtcaggctggggtgagcgttggctgaaggatgcccatgaaagtcttctttggatgtccagggttttggaacaaatcacatgtttagaggttgggatccactgcacctcccatcccctgggccactaagggtcacttctctcagcatggtcctgagcaggggcatggatcagggggttccagctggcacagcctattcctctggataccagatctcctgaagttcaggtagataagctgatgcacgtgacaagtggcttagtaaatccacgtactgactccagccgcagtgtgctctggttttgtgaagccaaatgagaaccaattgacaaaccaacaactctgaacggtcattccgatgttaccattcattgtctgcaggcgtgggcacgtggtgctgtccggggtggtggaggtgacagatgatgattaatccagcagtggtggcagcctctgacctggaccattttggtacctgtgaactcatcgggctgctagacaggtggctcacaccacgtagatcttataacgattcatggtagctattgtttggggcttgtcctctgccagccagtgtatttagaatgatcattccttagaactgcctcgtgagctgatagtctcccagtttcataggaaactggtctagacagattaggtaatgtgctcaaaatgagacagctaataagaggccgtgctggtacccaaagccagggcattgtttgcttccaatgcatgtgctcttaagtgtgttactattttgccttcctacagtgacatagagttaattaaataattggcaaagttttagtcaggaactgctgcattttgctgcttttaagctcctgtgtcaactatcttcagtgacacacacacactctctcactcacgtgtgcatgcatatttacttctgccatgcacgtttttcctagccccatcccatcccatcccatcccatcccatcccatcccatcccatcccatcccatccatccggccatctgtctaacaaacacttatcaggtgcttcctatgtgcctcaggacactgttaagtccaggggatgtgtcagcgataacgtgttccttatccttctcatgctacagtgggggatgttatctgagtaaacaagcaattagaatgcagagtgataaatcctgccaactgggggaaggtgccagtgccacccaggcaagcagtagggataactgacgccatcatgaatagttagggagggccagccagaggaaggatctatctacagtgagacctcagggaaagatttttctaaggagaggaaataacacgtaaaaaggctcagggatgagagaacaatgtgctggttgatcagctgcttatttatgatttcttcagctgcagtcagtgatagaaacttgcacagtgaagcaactctatttttgctataggcttctgcttcccaggttctttgtcaggtccaggcttccggacagaggtggcttgggctctcagttcccaatcactggctgccttgtggtggccggctccatgggatgtcaggccttgatctccactcttggcctgtggtgtttggactgcatggcatcaggggcattttctactctcacctgctctgcttaccgggcttctcttccttctcaaggccaagtttagcatctctggtcactggtgtcaactccattatgtcccagctgaaagaggctgctcgcctccaggcagaggggctgctaccttcccaggagccctctaggaaccccggctgcagagagagctgaggtggaggcctcccctctgaattttcctgatagtcagggcaggagctgcgtgttgtagcatcaccaagatcaagggagacatgtactagtccagccttaatttaacttacaatccctgccaatttcatgttagcagatcctttcggaggtggaagtaatgggccatatcatgcctcgagctggagcaatgacttatgttgatgtcactcactggctttttatggaaattattaataaatcagtaattctatctgcagtgatgttgttgtgtttataaatatttaatttgccttcagatgcccacattttcctcatctttaccttaaactctgctgacgttgctcttcttttggatgtgccgctcactagatttaagttatcagtagtgggaaaggttaacttatttctccccgtttcctctctggaatatggctttatcgtgtcttttctttttaatctttgtgtgattttggctcagggggttggggatgaagctgagagaatgcgacgtctcttgtgacagagatgaaagattcgtccagcttcagaaaaggacgaaactttccaattatggtctcgcatcgtggagaattgttgttgttggcatgtgtttttccctccctaaattaatgacatttagaatctgaaatggtgtctgatgtcttcctgccacagagaaatatttttgtccttgccaccgactcatcttttgaggcccagtgctttgattactaccgtgtgacaggttgaatggaaaggccttaaaaaatcaaaatagaaacagagtccaagtcgagtatttctctagcagggatggagttccaggctcgcaaatgaaaacagcagctgggaaacagcaaaaactttcttacctctcaggatccaatgtgagctaattgttgttattatctttttattcttctgtttcaggaaattgcagcttatttaataacatttgagaaacacgaagaatggctaaccacctcccctaagacaaggtaatgtcccagatcttgcagtttttcaaatgtgtaccataagtggattgatttgcattgattacctgatttggccagtgaattcatgggcaacgagttgaaaatgccatgttgtgctggatggctttcgacactgaggtctcattcattgacataagactgtggcagtgaatacgatcagatggattaaaaagagtgcaagtgccatccgccagttggaacttttaacctgacggctgcatccttcagccgggtgcttggaaggcttcacaggcaggagcctcaggggaagtttattttgggaaattgctcgcctgccactagtgttctctagaaacgtgctttgaaaaaagagaaaccagcttaactgcccacttttatctcaacttgtctacaaactgaaagtcaagttcttgattggtggtaaagagatccccccaaatcagaagcaatggctaagctcgcagtttattatgcagtaaatgtccttgaacctgctaactgccgcaaacacttagcttctctcaccacttgggaatagagggaattagtgaaaatatagctgacctgcgttccgccagcaccagtgatgttaccatcttgtgaacggtgatgttgggacttagggttgattttaaaaggcagcctcttttggtcctccccaactctaggtttttatttttggaatgttacaatctagagcttcggaaatacatggccactctcttccaattgccgtaagttttctgttagcagtgacaggacccaggtgtttattagctggcggggtggtagctggagtgtggtttacacaggatgcctggactgcaggcttgaactgaagtggtggaatgtccagttggtttcacgttggacagaagccccagagtccccaggtttgttaggaccagggaagggttgagtgtgtcctctgtgcccgtggcccatcagcttgacctgttcatccttcctgagtcatgggaaaggtcatccttgggaatgtttattccttctagaaggtattttaaaataccacattattaggctgagatatttactggttagcatcttttaggtgagggcacaatcctcccctttgaaggaggctagagggcattgtggaaggaaggttagttattgaggctcccttccccaggtggctctgaatggttcacctctggcctgagaatgggaggagagtctgtccgcaggagtccccaaaacctcagcctgctggaaccatggtttttcctttgctataaaatcaaataatttatatcagtcagcttttgctgtgataattctgtgtaagaaacgacctgcaagcttagtgactttaaacaacaaatctttattttctgctcatgggtctgtgggctgcctgtggctttgggttgaggtcaggtctgctgtgtgcatcattttgctgtgggacctaggctgaggaagccccctctgcctgggaagttggcgtctcccagaggagggcagaggcttacaagcccaaggcagttgatgcaggtgcagttgaaactcctgctcagatgtggcatcatatgtcatgcctgctgatgaatccactggccaaagcaagtcccctggccaagcccagtaagaatggggctgggaaggacatccctccacagagtgggggcaggggtgggcggtggagaggatgggaatacagtgcactatttggtgaatacggccatgttaaactagagagcctgacatgctcatttcccctttcttctgcggcatcttcttggaggacatcattctcaaacttgagcaggcatcagaatcagctgagggctcattaaaatgcgggccccaccctagggtttctgattcagcaggtgcggtgcagggggcctgaacatgtgttatttctaacaagctcccaggcagtaggatgtggctggtctgggactgtactttgagggccactggcctagttttctgggggagaaggaggcttatctgatttctgcctctggaccatttcctgacttccaagggtggcccttatctcaagcagccgccagcctctccttgcgcccttcactctccgctgaaacactccttgaatctaagtggaaagagaagagctcctccttagccagagagggagcttctctggaatgcgtcctgggccagacatctgatttcagatacgcagacccgtgctgggtttcagccaccctttgacggcagaacagtagaacatttcaaggcagcggttttacctcgagtttcagcctttggaatttgggttacaattgagaaggggatgtcactcagggtcatgcctgactcgcatgactttctggaatatacatagagccaagagaccccaccccgaggcacagggtgtgtgcctggcagaagaaggaaggtgggtttcagatgtggtcaagtccgggtttgagtcctggctccgtcactcagtggctttgcgactgtgaaaaggtcatcttagctcctttaaaagccctggtttttcttcttcatatagaaaatggagttgctgttgatcccacccttgctgggtcacgatgaggattgaatgtggtcacgtttctgattctgcttcccatgccgtcgggtctgtccatgcacaggtgtcactgtgcctcttatctgtggggcagtccccaacctgctggatgctttgacttcgacaggcgtctgccaggatttctctgggtttggaaggacgaatttctttcctaaaggcagagggtgaagacggaaggtttcctattagtattataatatccactccatgtttacacttgaaagcttcttgtcccaggagaagcaaaacttgctgtggttgttcaaggaccttcctaaattagttgttgagttgtgtttggatccccacccccaccccatctctagtattgaaattaattggtgcagttaactgctgagttcatacaaactggcctcctggtattaaggaattaatgacaccaatactctgctgaatgagaaggcaatacaacttctgtttgctgctgccgccgccactgctaatttcattttagaaaattaataaaaatgaattgcaccactgacatttatagagtttcctaataaaatgatacattgtttgtgtggaggaatccctattaaattaattgttgtaatcagttcacatatagatgttggtatagaagctgcagaggggccccctgcttgtctctgtggcttgctgctggctgggggttataaatatagtccttgctcagatactgccctaattacagagaaggccccgggagccccagctcacctgtttaataatgaggtgtgctacacggaggctcccagggctggggaccctgggggcagccgcggtatcgcaacagagctgaatgctgaacgttcaaacagcccgtattgtactctcagcaactgggacctccggtttgaaaaatcaccctgcggaacgtgtttttttggcacttgctgtgtgctcagtgtgataataataccatttggagaccccagggaacttcatgctccccaccctgccaggtgaattgagaatcttggaaagaagagtgtcctctgtctagaatgttctcccagctcctcctgcaggccttgactgggtgtccctttctcggggaggtgtccctggccatgcagtttagtctcacccccacccccacccagccagccccctttcctcctttcttgttttacgtttctctggagcactcatcgccttctgacacactgtgtctgtcgcagttgccttgcctaatttatgtattcattacttgacccactccaaagtgttagcacgaagaggagagggatttttagtggggcttgttcatggggcacccccagctcctagaacagtgtggacacctcccagaccctcaagaaatatccataaaatgaacaaaagtgacatagaaaggtgagcctgagtgttgtgaaggaagggacctggttttctccacttcagtttttcgggtatttctagtcccaggattgtccggttgagccagcactgtgttctctcacaccgcccatgggctggatgctgtgctttgaaacccttctggcagctctgccaggtatggaaggtacgtgccctcctgggactgcatggtgagtccgtgctagaactggaacttgaacccagtatgatctcactgcaaagcccataccctttgcttttgtgcctgtgaaggttcccagggagcccgtcaatagctcctctattcctctccgcctctcactgccgtgaattccaaaccaactaggagaaccaggctccaggcaaaggttccctttgtcagtaagcgtggctcatacgtgccagccagaagggtgttctacactgccctctgaattggagttagccccccagtcacaggcagtgtggaagagtggcacaccactgcaggggagcaggtccctttcaccagagggcagggaaccgggctgagcccaggacaggcagacagctgcaaaactgagcaatcccaatcatttattcctgctcccctgggaaatacgcaaccttccctggaagccaggaacacacaaagctcaagattgaagtaagagcatgtccttcccaggaatcctgtttatacccgttagaaagaggctggaaaaggctgttgattatctaattaattaattagattgatatagatagcacctccacatggaagcactaagggtctcataatagaattttcctatgatgaacactaaatgccttttggtcaataagcaataaaacagcccagtagaaggagggggtctagaaggaaaggaggagaaaagtgagccctgagtttcaaaaagactccagtggctcagagagagcttccactctcctcctcctggtttcctgaccccatccgtccattccggcttcaaatgcccagatctttccccgccctgatggtggtggacatcaaactgtgatcctctgctctttcttcccacattctcccttgtggggctcccaggactccccgacaccatggtctcaccgtcaagtctctgtggatcattccccacatccgactctgtctccccggcacctgcatgacgtattatgatctccagctcgccatcttctcccctccttccctgactcccactctgctttccatcttctgacttccctggttctagaagagccacctcgtttgtggagatgccagagcatacaacttggactccaggtggctcctttttctcctttgtcccctgcatctcattagccaccaactccgtcagtgtttccgactgtaattcacatcctcattttcgtatgttttcccccaggttcagctgtgtcctcactgccactgttacgcttggagtattgaaatatctcctactaggtttccttctctaagtcgaactcctcctccccattggtttgcctgaaatattgctttgattccatcgttattctacttgggagcctcagatacttcctgggagctgaggttgactctccagtgatgtcgttaaggccattcttctgtctcaacccacccttttccgtttattttccttgacatcccacctctaggtactgctacaactggggagctgctggctgctctctgaatatctttcttgtcccccactttggccttcacttggcattgccctcacctcgaatgccctcatgtccaatctggtctgcctcttcctgggagccttccccaaactcaccaactcagggcgagccctcttcccttcctgctcccgtagctgcacgtgctttgttgtcggttgtttgccaattcagctgtcatgagtgagtctttcttccccagtggggtggcgggttccccaaggacaaggtcatgctgtcccttttatctcttcacagcctgtgtgcagggaggccagggctttgatggggtggagttgggggcggacagagtgtggatgcattgcacagcagcaagtttgcccaggaggcaggagtgccagtgcctgccatccatggggttctttgtcctagacagcccttggggtcccggcatggtgccagcctatgagctgaggcctctgcctagaaagtcagtgttatcaggccccaggctggtcctggtgcagtggggtttgtctttgttcagccccattgtaagacccctggcagtgacctgttggtcacctttaaggcatctgctctttgggacagacagaggacttttctaaggaagcccctattcctggtaaggctgctcgagtgactggaatagaattgcaaaaaccatttaaaaattcccagagctgaaaagaaatgcaattctgacacctgctgcaacctggatgaagcttgaagacgttatactcagtgaaataagccagacgcaaagagccacacattgtgtgatgtgctgactgagggatctagaatagtcagctctggagatggaaagtagatggtggtttccaagggctggggtggagggagggagaaatggggagttagtgtttaatgggtacagcgtttcagctggggaagatgggtggcagtgatgatggtggcagagcaatgtgaatgtgcttaatgccactgaacttacacttaaaaatggtgaaagtggtacattttatgttacctatattttactacaattaaaaaaaaattcctggagttgcctctgtagctcttcctcaggtattcagctgggcaggattggctggggtggacgaattgtgtgtgtgtgtgtgtgtgtgcacgtgcgcgtgcgtgcgcatgcgtgtgtgtgcatgtgcagggggtgctgttggtggccagagttcggaagggcagttttagatttagagcattttaggactctgcactttggaactatgcaggaaaaaggaaactgggtcagcagtggtttccacgtggtaacctttgcattatgcactgaaccgggaacgcacttcaaattaacacagagacgtgtcacgttaggtgcgtgtcagcatttttgtaatgtatcacaaatccttggccaaggccattgttggccaaagggcaactgcagggtgagggagttggcgggtgccacatctgtcagagttcccagggagcctcctgcccgaggacttcctcgcagggtacctgtcacgtagttttcatttgtttccgggggtggggaatgagctgtggcctgtatcctgatggagtgtctggcggtgtctcgacagtggtagggaagtccccagtctctgcatggaaataggtctgccccagattccagttatctttatcctagttaatcccagaataccacatgtcaaagcaggggcaacccacggaggccactcctcacatcccctccgtgtctaggaagttggccgtggcgggggcactgatggcctggtggggtattgtcacatacactgggctcctgatcagaggacatgtgagcctcatgtgacttcagtgggcttagccacctgttgaaatggcagcaccagtccagggctcatgtccctggcacaagagctgagggttggcctccatcccacccctcctcacttcttggggccaggagtgcaagttcccggtgtcctggaggagccaagagggaagtgttgatgtttgtgtctctgattcctccctgggttagacagctacgacctgtggctcctgcccaccccgccacccccatgctttttaaaaaaattttgatatggagtctcgccatcagccaggctggagtgcaatcgtgtgatctcggctcactgcaacctccacctcccaggttcaagtggttctcctgcctctcagcctcctgagtagctgggattacaggtgcctgccaccactcctggctaatttttgtatttttagtagagatggggtttcaccctgttggccaggctgctctcgaactcatggcctcaagtgatctgcccgcctcggcctcccaaagtgctgggattacaggcatgagtcagtgcgtccggccctcccttcttttatttttataaaaattatacgtgtacatagtttagtatgtcaaatggccctaaaaaacttgtaagaaaagatagcagcctctgcagtacagctcaatcctgtttcccaggggcggctgctctctggtcttttggttctgatatttacctccagatttctaaatatgttgactctgctgtttcttgatttgtcaattttagacatcatcttccggcttcctcagatgctaactgaggatttagctttcttactgtgtccactgcctggctcttccttacctgggggaggggctggttaatggagggagccagctttctgttggtaactctgaggttcagcatctctacattttttctctggaaccatccgggttctcctgagaaggactggtcgatgtgctgcctagtttgagctggcctggctgctggtggtctgggagccaagcagggcgaggggctgggaatgtcagcattgggtatgagagctatcacttaattctcccagtttatagcctgtgtttcttgcctctcttctgctgtttccgagttcggagtctttccagactccacctcttcagagaatcaatgtgtctcccgctggggcagaggccagggggtggttgcctgtctgctcagtgtagacgtgggaccccgggagggtctattgccccctatacagatgtgtgagctccctctgcttcccaccccattcctaacttctgccttccgtggcacctactgcttccaattcacgagtcttctaggggcttggcaggcgggttagcgtgttgttcctggggtcccctgcacggcacttgggtttttgcttcctagattcagctgtgtcagttaccaaccctgcatctgcttcccgtctctccggaatgtgttggcgtctcttatccacactcgtctctgttcccctttggcttttcctttgtggatttatattagttttcattcctttactgtcactggtgaagatgagcgatgcttagtcctccctgtgagccctgtttcttcctcactggcctttgcccagagtcgtgccgagtgggacccactccccttgttttctcattcttcctctctctcctcttcgtttcctgctcactctcaagttaacttgctgtttcactctcttgcttttttctctttttccaagtctttttcagtctgcagaaagaaatgcctcaaagtgcagtttggaggtttctaagtgcgcagctgctcagggctgggaaatcctgctgctgacatgcacacatgcttcttgtgtgtgaggccccaggtgcgcagcccgacccacaccaagccccggcgctggcctcctgtccaccttcttaatgcaccattcttagtttagagcctttcctggcattggcacaggggcgtggtgtggcctctccctgagcagaatttcagggatcttggggacggccagggccatccactatgctgtgcatgtcccctaacagtgggatctcgatggcttttatttttacatggttctgcatgtgtcttctttggattttactgggacaaaagccttcgcggcagaggcttcgtgccagggtgcctgtgatgcacgttggggtgctctgacaccccaacaggagactgcccgcccagggtgacccttgccagcatctctaagcaggacacctggcagtgaatacttccgagaatggaaaagccccctggcactgtgcccacactgatcgataagtatttgcatgccctgtccgtgtccatcgatggtcattttgttttgtttctggcgccccgcaggccccgcagtttattcttagcatcttcagccctgtctccttggtttggagaattaggactgcctggtatttctgtcacgggcgtggattggcatctgtggtgtttcctctggatcaattctgatctaataaattgttactcgctgcccatggaaagggaaagggagttggcctgcgggccttgtggcattatgagataggaaggcgagttcttggaataaaggactttttgcaattcataagtttctgtgtaatgagtaatcaccagatcatctgggggttctgggctggagattctccccctgtgctgtttggctaggaggtattactgtctttgctattcttagattttccacagtccttcattatggagctttctaaaaaaattaaaaataaaccaaaaacaaaggaaggaaatcttttctggttctccaactctgctgcatatcccactttcacttgagcttttgctttgcgttgtgtgtgtgagcttacacacatgtatgcacatacacacacagcacacatgtagacacatatgtgcgtgctgtggcacatagaaccatacacgtgcacatagatacacaactacacatgtacacatgacacatatgcatgaacaaatttgtaacacacaatacatgtgtgcacacagcacaaacacatatacacatgtacacatgtaggcacatacacacatatgcatgtgcccaggcaatacagacacggagcatatacatgcacatatacacacaactacacacatgtacacacaacacacatgcacaagcaaatattcaacacataatgcatgcatgcagcacagaaatacacatacatatacatacatgtacacacatgcataaatacacaacacacacacacacacacacacacacacacacacacacacacacacagcttcctgtattggtcactgttctcttgtaagaagtctctgggaaaatttttcttcgttatgtgtcttagcgagttgaaattttttgggtagaggaaattttctcctcgaagaaaaaattaattattctatactggctactcctgacctcacctggcagggaatttattgttaattaagctgtttagtttgaggtgactctggtggggaagagggagcgagagtccaggacggggcagccacgtccgggaggggagggtcctgctctgctgaggacaggggagctcactgaagcattggtggctggcgttgtgacttcccatcactctctccaccgggatgatctgtaggaattcaggatctgagttttttattttggcctttacctgcgatggaattgaatttgcatgtagaatggcagctggtgcctaggccgagggatcagagaagtcagcccactgtcaggtctggagaacgacgtctaggcaggtgatgaaattatggaaagaacaaatgtatgcgcaaggatggaggagggaaaacagatgagacacttttgcttctccccaggagcacagcctgcaccgtgaaatgtgctatttccacatattttcacactgaaaatccacggcccttccacctccagtgtcatgggctcgctctaattaattcagttcaccagtgttgggcgatgctgcccttctgatgctgggggttgaccgtgctctgtttggggaatgggtgtcatcttctccctgggttatgagcgagcccttttattcctgagctgcgtgacaccgaactgtcaccttctttagttgttggttggcacccactcttctctttactcggtgaataccttccgactgcttcctgtgtgccaggcattgtgctgggcattgggacatagtggtggtgaccaagacagatcatttataagaattgcaactttggggagtgctacaagggtcaagtgcagggagaggctgcccctctagtgcatggggtgggggaggttgggctgccttccagaggggctgcggggtgcagtgggggttcccagcggggtggggggtacccttgaacagggtacctacctgagtagctattattaacacccttgcctggttgccctagggatggacaatgaactggaagtccaagggtgaaagtagaaagaacccgggagtgctcacatgccaatgtagattccattttacggatgggaggactgaggcaccgtctgtctgagaggcacatatacacacaactacacacatgcacacacaacacacacatatatacacaactacacacgtacacacaactacacacgcacacacacagcacacacacctacacacactacacacatgcacacacaactacacacatgtacacaacacacactacacacgtacacacaacacagatacacactacacacgtacacacaacacacaactacacacatgtacacactacacacatacacacaacacaactacacacatgtacacacaacacacatgtacacaactacacacacgcacacacaactacacacacgcacacacaacacaacacatgtacacgcaactacacacatgcacacaacagatacaactacacatatgtatacatgacacacatgtacacaccacacatgtacacacaatacattacacacatgcacacacaacacacataactacacgtacatacaacgcacatatacatacaactacacacatgcacacacaactacacacatgtacacacaacacacatacacacacacacaactacacacatgtacacacaacacacaactacacgcgcactcacacatacacacaactacacacatacagcacacacgtacatacaactacacacacgcacacacaacacacaagtacacacatgaacacaacacactacacacatgtacacactacatatgcatacaacacacacaactacacagatgtacacactacacagatgtacacacaacacacatacacaactacacacatgtacacacaacacacataactacacacgtacacacaacacacatatgcatacaactacacacatatacacacaacacacatgcacacacaactacacacatgtacacacaacacaactacacacgtgtacacacaacacacatacacacaactacatacatgcacacaaaacaaatattcaacacaatgcatgcatgcagcacagaaacacacacatatacatacatgtacacacatgcataaatactcaatacacatacacacacacacacacacacacagcttcctgtgttggtcactgttctcttgtaagaagtctctgggaaaatttttgacttatccttgtcctgttagctgctgtcagcaaagacgccgtggagtctgaccttctgagtgtggagagccagaggagctctgggggaactggatccccagaggctccaagcaccaagctttggttccccttgaatgccagctgctcagatttggctgatgtcagacccacctgtcccagtgtcccctagcactgtgctccttttaaactttctcccactcccatctctgtgtgctcagcccctccccttccaatcagactgtcaactgaggcttcaggagagaaagtggtctccagggacaaggggtcgtgctggctgtggcagcttcacatcacgggcccatttacatgtgagaaaactgttattgatgatgatgatggtgacggataatggagagactgcatggggggaattattcttagatataattgccaaactttgaattcttttttagctgtgatacagaattccaaggtgagaaaaaaaatctctcccttcactttatgagtaagtgatttggttctgctccttctagaaaaattccagccttaaccccatctatcccatcagtgtgtgtctgggaatatctctagttacgccatttctctggtgcttaatttctttacccagtgccagagggtctgcaaggatatgtatgagttttgcagtttattaattttgcattaaataattaatagtaaagttaattgatgaattattcaattttcaggtaaaatgggatgataaatattcataacttattttattaagggaatttccatttcttatgtcattaaatctagattaacaaaggctgattttaaatgaagattgaaaacaattgtgttttggaattaatttaccaagttaaggtcattgctttgtgagtttaccccctgccagaaagttcgggcttatcatctggaaaggtatctgaattcgcagaagtcacattgccatcagttaggagaattccccagatctgctgggaacttcccatgaagggcatgacaggcccacggtggggtggctcggaggcagaggcggatctgcggccttttcctccgttccactgagcactgggctgttgctttgagctgtttgttgtcttctcaggaattggaacacagtttattattaacattagttcatacatcccagggaaggaatgataaggtgcatatgcctcaaagttgattttaaaataactttggggccagacacaatggctcacacctgtaatctcagcactttgggagactgaagtgggcagatcacttgagcccaggagtttgagaccagcctgggtaatatagtgagaccaccgtctctacaaaaatacaaaaattagctgggcatggtggtgcacctgtggtcccagctactcgagaggctgaagtgggaggatcacctgagcccaggaggttaaggctgcagtgagccgagatcacgcaccgtactccagcctgggtgacagagtgagaccatgtctcaaaaaaaaaaaagggtttccccagagttttaggaggtgtatgaaatgatttcctatccactaatgctcttagtcaagggttaactacagtttcagtttttatctgtgttttctagttatcttatttcttttagacctggtttatgttaatttgtaaaactgcttagatcacagacccacagagtggtggtgagaagtttctgagtatcttacaggctgcttacaacttgcaaaacccttcagatctgggatctcaatccttttaacaacctgcaaagtaggtaatgcctggggatacactgagggagggaggaagggagagagagagagagagaaagaaagaaggagaagaaggaggaggaggaggagacgaaagaggaggatgaggaggaaatagaggaagaagagggagcaaaagagagggagggagatggagggagaaagaaagatccagagtaagccacatctcacattcagttttctttctcctgtccggccacttccctccactcacggatgaggaaactgagacccagaaattatgtgacttacccaaggtcacttcagctaattaggtacagaagttgggaccagagcccagctctttctttttcacatttgagtgcttttttcaacttcggtgtctttcttagcgctttaaaataatttttaaccgcccccgagtagtggagcgcttgggagtatttatagccccgtggaaccgcgtttctctgcttcaccaagtgttcattataattttccagtgaaacttgtttgctctgaggaagttgatcctacggtaggccttcatttcagaggagagcatttgatgttgcatctcatgaacctgctctcctaaaattatccctaattggcttggaaagtggcttccaacaagcagatggcttaatatcttgactttctggtgtgactcagggaggcaccaggattagatctggcttgagatagtggtcttgttatttggaggatgagatgctatcagtaatgtgcagactggagtggcagcctctggggagatgtcgtggaaaccgccagggacagctcgtgtcatcagggatgtcagatggcaggtggggtggggagagggggcctcgaaatgcaattccataatgtctagcgttagtcaacaagccattattgagtgcctgctgcgtgcataggtttgtagtaggcactgtggggttacaaaggcagtggaaaacatggcccctgatctaattggaaagacaagtcacacatatctgagataactagagagaagttcccagacggcacacgcaggagagcctggtgtgtgtgcatgtgtatgtgtgtgtgcatgtgtgtgtgtgtgtgtgtgtgtgcgcgcccacacacacagctgtgggaggaatgcaaaatggggccaagatcaattggattcaattgatttcgttgggaaaaacagcacagcagcatttgtacgggtgaatttcaatcagaaaaccgtgaactttggtggggaacggcatgccctgatagggtcgggagagacaatgcttgggcttttctcattcttaagccacacagagagcagattaattggtggcgttgacataaatgatgagaagactctggaggccatggaatgcaagaagatgggacaaaagccgagaatccctgcaggagccacctcccggaggggcgggtgctgctgggatgccttttttgtgcacgctctgtgggagcctggccggggctcagccaggcagagctgtctctcccagatctgctccctgagctgcagggctgtcctccagggcacagcctagcccccatttagtgagtgtctagatgggcactgcgaggctagagggcctttccaagcagggactccagcccatgtctgtctgttgaaagcctgtttgtcccactgcacccatcaagctaatgggaccataaatggaagtgtttacaaggtcaccctgatgggtcactggaatcatctgcctgctgacttcttcctacacttgagaagggtgcctctcaaccagagacacaaccaccccctcgctcagtccccatgggacatttgacaatgtctggagacatttttggtggtcaccatgggaggggccaagctgctggcatctggggtagaggctgttgatgctggaaaccgtcctatggtgcacaggacagagccctgcatgagggagttagcgagccccaaatattgatggcaagaattcagtgaagataattcctaccgaagcgcttggtggtcaagagccgggctctgtatatgaagcccagctcttccatttagtagcagaaaattaccttctcaccgtgcctcagttttcgcatctgtataatgggagtaatgatagtacatattgttgtgaggagtacatgagtgaagcgtgttaagaacttagggcttagtgtcattggtgtattcatgatgatgatctccccaggaatctgttccaaaccgcagacccagatggccctgggctctgtacgcacacagcccagttcttcctcacttctgcttttgtggttgtgcagaaggacggcctgaactctcacatcatcctcgactaccagaaacgattcaacaatccttggggtgaaaaaggttcagagaggaaataggggagaaaactcaaagagtccacatcacagcattcaagaaagaagagcattttaaataggagatggtggttaagagagtcaaatgctgcatgggaagccaagctaagagcccaaacttatttatttattcatccaacaaatatttattgacaatcgtattagttacctattgcgctaattttatagttacctaattgcctcaaaacttagtggcttaaaataacacttatgtatcattttgccctgtctgtcagtcaggaatccaggacaacttagccaggtctcaaggtttctctcggggctgcagtcaaagtgttgctggggctgcagcctcagttgaacactcgactgaggcaggatccactcccaagctcactcatgcattgtgggaggattcagttccttgtgggctgttgagctgagggctgaactcctttctagctgttggccagaggctgccctcagttcctgccacatgggcctctccaacagggcagcttgctttatcagagtgagttagcaagagactacgagagggtgagcaagacaaaagccagagtctttttgaaaataaatctcacaagtgacatcctttcattttgctgccatctgtttcttagaagtgagacattaagtccagctcctgtcaaggggagctgacccaaaagggtgtggcttccaggagcaggagtcattgggggctccctcagatgctgctgccgcactatgcattacacgaaagcactgataagaggggcaaagtgtaggaagaacaggccacaaactgggagttcatcatggcatcaatacgcactctctgggtggcactgggcaaagcattcttgcctttctggggctcagtttccttctccttacaatggctgaattggattcagggatggtgaatatgcatgatccattgatgcccagagcagacatcactacccatggtacaatcttctgtgagctgggtgcaccctcagaatccctcctaacacagctctcgtttcagacagacacgactcattgatcagagatagcacttgtgttgaaatccatctgccatccctgtgcaatctgcaaagagacattctgtgcttatggctccacagaccaccgatcaagatgtcacagtaaaaacgggcagatgaatcgtcctcccattggcctgagtgagaaagctgactccttagtgtttgaggactgggggtccttgttctgtacctcagcactttccttcccagaaagtacccagtgtctagatgggatgattcagaggggacgctgctgaggagcactcggggtctgaagcccatcgtgggattagcttgacctgatggggtgggcttagccccacatcttctgtttggtttcttatgggggcagatttggcctcagtggctctgctgcctatggtgagccgggaagtgagcatgggtctttctggaaatgagcccgaggtggcctgaggtgtttctgcattcaatttatctgagtttcaagtgattcatcctgttccttcctggatcgtgttcctgggctccaggtgatggcttaatttgcttctgaaatctggatcccacccattcactctcttccagtagctgctgggggcatcctgttaacaagaagcacagcacattttctgggccatgtaaccctttatcccaacccattagaattttcagcaccccccttcccccctttttttttaagtttcttttcctgaagggctagaatgttctgaggcagcttaatagacatcgatttgcaatgatttttagccactgtgcttcaggagagttgaggagctgatgattaatcctcgcaacagctcttcccttttgttttaaaatgacctaatagctgaattgcccgagcaggccgggccagtctgacccagttcagctccttgccttctgctgcttcatttaaatgaatctgcgatgaattattcagccctgctacgggggagagtgagtgctcctcctgtaatatttaatcagcaacctgggaggacagcgtcatctttacagacagctgctgctcacttagaggcagatgaatgagtgttcttagaagctgggtcggattcctgccttttcaaggaaggtggcttgtcctctgatctcagagggatggcgctgctcctcgggttcacccgtgatccctttggtcggtcctctttctatgtcagcagaaagcagcccccagggcctcccagtttagggactctgtgcgacctcgattcccaaatgtgcccccttaactgtagtgtcctctcctctatgtaacaaaccactgagaacttaattgcttaaaatgactggaacgcattgtcttacagttctgtatgttagacgtgtgacccaggtctcactgagctgaaattaaggtgtcagaagggctgcgctccttctggaagctctgggaggagaatccatctcttcacctcttccagcggctagaggccgcctgcattctttggctctgggtcccttcccccatcttgagagccagccacggagcatctctctggctctctttctctgacctcctctcctgagtcccccttctacttctaatgaccttgtgattacattgagcccagctgggtaatctgaaatcatctccccatctcaagatcagctgattagcagtcttaattcaacttgccaacttacttcccctttaccacataatctaacatagccacaggtttcggggattaggacatggacatctggggagaggggtacatgattctgccctcccatacctaccattgccctggcttcatcatccctggttttatagaaatttctattgagaagaaaacctctgagaaccttcctgagcacgctgtctaatccaatattaagagcatgggctctggggacagacaggcttgcacccatcttaactctgccatctgtgagttcagagaatggtgttggacacatgacggctgatgaacagtggacaggttgcttcacctctcggagctcctgtaaaatgggtttatggctggttggggtggttcacacctgtaatcccagcactttgggaggatgaggtgggcagatcacgaggtcaggagatcaagaccatcctggctaacacggtgaaaccacatctctactaaaaatacaaaaaattagccaggcgtggtggcacatgcctgtagtcccagctactcaggaggctgaagcaggagaatcacttgaacccgggaggtgcaggttgcagtaagctgagattgcattactgcactccagcctgggcgaccgggcaagactccatctccaaaaaaaaaaaaaaaaaaaaaaaaaaaccgaagactgaactcccagggctgctgtaagatgaactgagctactgtgtggaaagggagtggctctaggaagcagcctatgagtggccaccgtcactatggctgtcacgtatctctgtttctgagtgtatgggtctctctctgtccagaagggggtgttggtatcttattaaccccttatctggagcctttgtaggggaggctgtgtgggtcgccggtgcatttgtccagtggcacgtgcatttgttgcaggaccgctgcgtagagctgctggctgctgggctgtcctctttggtcacctctcacattgggcttccttcaaacccattctcttacttttaggacattggactgtatgacccttagagacatggatggacttttttctttgtatccctcacaattcctgtgggtaattttaataacacccatatttccattagttttccttgattcctcaaagagcttggccattccaccatgtttttcttcactataagtggttaagattgagatgattttccccattttacagacagaggatgaagcactaaatgagctgcccaaggttccatggctgaccatggccgagccgaacaccagccccagatctgactccagatggaacgctcttcccttaagggtctagctccccactctgacagacacccagcggatgttggctactttggataagccttgaggcctcctccctcccgctgtgtgtccctctccctttgtaggagcacattctggggccagcagcctcccgctcagacttgccattgaacacaagggcagggttacagttacacgctgctgaattgtcccttctggcttgtgtgtctcaggggccctgggtctcccaggccctctgtctgcctctctgacatcaaagatcaggaggtggtgctttgatcccacgggccatttgtttgtttcttccactttccagatctcacttccttgcgcggaggtggggctgctttgggctcaggcttcttgctttttggggctgccctgttgaatgcgttgatgcattttctcatgctgcttccttcaccccattggtggaaacctttcccggcagcctcacgtctgcttttcaggtactctggttccatctcttccggcctttgcatgtggggctctcagtttaccctcagaaagtgtggcatcagcacgagaagcagcaactttctgaaatgcaatgtgtgcagataaattattcagtgaaacccagtctaactttattaaggccagaatcatccttttctgtcagaagccacagacagaggctggatcaacaagaggccccaggacctagacagcaccctggggccagaggatcgtggttggccgtgggctggtcactgccatgtgggcttgggttggccttcccgtatgtttgcttggccacgtgcctgtgtggccattctgaccaagtggggtggacggcagagacactcaggtggagaagccagatgcggcccccttggagaggggtcatctttacttgattcccttggtctggagagaaggatctaggggccagagtggctcccggtcagtgtctaggaatggagagggaggaaggagggtctcgggcaagacctcccccaacaggcagaccagggcagtgcctatttattcatggcatttcacatcataagagagttaaagagtttgtggcattttaaatgctttatagattaatttatattctaacatggtaatgaggaagcggcttttgtccaagaggtgagatatgcaaaaataacctttaagtttcccataattaacctttaatgatattctctcactttagcaatatattttgtgcttcaaaaatgtaacagatagaaaggagtgagtgcttcttgcatccaagtgcctggcagaaatgaagtcactttggtgagtgaggttttacttctccgtcctttggtccaaggctactgggagggtcagatggtgaaatacacacaggaaaccttggctttgtggccgtattggtctttctttacatcatcggcaagccactgtttcggattcttcagggctggccttccctcttcacagcccctcccaccactgctgtaacccacgagcctgctgcacgcagggcccaccccccatcctctctccttggactttggtgagatttgaccttgtaggttcattgaccttttgtcaaagtcctcttctgttgattctgcagagcacctaacatgtgccaaggccctgagctgctgccctcagagttatgtctagtgggggcctcagacacccagacccagtggcagcagtgggagggaaggcaccactgctgtgacccagggtaccctgtattagtcagggttctctggagaaacagaaccaacgtgtgcctctgtgtgtgtgtgtatgtgtgtgtgtacatacatatacatagaccacgggtgtccaatcttttggcttccctgggccacactggaagaagaagaactgtcttgggccacacataaaatagtctaacactagttgataagccagaaaaaacaaaaaaaagagaatcacaaaaaaactcataatgttttaagaaagtttatgaatttgtgttgggctgcattcaaagccgtcctgggctgcatgtggcctgtgggctgtgggttggacaagcttgacataggcaaagagattttttataagaaattggctcctgtgattatggaggccaaataatcccaaaatctgcagtcagcaaggtggagacccaggagagctgatggtggtgttccagtgtgagtccaaaaacctgagacccaggagagctgatggtggtgttccagtctgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaaatctaagaaccaggagagctgatgatgttgttccagtctgaatctgaaagcctgagacccaggagagctgatgatgttgttccagtctgaatctgaaagcctgagacccaggagagctgatgatgttgttccagtctgaatctgaaagcctgagacccaggagagctgatggtgttgttccagtctgaaaaccagcaggcttgagacccagaaagagtcaagtttagtctgacttcagaggccagaaaagactcacgtccccatgcaaggcagtcaagcaggagggcatcttctcactcatgggaggggcagcttttgcttttatttgttctattcaggtctccagctgattggatgggcacatgaggagggcaaccttctttactcactctgctgattcaaatgttaatctcatttagaagcaccctcatccacacatccagaatcatgtttggccaatatccaaatacttcgtggcccagttagattgacacataacattttacccctcacataagatgacccctcatgtaacatcaaccctcatgccctcctgagtctgcaagcctctctccttattaactttatgggttttccctgtctttcctccttgccttctaccccatgccttcaaccaccatctcttgacgggtaacctccagttcttcaccactgactcagctaggttgagtcattaatcagttaattttaaaaaatcacttaaagtagggaattgtacttgtaggtacataagttaaaaatttaacttaaaacctataagtgagtatggacttaccaatctttcgaggcagggcaaggttttcttggttttccttagtgtggcctgctgtttgtgggtgagttctgtctcttttcacagatcaccttgtaagaccttgcctacaacttctcatttagatttcttcaacatggaggggcaacttatggacacactggtgaagcaatcagagaatagaatccttctagagttttatgaaccatcccccccaatattttacagctgaatccacccactttaatttcatagcattccttaagcaactcactttgagtcttgctaagtatttgacttagttttcttttctttctttcttttttttttttttatggagtctctctctgtctcccaggctggagtgcagtggcacgatctcggctcactgcaagctccgccttccgggttcacgccattcttctgcctcagcctcccgagtagctgggactacaggcgcctgccaccacgcctggctaatttttttttttgtatttttagtagagacggggtttcaccgtgttagccaggatggtctcgatctcctgacctcgtgatccacccgcctcggcctcccaaagtgctgggattacaggcttgagccactgcgcccggccaacttagttttcatagaaataactacttttttttttgacagagttttgctcttgttgcccaggctggagtgcagtggcacagtctcggctcactgcatcctccacctcccaggttcaagtgatctcctcctgcctcagcctcccaagtagctgggattacaggcgcccgccaccatacccagctaatttttgtatttttagtacagatggggtttcgccatgttggccaggctggtcttgaactcctgacctcaggtgatccgcccgcctcagcctcccaaagtgccgggattacaggtgtgagccaccacacctggcctatctttctttttatactcacatttcactattttctatattttttatgtaattacaataaagagtacagccagcacagcacgtttggggataaacagagctgattctcagtacacatagaactcaattgatgaagcaagaagtgcatggcagcctggagagtaatgagcacctgtggcccgtgtgctggtgaatgctcagtggtggggagaagggttgctatgtcctagcacttaccagtttccatggggtaaccactcctgccatggatgacttccagttaccagtgattaaataacctaactggctcaaaaccctgaacgtttaataactggctcccccctagtgggcacgggtgactctagcacaccactgcctactgccttccagtgttgagcagaggacggcctctggcgctggcttatgcaactccttaaagaccagttaagggagtgtctaaaaatcagcatatctcagccataattggtcttcactcagccaccagctcctcctcctttgtgtttctaattcctgctccctggggatggcggactctctcgcttcttccagccaattcccgttctgctgtggtcatcctgctgtccctaccaggcctgcccactcaggcagcccttttaactctcctggctttttattcttcctacagaactcctctgttctgtgtcccagccctttcgggacccactaggcttttggctgactaatttaatcagcattttcagccgaggtgttggcttacaaaggcttcattacctccaagcctggaggacaggctgactcatgtgggcggtttgggtctcagagcatccgtcgctcaaatcctcatgcctgtggttgtctctattgatgggtacagccagctctgattgctgggaaaatagtttctagatccagccactgttcttcttgtcacctgagggcattgcctgatggagggactctagagttgggagtacaggagtggcaggggtcagagtgggactgcagattcttggcatccttttttttttttttttttttgagacagggtcttgctctgccacccaggctggagtgcagtggtgcagtcttggctcactgcaacctcgatctcctgggctcaagtgagtctctcacttcagcctcctgagtagctgggaccacaggagtacatcaccatgcctggctaattaaaaaaaaaatttttttttggagagttggggtcttcatgtgttccccaggctgttggcatcccacaagagtgggatggctgttggctagtaccattctgacgcacagcagagaagtttgtctgagctttgatgcttttgattctactcaaaaggtggtttttggagtcagaaatgtttatgactgtgtctctacacatcgtttgaaattttttattgttaaaaaatgtgtgtcccggtgcgctagatgaatagcagcctgtttgcttttgcaaacatacactccacaccctgagtggggaatatggtttggtggcaccagaaccatttgtgtgtcagggactgaggcaggagaccttgatggaagggagggaaacacaacgggaaccttgccattgagaggctccgaatacaaacccatttgtataacaagctgtgtttgtcagaagacgagctgacttcagaagctgatttttatgctgaagagtagcgtgcggcatgtgtaatgaacagagtttatctttgtgtgggatgagaaataatttgctaagccagtaactcctgtatttcccggatacccgtgcagttcacatgcagcctggggtctggagagcaggaatcgccttaattcacagagctctccaaggacccctgatgtcagttcagatttcagaaattaaaggattaaatgctttctgtgttctctgaagacttgctagcacttgatctgtttcattaaaacgactcctttggtgcagtctctccccaaaaccaatcaagagccactgcggcactgctgaaaccccacctttctgtccagctgttgtctaagcccgaacccagatgaacaccagtgcagagggtgttggagaatcctcaagaggtcaacatgagtattgtattaaacatgagagacacaaaccacagggctcctaacctccccatacccctcctcttgccgaaactaatataatccctggaaaggacagcagtgaacagcggggggcatcatttttatttctgtcctgccaaatcggagttctggatagttaacatggaagaacccctgagccgaaaacatacagaagaatgcttgttattggcaagaaatcctgttgttattaagttactctgcgatctctcttctgggctaattggtgggtagagtgggcaggatgaggaagagggcttaggagaggcctcttgatgccagactagacaagactgaatttctacctttggagaatcagggcatctgatataacaatacaacagtaacaaaggattcagctgctgttaatgggagacttccttgcagactttctcacctggggtttcataagagaattaagccgtacagaaaatgatgtgcgtggccttttctcagtccttctgaggatggtgcatagctagtaccattctgatgcacagcagagaagttagtttgtcaccatggatacctgtgggccaagttagggctgaactcccccaaggaaccctcatgagaacctttcgaccaactgtcacatttaatccttacaaccaccccgagataggtataattattatcaccattctacagatgaggaaaccgaggctgagtaactggctcaagatcacacagatggcaaatggaggaatgaggaccagaactcagatctgtctaacttggtgttagttatctgttcctctgtaacaaattaccccacactgagtggcataacacaacacatgatccttatctcacagtttctgagggtcaggaacccaggcctggcttagctgtgttctctgcttcaatgtccctcatgaagctgcagtcaaagtgtcagttgaggctacggtctcataggaaggcttggctaaggcaggactggtgtccaagctcacataggcctggcagggttcaattcctcacaggttgttggacaggggcctcagttccgtgctggctgtgggtggagaccacctttagttcctggacatgtgggcccttcaaggtggctgcttgcttcatcagagccagcaggggagagagagcctgctagcaagatggacgttcctgctggccgtatgtgaacaaatcacagaagtactatcccattgcctttgccgttctgttggtgagaagcaaagctcacattctgcccacatttgggggccaagggactgcaccagggtatggagcccaagaggtagggataacgcaggggggatcttaggctctccccaccacagatcccaaagcccatgctcaggccttgctgcctccctttgtggagtaggaaagacccaactggatgatgattcaaggatcctccctatgggtcaagaggtttaatcgcactgcctgctttgaggtgatacagttttcattgtctgctacatctctgatgttatcagggatggaattaaaatctcagagccacacttgtgattaaggtatcattaatcatttcataaagttatctttcaaagagagtcggccttcagcagagatgtcagggccagggttgttttgcagaagtgctctcacttgtggcaactaagaagagccagcaattctgccagtggtatctagcctctgtactgcctcctaggggcctggtggccacaaatggaggaaaataaaatcttccaagagaagctgcatcaaccacattacctggaggatcgaatatggcatgaagcagagctctgtgtgcatttctggccaccaagtgaccctggctttttgccagggctggccgaggactgggtttaaatggaaaggaacatgagctatgtgtgtaactgaaagaacatgagctatgtgtgtaattgaaaggccccgtgggatcccagtagggcattctgatgggtgctatagacagtcataaaaaataagttacaatttccgatacacaatgggtggataagatggatcaaatcaaactctaatgtggtcataagtgagatgttccagtgaagggaatgttctggttgctagagaacagccacacactttcccacagaaatggtcagtcacaaaagaactggagaactcttgcggtcatgggtgaagtgcatggaggcacacataacaggagagctgtgataactgaccattactgcacttttctcagataattcagtaggcactgatgggctatggggaggtcagatcacctcagtgcccagggggtctctggaaagaacaaggcagggttctgctcttccactgtgcctgctgaggtagggtacacagcccgagacgggagctggcacggcgagttctggcagccctccagagcattccctagacttggctgttggtgctgaggcctggctggggacccacagtggagcagggagagccgcgaggggggtgccacgtggctctttgggagtgactctgtgtcctgagtcttatgggcatctggcagggtgagaggctgggttctaggggagggcactgcctttgaccctcttcctctctctgatgtcaccttctccttggggctcctatggcttgtcagtcactccccctggctcctcatccctcagggcataggaaaggcccttgggaatgccggcctgcagagcagggatgggcttgaggctgtttccgggaaaggccatggagtgttctgggctctgtgagtgtccgaggggaagctggtggtactgtgcacgctcctctcgccctccctgtccctaaacaggacttcttcctccttccacccttgccctgttcttcttttagaagcatattaacctgtccccactgtccctgtcatccctgtcttcctcttgcccccgccttgagctttattgggacatgccagattatatttgcacagccacgtgcaccccagggatgagtgagaagccacccccacccctaagagctccaggtctggaggaagaaatggagacagctcacggagtgaaatgtaaggagtgtgcatattcgtagggggtgcctggcgatcagagcactttaggggatatttgaatggatggtccctgaaagtgcagtggacagacgggaggacacgtgcccctgagggatggcatgtaacaagcagcagagcaggcaggcacttcgggtgccgttctgtccaccagcatgccgtctgagcataacttcccctctgcaacagggcttatttcctagccaagtcagctctcaggaaagtgtctgcaggtaaggctgatggaagctcagggcttccttcctcagggctgttgttgctgagtgtggctccacgtctgatgctggagtgcaaggccgccccaccctgcgcctcccatgcccatcttcactccgcagcctccctgctgctgaagccagaagcttggtgtcgcccgagtctcctctctccctccatcacacctgcctggatgctcttctgtcttgcagacatcacagtggccctcactggtctcccttttatacccatccccagccattctccctctagaagtcaaggcgctctgtaaaagtgtgtctgcccatgtcacattcctgtcgaagccctggaggactcccagctcttctgggatgaaactcaagatccaaacgtggtctgcaagccctgcacacacgtggggctccgggccatcttgccagccagcatgatggttgggcaccacgtgagtttccaggagctgacctgacaagtttccacatctgggtagcttcaacaataaccatttcttgcctcatggttctggaggccagaagcctgtttccctctttggcttgagaaggaagctctgtttcatacctagcttctggtaccctcaggtgttccttggcctgtcggtggctgtctctttctcgtgtcttcatgtcatcttccctttgaatgtgtctgcctccgtgtccaattctccctctccataaggatgccagtcatcttggaatagggccaccctaatgatctcgtcttgtcttgatcatccgcgaagaccctatttctcaatgtcccattcacaggtactggggtgggactctaacatatttggggacaccattcatcctatagtaggtgccacgtctgctgcgtgcccctgccctctccacacctgctctctgcccttgtgtgagtgtgccaggctctttctcaccgctcgccttcacccaggcacatgtggcagtccctctgctttggataagccctgggcacccagcctgggtagtaccttggcccctctgagccctggtcactgccctcactcccgattccttcattggggatgcctgttctggcccttgacttgtttggagagccctgttgtcacccccacagcccctcaattctcctttgtggtattttcctccacagcctgacccattcactgccaagtccctttgagggcacagtgagaaccaaggccttgcagagggagaggtctgtggggttgcatccaagtccaagggcagccaggggaggtggctgtgggcttcacggggaaagtgtctcatggggttgacccaagggagtgaacttgggctggacgttcccatgagaatgtcaccccacagcttctcagctgcaggaatgcgtcttggccagaggtgggttgggcttgggggcacagatgtctcacctcgcagctatagtggtgtttccaggtagcctgctgggtgccttgtcattctccgcatttgtcactgggtcccagtgagtgactctactgagtgggagagactgaagcagcgtctcaggtctgcccttggcaacaagctgttctggctggggccctcttctgtgttctgtgctcttttccctctcctgggacgaatctcctccctcccagacacctgtcccctgttgcgttcccaccgtaggtgctaccgacgggtgcagcatcctccctgcacacacactgtccctcccgttgtggaagcaaattccctgctagaatattctatcccgccttcgaggcctggatcaaatgttacctcctttctgatgcttttctccacatttgcaatcagagtacgtcattccttctttgccaggaatgtcatgcgccatgtggatggcccttctgcaatgggaactcgtgccctagacgcttatcctctatctgcccctcgcttgactataaagtccttgaagtcaggactgatgtgctgatcaatactttatattccagatgggggatgcccaatggatttgctgactgatctttctggctctgccgtcaggaaacgttaagcagattccttgaagtttagggtcatgggtctcgttcttgagtccccacggcgaagcacggcgctgacagcaggagatggcttagtaggtgtgcatgggacgaatgaacttgttagctgagaagatttaacgtcgccctccccaagttttctgcaatttagtggtgaactcttaaagaacaaagattttaagcactagataaataccattttattcgtggaagcctagagaagtgggagtcaggaaggggaagggaggagattttgtcgggggaagttttcccagtgcccttaaatccactctaagtgccgtctctgctctgtcctcctagctgtgagcacccagggagctccgagcctggtttctgtcatcagattgaatatctgatttgtaagaagtggaaagtccccatctgttgtccctgctccctgagtagagttccaggaagcaacgcctctgcatctacaccgtgttaagatggaggagggcacgctgagccaagcatgggaatcaatctctgaccacttgaatggggctgcccttcctccaggtcaccctcctccacgtcagcctgggggacactagaagttcaaatggatctaagggagcagactgtattcattcattcattcactcactccctcattcatccattcatcaggtgttggttgagcccctcctgtgtcccagatgccatgctgggtgatggggagacagaagtagataggaccagttcctgcaatgtgaaagttcggagtgattgcaatagagccaaacagaccgtgtgttcaaggtcagcccagagaccatgatgggtggcataaaacatggcagttgcttacccatccataggcacctacggaaacacttcctggagtaagggacaaataagcagaggccccaaggaggagtaggaactcaccagccagtgggaaggtggaggagggacaagggcatttcaggtgggaaacaggattgcagaggctagaggaaggagagctggccccggggcgactgggggctggcggttcagcaggagcagcatgtagggtgagaggggctgaaggttgagggaacaggcccctgagggcctcatacatcacccaacctgaggaatttgggctttgacctgaagtgaaatcacgggacagaggttccaggggtccctcctttccatctctcctccccaaagcctcaaagccccaacgcccagtgtgttagtccatctttatgctgctgatagagacaggcctgagactgggtaatttataaagaaaaagaggtttgaggttttaatgaactgacagttccacatggctggggaggcctcaaactcacagtcatggcagaaggtgaagagagagaatgaggtaagagagagaatgagagccaagtgaaaggggaaaccacgtataaaaccatcagattccatgagactttttcactaccatgagaacagtatgggggaagctgcccccatgattcaggtatctcccactgggtccctcccacaacactggggaatgatgggaactacaattcaagatgagatttgggtggggacacagctgaaccatgtcacccagcagtcccgcaaacctaacaaatgcctgcctgtcttcacctcagatggaacggccctgattcagctttccccatccgtgccttctaccccctccctaattcaatctgctgcaagcctctttccaggcagctaatgacacaagggtgtttaattctgaactctgcaatctcaaaagattaaataatggattttgtgatctgccaggctctttcctggatagaatgataagatatcaattggaaaaatttaaatattgatgagttttaacttttgtattgattgggcagtgacatattttaaataatgattcacattaaaaatacaagggttcctattgatcatgcagcatctggttgtattaaaataatgaataatctttagaacttactatgcttttaacattttgtttttcctagtagctgaagatccaaccaatgcatagcttgcaacacctatttggaacctcatgcatctgtctgcccatgcttttctgtcgctgctcaggactgccatttcttttttatgtttttttgagaaggagtctcgctctgtcacccaggctggagtgcagtggcgtgatctcggctcactgcaagctctgcctcccgggttcatgccattctcctgcctcagcctcccgagtaactgggactacaggcgcccgccaccatgcccagctaatttttgtatttttagtagagatggggtttcactgtgttagccaggatggtcttgatctcctgacctcatgatccacccacctcagcctcccaaagcgctgggattacaggcatgagccactgtgccgggtccaggactgccacttctttgtagggtcaggcagcatggggcctgggagacagggggctgagcccgcagacgtggggctagccgagcagctgggcactatgcaaccccaggggaattctctgattgttcagctttttctgggtgcttgtggctccaggggtgaagggaaggccagaggggctttttttttttttttttttttttgctagccggaagccgttcctttaggatctacgatgggaagtcttcaaccgttgcacccagggaccttgctcaccctccttgaagtcacctttactcctcttgcttggacttctgaccatgttgtctcaaagtttccaggctgtctcttcatctgcactgttacaatcctgactttcttcactcatcgctaaaaatatttccctagggccctcaaggagtctcaagactcaggcagttaatgggagtggaactgccacctgctggtgttgatatgtgccggtcaccttgccagcctcttcgcattcattcaccctgcatccgtcattcattcacccagtgcagatttattaaactgactccgtgccaagcaggcacgatgcttgtccataggaagcttagaatgtagaaggggacagatgttaacaaacagttaatgcttgactattaattccaagtgtgatagaaccggcacaggaaacaggcaagaggacctagcctcatcaagggtgacatgcaggaaaccgctaacctagcaggcctgttggttgtcctcagaaagccctcaggcctatccttaggaaggcctcttgcaactttggctcttggctggtgtccaggaacttgattggtaaaccgttctctattctgacataaaaccttcactaaaggattagagcggctcacagtgcctaaactgcttgtacaaaccatgccgtttatgccgagcactggctttccttcttggggtgtggaattttggtatgtgctaagcagaggatgcctacatgacccccagcagagccctgggtgccgagtctctgatgagcttccctggcagacagcactttgtgagtgtatcacaccctgttgctagaggaatcaagtgcgtccggtgtgactcccctgggagagtagccttgaagcctgtgcccggtttccccctacctcgcccatgtgcccttcccttggctcatttttctgtctccttttgctataataagtcttcaccatgagtacaaccatgtgctgggtcctgtgagtcctttcagtgactcaccaaacctggggatggtcttggggttccccaacacgggtggccagggaaggcctccctgctgaggtgacatttagctaacaccttaaggaacagtaggtgtgagatagcaggtgttagaaagcatccttggcaaatccaagagcttgtgcaaaggccctgaggtagcaacagaaacagggttgagtggtcagggctgttggtttggaggattcggtgtgagatgggctaagaaaagtcagatcatgtcaggccttttagccatggtaaggaatttgggttaccttatttctaacttttacagaagccctacaaagtagaaaggattagccctatttttttttttttttaagatgaagtcttgctgtcacccaggctggagtgcagtggcacgatctcagctcactgcagtctctgcctcctgggttcaagtgattctcctgcctcagcctcccaagtagctgggattacaggcgtgtgccaccacacccgattagctccccctcctttttttttttttttttttttttttttgagacaaggtcttgctctgttggccaggctgaagtgcagtggttcgatctcagctcactgcaacctctgcctcccaggttcaagtgattctcctgttcagcctcccgagtagctgggattacaggcatgtttcattatgcccagctaatttttgtatttttggtagagaccacctcactatgttggacaggctgatcttgaactcctgacctcaagtgatccacccacctcggcttcccaaagtgctgggattacaggcatgagccaccacgcccagcctagccccatttttaaagaagaagactataaggtcacttgcccaggctcccacagctggtatgtggaaggacttgccatgaatttgggtccatctggcttctattaggttggtgtaaactgtgattacttttgcaccaacctcatagaaagcctgggttctttccatcagaccttgttacagaccaagacaggacttgagccttcccgagaaaggttaccgagaacactcaagccaggttgctgtctctctctccttttcctctgggtctgctctgtctccaggactcactgctttagaatagtaccatgttctgtcaccactgaggggagggggagcgttttgtgaccaagagtcttatcccaggtgtcagaagttctgcgctggaatcttagctgtgtgaggttcttactccaggcaatacacttaattcctttttgcctcagcttttgtatctgtgaaatggagacattaatagtgcttaatttgttcatttatagttttatcaagatgtaattgatgtaaataaactgtatttagagtgtacaatttgatgagttttgacatctgtatatattcatgaaaccactaccacgatcaagatagtaacacattcatcaccctaaaagtttccttgtgccttgtgtaactcatcccttctgtccctctcccatctctagacaaccacttacctgttttctgtcactatggattagtatgcgttttctagcattttataagtatgatatcagacaatagttgttcttttagatctaccttcttttgtgtgtgtgtgtgtgtgtgtgtgtgtgtgtgtgtgagatggagttttactctgtcacccaggctggagtgcaatggtgcgatcttggctcactgaaacctccacctcccaggttcaagccattctcccgcctcagccccccaagtagctgggactacaggcacgtgcgtcactatgcctggctaatttttgtatttttagtagagacggggtttcaccatgttggccaggatggtcttgaactcctgacatcaagtgatccacccaccttagcctcccaaagtgctcggattacaggtgtgaggcaccatgcccagtcaaatctaccttcttataatcagcatagttattttgaggttcatacatattgtgtgtatcaaaaattcatgccttgtttattgctgagtagtattccgttttatagatatgccacatttttgctatctattcacttgttcgtgcatagattattttctactttttggctattacaagcaaaattacatgtacacatctttgagcatatacctttatttatcttggataaatacctaaatgtggagtggttgggttgtatgggaagtatattgaactttatatgaaaccatcaaagtattttcctatgtgatttttgtgtcattttacttttcttccagcagtgtatgtgagagttccctttgcttcacattcttgctaaccctggggtggtcagtttatttacttatttaaaaatttttagctaatctagtgtatgtgtggacgcatctctaatgacggatgatgctgacagtcctataaacacactcttcccatatatctgttctcaagagctgataatctctccaactgtttgtctgtttgctatccatatatctctcttctgcaatgaagtacatattccaatcttttgcctctttaaaaaattggaatgtattcctattactgagttgtaaaagttctttgcatattttagatatgaattctttgttggatatatattttacagatattttctgagtttgttccttgccttttcttttcttttttttttttgagacggattcttactctgtcaccaggctggagtgcagtggcacgatctcggctcactgcaacctctgcctcccgggttcaagcgattctcctgcctcagcctcctaagtaactgggactacaggcacgcgccatcatgcctggctaatttttgtatttttagtagagacggggtttcaccatgttggcgaggatggtctcgatctcttgacctcgtgatccacccacctcggcctcccaaagtgccaggattacaggtgcgagccactgcgcccggccgccttttcatttttataacagcgtcatttgaagagaaaaggttttaaatttcggtgaagtaaaatttgttgactattttttcatggttcatgcttttggcatcatatttaagaagttaataaaggaagaaatccttgtcaaatccaagatcattaagattttctcctaggtttacaagaagtttagtagttacctcttatagtcaggtctatcatagtttcaagttagtttttatgtgtggtgtgagatgagggtcaaggatcgtcttttcttttttttttttttttcttgctgtggctacctgattattcctgcactatttgttgaaatgattattctttttccattgaattgccttggccccttcactgaaaaccaattcaccatgtatgtgtgagtcttttcctaaactttctatcctgtttcatttttccgtatgtctctacttatgccaatatcatactttattaatatagctttacaacatgtattcaaatcaggggtgtacatattccaattttgggccgggcttggtggctcacgcttgtaatcccagcacttagggaggccgaggcgggtggatcacctgtggtgaggagtttgagaccagcctggccaacatggtgaaaccccacctctactaaaaatacaaaaattagccggcatggtggcacatgcctgtagtcccagctactcaggagactgaggcaggagaatcgcctgaacctgggagggaggttgcagtgagccgagatcgaaccactgtactccagcctgggtgacagagtgactctgttacacacacacacacacacacacacgcacacacactccaattttgttcattttcacaattattttggcttttctaagtcatttttcatttccatatacattttagaaattttaacatcagcttatcaatttctgcaacaagcctgataggattttaattaggattgctttgaatgtataggtgaatttggggagaattgacatcttaataatattaaggtccccttcctccttcccttctccttcaacagagtcttgttctcttgcccaggctggagtgcagtggtgtgtgatcatagctcactgcagccttgaactcctgggctcaaacgatcctcccacttcagcctcctgggtagctaggactacaggtgtgtatcaccatgctcggctgatttttgtattttttgtaaagacagggtctcactatgtttcccaggatgggggaattgacttttaattttacataattatagactctcaagaagtgaaaatagaacaaagaggttctctgtgaggccagggttggtggctcctgcctgtaatcccagcactttgggaggctgaggctggtggattgcttgaacctgggaatttgcaaccaccctgggcaaaaaaatagattctgcatgccttttatccaacttcccccaataataacgtattatatagctatagagtattatcaaaaccaggaaattgacattggcacaatactatcagctagactaaaaaccttactgagatttctgctgtgagtttttttcatgaatggatgttggattttgttgaatagttcttctgtacctattgacgtgatcatatgatttttgtcttttagtttgttaatagggtaaattaccttaattgattttcaaatgttaaacctacattttatcagcctatgttacattattatttttatatatagctggattttatttgttcatatcttttaaatattttaacatatgtgtttgagggatatttttctgtaactttctttccttataacatcttagtctggttttatatcggggtaatgctagatttagaaaattaggagtgaaatgtttcttccgctcctatattctggaaaggtttgtgttgaattggttatatataattgtttggtagcattcatcagtgaaataccagttatctgggcctggaattttctttgtgcacaactttttaactgtacatttaattttaataggtaaaggtctatttaggctatctaagtctttatgaataatcttagtacttcgtgtcttttaaggatttgtctatttaagttatcaaattcattgccgtaaaattattcacaatatttccttattacctacttaatgtctgcaataactgtagaatgtactccctctcatcccttatattaataatttgtgtcttcttttttttcccttatcagtttttctagaggtttatcaattttattgagcttctcagagagccaccgttaattccattgatgtttctgtcaggtatcactgtcctgcactgtcaatatgtgaaaagtcttgtttcatatagtttgtcctttgagaaaagttgtgtaaggtgggaaggtaaatccaatccttgtcctcccatcataggtagcagcagacgtcctccgtgattttcagggctataaaggagttctgtggtgagagagtgggagaactctgttagctctagctgaactgtgtcctttcctgaggttactactcccatgtggccctctcaaatggtggatgttttctctctcacactttttgttttattattagtacaatgatagagtcatagattatttggtaacagttttactatgaaataagttttttaaaataatgtcaactcttgatttagataccgagggtatgtgtgcatgtttgttacatgggtgtattgtgtgatgctgaggtttgggtatggatcccaccacccaggtggtgagcatagtgcccaacaggtagtttttccacccacacctccctccctgactccccccaggtagtctgcagcgtcaactgttcccatttctatgtccatgagtacccaatgtttagctcccacttttaagtaagatcatatgggatttggttttctgttcctgcattaattcacataggattatgacctccacctgcatccatgttgctccaaaggacatgatttcattctattttatggctgcatagtattctattgtgtatatgtaccatatttgcttttatttttatttatttttatatgttctgagacagggtcttgctctgtcacccaggctggagtgcagtggtgcaatcatggctcacttcagccttgacttcttgggctccagcaatcctccacctcagcctcccaagtagctgaaactacaggcctgtgccaccattcctggctaattaaacaaattattattattattattattttagagacaggtctcactatgttgtccaggctgattacaaactcctgggctcaagtgatccttccaccttggccttccaaagtgttgggattataggactgagccaccatgcctggcccacattttctttatctaatctaccattgatggacacctaggctgactccatgtctttgctattgtgaacacatggtagctagtaatcccattactgggtatatgcccagaagaaaataaatcattctatcaaaaagacacatgcaattatatgttcatgggattactagctaccaataatgagaatggtagctctgtcaacagagtaaacagagaatctacagagtgggagaaaatatttgcaaaggatgcatccaacagaggtctaatatccagaatccataatgaacttcaacagatcaacaagcagaaaacaaataacctcattaaaaatgggcaagcgacatgatgagacacttctcaaaagaaaacatacaagtggccaaaacacatggaaaaatgctcatcctaatgaatcatcagagagatacaaatcaaaaccacagtgagatcctacctcacaccaatcagaagggtgattattaaaaagtcaaataaggccaagtgcagtggctcatatctctaatcccagcactttgggaggccggggcaggcggatcacctgaggtcaggagtttgagaccagcccggccatcatggtgaaaccctgtctctactaaaaatacaaaaaattagccaagcggggtggtgggtgtctgtaatcccagctacttaggaggctgaggcaggagaattgcttgaacctgggaggcagaggttgcagtgagttgagattgtgccactgcactccagcctgggcaacaagagagaaactccgtctcaaaataaataaataaaataaaaagtaaaataataacagatgctggtgaggctgtggagagaagggaacaattatacactgctggtagggatgcaaattagttcagcccctgtggaaagcagtttggagacctcttacactcttggtgctgcaggacctggaggccatgtaggcatcttcctcccacctctttttcactcccaggccattgtcatccatctcatttcatcttccctgaaaaccctcctgctgctttgagcctcatgccttcaagcttctaccacctgttgccttttctcattgcaattattacagattgcctgatttgctctccctcattccttgaagattttagcacctggatcgctgtctctttctgactctctatctgtcgtaattcatgatggtttttaatatccacacagagatcctttcaaaacccaggagtaccagcgacattaagtaacactctgtgctgttacaaaccaacctggaaatctcagttgcttaacccaataaaagatgatttcttgcttgtgccaaatccaatacacctctatggtacttacctggctataccccatgcctgttcaaagccaactttttactttctgaaggcttatatctcgcagcccagtgtggctggagaaaaacaggtacctgtgctaactggtcttattttaaatgtatgatccctaccccaggccctggtgctataagattccacacactactctgtccatacctgtgccaaacaatatcatgtggtctcctctttcagacagctcctcttcctcctccacactctcagcttttggccctgcttcttatttctctgggggaatggaacaaatcagaagggaatttctgcatgctcccagcagcatggctgcccacccctctgtgtctgcacccacacggcagccttccttccagttctgtggatgacctgtttgtcctggctgcaaccacccctttccttgtgtgccagatcacattccttctcttttactcaagggcatcactctgcaattattccctctccctccttcaaccttagatgtttcctgtctattggatgattcctatcagcgttcctattgttcataccctatctatctgtagtattccctatcttgaaaaaaaaaagcctttcttattgctactgcctgtctctctccttctgtctgcagcacaacagcttagatgtaccacattgtcttattcattttttctggttactcccctccagttcactcttaagctgtctggcttttgcctttactctgtgggaaaagctcttgttaaggctgccaagtgcaatagttgagtatctgttctcatcttactggtcgatgagtggcatttgacatgactggctgcctcttcctcgtgaaaccgctctgtcctggctggctccttcctcagagactgctccttctttgtcctgctaaccccttaaggctggagcgcccagggttcggtcatcatcttctccgtttctctacccaaatgctccctggtgacctcttagctttgcacactttttacatgctgatgacctcaaatgtgtaattctagccctggctttcccctggccttcagatgcatctatccacctgagtgtcagatatctcggacttaagcgtctgaacaagctgttgattcatcacctcttaccaagctgctaccctaatctttcctgtctcagaaaatggcaactctaacctgccccggtgcctgggagtcatcgtttattgtattttttcttctcttccctcctttaatccatcagcaaacttgtggctccaccttcaaaatagatacagaagccatcaacttattcgaaaccttcactgctttcactagagtctatcccaccctcacctttctcctgaactgttggtagagccctcttttaggatttctttttgacattcatcaccgaatcgctgaaagacccccaccagctcctgttctactcaaagtctagaagaccctgctgggtctggctcttgccacttttgtgacctcagcccaacagaccttacgtccagcagcccagtgtggctggagaaaaacaggtacctgtgctaactggtcttattttaaatgtacgatcccccgctccaggccctggtgctacccagagattctgcacactactttgtctgtacctgtgccaaacaatgtcacatggctccctctctcgcacaagcatctcctgctggcctgctctgctccagctgaagcttgaaccctgcactcctgcctcggagctttggcacttcctgcttcctctacttggtatgccctttcccctgatatcctgaggctccctccctcgtttccttcaggcaatgcctcaaatgtcaccttctcaaggaggctcaactcagccaccctacaaagaacaggacccctgtccccacatcccttctctccatctccctcctctccactgcccggccatctgggggctgctgtgtcttccctgctggaatatcgggcaggtatgtggatgctggttcactgccatgctccctggagcatagaatcatgcccagtttgtcatagggactcagtacattttattttatttatttatttttttgagagacagagtcttgctctgttgcccaggctggagtgcagtggcacaatcatggctcactgcagccttgacctcctgggcacaagtgatcctcccacatcagccacccaagtagctgggaccactggtgcgcaccaccacgcccagctaatttttaaaattttttgtagaaatggagtctcactatgttgtccaggctggtctcatctctaactcctgagctcaagcaatcctcccgccttggcctcccaaagtgctgggattctaggtgtgagccacagtgcttggcccatctttgtagcatgaataccttttagctcatatcctcgattagtgacatagaaataccctgccacagtgtagcattggcatttaaatgccctcctttaatattacgtttcagaaattaaatatgatgactaaaaagaatcacaagatttaaatatgcatttttatggataattagaaaacagtcgatgctaattttgaaaaattcaaactctacagaaatgcataataaaaagtgaaagattgtcttttccatgttttctcccatcccgcctcccacaggcatacacgtcttttgatgatgttgtgggcatcatttctctgtagagataaaacacatacatgccaacatttttaaaaactggtatcttgttttgtatctagctcacctttttttacttacttaaaaatatactgaagatctgctgggcatggtggctcacacctgtaatcccagcactttgggagaccaaggcaggcggatcatttgatgtcaggagtttgagaccagtctggccaacatggtgaaaccctgtgactactaaaaatacaaaaattagctgggttttgtggtgtgtgcctgtaatcccagctactcagtaggctgaggcaggagaattgcttgaacccaggaggcagaggttatagtgagccaacatggcaccactgtactccagcctgggtgacagagcaagactctgtctcaaaaaaatatatatatatatatataattttatataaatttatatttataaatatatatttatatttattatttgtttatttatatttatttattatttatatttatttataaaataaacaaaatatatttttataaatataaataaacaaatatataaatataaatatatataaatatataaaatatttagaaaattatatttataatatttataaaattatattcataatataaatatatatttatatttataattataaaattatattcataatataaatatatttatatttatatttataaaattatataatatatatttatattataaatattataaatctatggtatataaatattttatatatagatatataaatatatctcaaagatctttctatgctggtgcctctagaccttcagaaaaccctctccgaggctgtggtgggtgcccagcagcgattctgctttgcccctcctcctttttccaggggcatgtttgcttattaagctcgcagtttaagagcccctccctggaaagtctggattctcagagcctctgtgacattgcccacttcacacccttcacagaacttttccacacagttttccctttcctcctgtctgtctgcagccttgctgcttgtctgcctgattcattggatgacatattccttggcgactaggtagtgtgtgtcttttgtagtcttgtgtcctccatagttgtgggctcagcggatggttgttgggtggatggacggataaatgggacaatgaaaagatgagcttctcttctgttttctccctgagcagcagttcgcaatgcttcgtgactcaaattgtgcaggtttgctggccgggcgtgagcctttttattttagtccatcagggaaagtggctggctcattcagccacagtgtagcattggcatttaaaaatatatcaagaatgacaataaagattagttaccatttattgagtgtttactctgtgcctaaatgctttatgtacattatcttctttactttttcaacaatcttgtttgaattaggtcctattattatctccattctgtagaacaggctcagagaggtgaagtactttgctcacaaatgcacagctaggtgtcatagggaggtagctaggtggtagcagagccaggattcgaaccagggctgcttgatccacagtccagcttctcaagcccaaccttgtacttctgtgatggggagccaggtttgtgtggaattttgtcttcctatagagactggctgcatttttaattgcagaaaacatgcaacctgtgatgaatagattaacatggcaacttttttttcccctgagaaagtggtactttaatttgcacataacattaatagtgaagagactgtctccagagtaagtagctcccctccacccctcccccaagcccttataggacttcaaaggggtcaactccagctctctcactgcttgatttctttgactgcttttctgctttagcagtgagaaggcaatgagaagatggacttgtgagaattcacccaggagaataagcaactgggtctcaagtgttttgttatgtaagcagtaaacactgtggacagcatcatctactgtttgtcaaactcagccctgggttctacaaaactgagtttaaaagaaaaaaaaagctatctgtggagattttgttaaaggttccacttggttagcatgcttgcaatgcacactgtaacaaagctttaatataattaaattttaaattccatgtagaatctagtgggtaggcagatgtaccggtatgttaaactttatgtcgcttgaaaatggttttcaagtacatcagagggagaccatccagctgtaaaattatctgctttatgatgccgcatcacagctctgatctttttcttttaattaaaaatgtaccttaaagttgaaccatccccactctctgctaccttttcttcctttctgtctaccgacagaagatgaagtagcatgactgttctgtgaaccttcggggatgtttatgcaggaaataacttttcaattaaatattaatttttgtggctcttcagctggactcggcccctctgcaggccaaagggtagctccctctgtatatggtgctgtccaggttgtgaggcctttggttggtcataccttctaacctcttgcagccagttccagaaatcaagagtcatagaaccttgcaaaggtgaaaaggtgataccccctgggctcttcctgacttgccaggtgtgaccggcttcagaaggcatctgttctcacagtggcatgtcagggtcctgctcctgtcccccaaacacctttcttactatagctttctaatgtctgatttcttttcctggagaatgttatctctttaatttgaggtctcattctctgttaaaatatggaccactggtggacagcactcaccagtcattatccccttgtcatggctaacgtctccagatcgcccatggaagatattggatgctggtgcccaggaaatggccttggcagaggggaaaagacatagaagggcacactaggtgcagggattccccagggctggctctaggtgtggctaatgagcagtcgtcagcatcagcacactcagcgttacttttcaaatgagatcagtcctaccatgcacctactctggagtctggcacgcagcaagtgctgggtaaatattagctattattgagattatgaatattttattactctaattataatcagatcctggtaggttcttttaagtatccttctggaacctgccagctggcagaaggatgagagacaggcaatggttacatgactccgaaggcctattgactggtcatcagacgggaatggaacttatggatcatctcatttcatgctcctacttttgcagaacaaaaccaggggcttgtggtagagaagggcctcagttagggacacacagcgagccatggcagagttgggtcctctgacttcccctgcttttttcctgatgtcttggctgctcccacctcacgctagcttcctctgtgctgggaagggcccttgctaagctgcttggatccagctcttcctggtaccccttctgttactttgttggggtgagtgcccagatgttcctctgcagtcttggagagccctgctctactgccagcaccctcccaggctgtgggcagaatgaatggccaaagagggtgtccctgaaccttaaagaaccttccagtttccagcagcctctctgctttctttcaactctgctaagcagccagtaccattcactccctgtagcaggaaaggtccttttttcctctgtgctggaacccagttgtgatgagactatttgaaagcagtggtccacgaactgcaatgatggggagactaccacccagctcggcctccaggtctgtgatgatgggcaggtgatgtcccctctgtgggcagaaggtgctgctctagtttggatgtttgtactcctaaacctgttacaatgggatcctaatgctggaggtgggacctaatgggagatgtttgtgtcacggggtggatccttcatgaatggcttggtgtcatccttgcggtaatgagtgagttcttgctctgttaattcctgtgaaagttcctccaggagctggttgtttaaaagagcctggcacattccttctcttcctggcttcctctcttgccatgctggctccctttagcattcatcatgaatgggagcagcctgaggccctcaccagaagcaaatgctggagccatgcttcctgtacagcctgcagaactgtgagccaaatgaacctctttcctttataaattacccagccttagctattccttttaagcaacacaaacagactaagacaggtgccttccctgaaacacgagaggctggacccattggctttcatggtgcttttgggccacacacattgattctaatttggcattttcatgcctgagctgtctcagtttctccagtctaaggttcacattggggaacctggatctagacttctctccctccaggtgaccccagagggaagacaggctgctggactaagtgcaggcccctccagggaccatgaggagaaggaacaggtagaaaactgagcagagaaaaccacggggtgcagctcccatggtggaaggtggggtcgtcagcagcaaggcggggtgggccgagactcaggcacactccagggagtgagtgtgaggagtgagcccagccctcagaatcctgggctaacagccatccatggtatacaggtagcagcctccattctcatcagatattatgtatttggaaaatgaatcttatcctcaagtattagtcactgcaagaagcaaaaaccttccttgagacactttggaatgttccagagtcaatgttgtttggagtaagatgtatgaaaccaaaattaatgacattttgcacacccagacaaactcctaagtgccacccattggctttctcccatctctgggtgcagcctgcttttctggtcagattattctttcgggcagtgcaggatctccttccgccaggagctccttccaataccttccaacctccaactaacactgaggttcttctcccaaaggattcaggatgccctgggtattgtgtcataccatcttcttaccttttacagtgaggtcattgcagaactactcagctatatagcaaacactccctttcctagtgatgggataaaagtatttatggtctacctgaaaatgttgacttttagggattcagataaagtagttaaatgtcaacttatactaagtgtactaatttcattgtatgaacgcatataaagtcatatgtctatacactaaagtatttgtagaaatatggcttttttccccatcctttaattctgtgaaatagtttctattcaagttcttcctgtgcgtgttgtcatccacaaagccactctgtgtgtcatcaaacacaaggacatttttacttctctgttgtttgagatacaccactttttgaatctaggtatgcaattttaattgcatctgtcttaagtcaggctgccgtaacaaaataccacagactgggtggcttaaacaacagacatttattttcttatgttctggaggctggaagtctgagatcagggtgccagcatggccaggttctggtgagggctctctttctggcttgtggacgactgccttcttgctatgtcctcagatggccttttctaagtgtgtgtgtgtgtgtatgtgtgtgtttgtgtgtatgagtgtgtgtttgtgtgtatgagtgtgtgagagacagcaagagacagagcgaaagagagagtctcttttcgttctaaggccaccaattctattggatacagaccctatctgacctcatttaaccttaattacatctccaaatccctatctccacacagtcacactgaggccactgagggtaagggcctgaacatatgaattttgggggacacaattcaacccctcatgctatcaggaccgatatatataacactaggcaggattagaagatttgccttgtcggtgtagtttgtggcttcagtgttgtgaggacttactctcattttcagaactcgttacgagacttgtttatacagatattaggacttgcaattgtcaggtcacaccactcagaataattactaaaaactgtgtcaaatgtatttgcttccttctaccagtcctgtctggtaatctctataagcatcccaaactagtattgattgacgtcattttggctaatgggtcttctccaaagagtactttattgtttaaagtagagccattgagaatgttccctataatttgaacaaccctaagaattcaactttaagctggtcatttgtcctccacaactacctggtgaggcagcacttgctttttcttcccatgttacaaatgcagacaggaaggccgagtaacctctcaagctctgcagcggttgggaggctgagctggccttgacctggattcgctttcttctagaattgggtccctttcggtgcctcactctgctctgggggaagtaagggagtgaggttcaatgacgtggccaagatctttcaggggacgaggggcagactgagtcctctatccagggcccttctcaaagccatcatggatctcttggaagtattaaccccaaggggtggagatgccgcctctgagctcctgtcaccttcccaggcccgggagggagagcatctttccgcaccgctcctctgcggcttatgtgggattccacgtgcctctttatcttgcattaaataatggttttagtgggctgccagcttattcatctattgtatttatggaaactactaaagacttcaaaaaagggtttaattcaatgtgaggttctatctttgaagaaatttgtttaatagtgcagggaaaattgggcttttaatacaggaggagcagaacctgctctgtaacttcagagagaaaatggaaatcgagacgggaagtaccagagaagccactgggcttggaaggagggtgacttgggaatgagctggagctgggcccaagtaaagcccttcctagccttccctcgtctctgtctgtgtagggaaggcaaagacacaggaaaatgacagcttagtgtccggaaccctggggtcactgcaggagctggactccagtctgattgcatagagctgtagtaacccatgagtctgtgagcacagaggggccgggacgattgcagtcatccgtgtctcccgaaagcacagtgcctgtggcttctaggctgcaagcatgaagcctcccattgcagaggggaagaggctgcccttcagcgaaatgtggagtgggctgaggggatcttgggtacggggttttaaaaaacgtaatcctgggttcaaatccctgtgctgccctctatgacctgtgacctgggtcagtttctttatgtccctgagctttggccttcttgtctatgtagcagagataatctcaaccgtctaggtggtggcatgcatgaatgatagcttctatttactgaacacttactacgtgcgtggcactatgcccagtgctttaattggatcttttttttaaaatgggatgattgtaaaggccgggccgaggatctcccctggggatgggcagtcatggtgcttccccgccctgggcagctgcttattccagaaattgccgtgggcctgcaatcctgcttgcaacacccctcgcagcaggagcttggcagcccctgaacccggtgcctgctcatgagccagtctccctcttggcttatgtagatcaaccagagccttgggatatgagaagttaatttccacatatcctggagggggaagaagcacgtatgaaagaagtgaagagataagaatgtgtaggaaggttatctttcaattaagaagggcagtaatgcttcccatcaagagtcctgtcggggaaagtctgggaatatctgtttcggtgctttgctgagaaccagttaggtgaattctgtgctggtggacactgccgcccagcaggacactcatcaccatggccttccttgaccccggccacgtcctgccggctcctcctccttgaacaccaaccatcaggttgccaggacctgtcccctggggctgggtcctcactgcttccctgggaccggctgtgtaggggttgatgtgggcagtcagagggggtagggagagaagggtttggcgtattgcacacacacaaacacacactcaaacataaaccatgcacacacacacacttgagcatcatgcacacatatataccacacaaatatacaccatgtgcacacacaccacacacacatataccatgcacacacaaacacaaagacacaacatgtacacagacactcaaacatatgccgtgcatacacatacacatcacacactcaaatatacaccatgttcacacacatcacacattcaaacatatgccgtgcacacacacagaaagttacagcacgcacacacgcactcaaacatgcaccatgcacacacactcatacactttgcacacacactcaaatgtatatcacacacatgcacacaaaaacacactcatgtacagcatgcacacacacaaacacacactcaaatatataccacacagccaggcatgatggctcacgcctgtaattccagcactttgggaggccgaggtgggcagatcacaaggtcaagagattgagaccatcctggctaacatggtgaaaccccgtctctactaaaaatacaaaaacaaaattagctgggtgtggtggtgagcacctatagtcccagctacttgggaggctgaggcaggagaatggcgtgaacccgggaggtggagcttgcagtgagccgagatcgtgccactgcactccagcctgggtaacagagcgagactccgtctcaaaaaaaaaaaaaaaacaccccaaatatacatcatgcacacacattcatataccatgcacacacaaacacactcaaatatacaccatgcatgcacactcacacactcaaacatacactatgcacacgcaaacacaaacatacatcacacacacgcactgaaatatgcaccatgcacacacacactcatacatcacacacacactcaaacatacaccacaaatacacatactcaaatatgcaccatgcacacacacattcatacaccatgcacacacacaaactcaaacatataccatgcacacacacactcatacaccatgcacacacacaaactcatataccatgcacacacacaaactcaaacatataccatgcacacacacattcatacaccatgcacacacacaaactcatataccatgcacacacacactcatacaccatgcacacacacaaactcaaacatataccatgcacacacacactcatacaccatgcacacacacaaactcatataccatgcacacacacactcatacaccatgcacacatgcatgcatagaaatatgcaccatgtacacactcaaacatacatcacacatacaccacacactcatacaccatgcacgtatgcacacaaacacacactcatacaccatgcacacactcaaacatacaccacacacacgcacacacactaaaaatacacaatgcatacacacacgacacaaatgtacaccatgcacacatgcacacacatgctcacatatgcaccatgtagacacacactcatacatcatgcacacacacaccacacactcacacatacaccatgcacacacacaaacatacaccaagcacatgcatacacatactacacagtgaaatgtatgccccccacacacacaccacacactcaaacatacactacccacacacatacacaccacacactcaaatatgcaccatggacataccccaaacacacgaatccaccccctccccccccgccacgctccccgccatgctccttcttctccctgtgctgggcttttggaaagagccaggggtctgcttttgttctgaatccccatcctgctgacttgccaccggggtgtctttacctatggggggagtgggtccagtccccacgttgccaccttctgagtgagcaccaaggccctcccattgcagttggatgtggccagccggcccattcagtccaagtgcccaggagcccagtgtgcccttcctttggctctagctcctccctcccccatcaggggaccactggggcactaagtgtggtggcagagggcaccatgtgggctgtgaccacctctctccagcagactggggggtgcctgcagagcactgactgccagtgggcaacattactctctggcctgcctcaccattgggctgtctgttcacttgcttctcccagctcagttgtggtctctgaggtaggtcagagcctgggctggcttatcaccaggtcctgggcacctgctcaggatggagcacagagaaggccttgctggcagctgtcaggggtgcgtgtgtccagtggagtggggcttcctgccctgtgggcacattcccgaggtacgggggcctggtgtttccacaatcatccactcccttccagctgcccagggattggggtgtcggggcgtaggggcttctctgggggtgggtacaagtccctacttgccattccccagctaaactgccactgagtggagagggcggctttccccgcagggaattgggagtcccagatgtctcccttctgcgcttgggaggggtgctcctccctgaaggacagggtttttgcttctgagcacatgggccttttgcttctgagcaggagaaagactttctggcagggcaccgtggttcacggaaggttctgaccctgcaggtgggcttcggcgagactctcacgcaagggactttgctcattttctgcccctctgctgccatcaaatgtagcagaaaaaaatgtgtgtccctctccagccccttgctgtaggaatgccagcttcggctcaggctggtagtctggtttcgtaacggccgtgtggccgcgggtcaggtgcttcacctttgggcctgggataatcatgccacctcctggggctgctgggggatccagtgagctgatttccatgaaggcggaatgttggcgatgcgagtttttagctagtccccgacacacactgagaacaggaaacgagccactgggtgctcagctctccaagcacggccgtccctgagtgctgggggatgggcaggtccagccatgttcccggaataactccggcctgggcggcggccagcaggtcagagctgggccagaggtgccgacggtgcccagggtaaggggatgccgggaagacgttgaagacaaatgtgtgcctgtggggagcagcatgtttatggcaaataaaactcctgataacgattcacgaatcctggcagccctgccttccttgccgtacctgggggcttgtactgccaggggaggcttcgtctcatttccttcactgctggggaaggactgcccaggactcaaacaggaaaactgagcctcggagacgttcaactccaacagggagcagcagccgctgctgttcggtcgcccagcggcctccctggaggagagtccctcagtgatgcctcttcaaaggctctgcgtgctgcccactgtccgtaaggagtgaggcaggtgtggtcagagtgcctggacccgcatcgccctttgcctccccagctgcaatctcacttgctcacttggggggctttggctgagctttgcaggttggcctggaccggcaggtgggcacaggcccattgcacctgactgggtgtgattaaggaaacaggaatggaaatgcttctccaactggaggaagtcagaaagccacagggcatcctcagacgaaacccctgcttcctccatcagagcgggggcaagcagatggggaggggagatgcttttcctcagagacaccaatgcctctacacccaggcctctccatgcaggtgttatggacattccaggctggataattcttcgttgttagggccatcctgggcatggaagcatgttgaacagcatccctggtttccacccactagatgccaatagcacccccgacaaccaagtgtgtctccaggctttgcccagttcccttgaagggcagaatcacccctcaccgagaaccactgctccacccaatgcaaagatgtaactctcggcatgtttaggaccaagtattgggatgtgcagaaggacgcgcaggacgtggaaccctgtgtgcttgggtcgtggccgtgccttccggatgcttcgagggaaatgacctggctcctggtcagacataaaagtgggaagtgtattttccctctgatgttgtcactactggctggtgccgcagacggactcagaaagcaccgtttcattttgctcgagtaaagaaggcaggcgcagagtgctgctcatatattgattgactcatcaaatgatctgctgcagctgcctgcatttgtttacagggcgaaaattaatgccacagatgtttactgtataataggatttgaaatctgttggggggagcacccgttgaaaccattgggccaagaatgagaaaaacactttgcataaaggaggatttggttcactaagtagcacacggtgcttgctgtcaaatgctaacaagaaacatgggcctcctctcccttggccagcgctggcgttcgcgcctggctccctggctttcttctacactgtgctttgatgtggcaccttccaaagtgttttcatgatggagagggcttcctctgaaatgtagcacccgagcctaattaactgatgcgtgattcttcattagcatctgggcaggcctggggcccccagttccctttccttcctcggcccctctttgcagcgggcaaccctggattgcccagcgaggctgcctggcccttgggtgtctgtgtctggggttcccctggtgaccccaccagctcctgttgtgtccctgccttccactgcctggagccaggtctctgaatgaatatagccatcctccgagacgggagctgctttttcttggcacagcatctaagccctgcaaccctgagtgtcttgacggcacagccaattcctcgctatgcccaagggcttttcccaggcatcagggcagacagggacccccagtgcttcttagagcctcctccagaggaaatggctttggggtgtgtctcccagtcgaggacggaggacatggcaggctgctggtgctcctggtgaccattgggaggccctggagggagcctccttcccaggaagtttccttccagtgggttcgagtgtgcatactccgtttgtattttcactttccttatgtttttctcttcagccagctctgattggattcaccacagattaacattttccattatacgttataatgtgtttttttaaaaccaaatctcccttcacagattgctgtctttataatataggaattatttctcagtcactttaaaagtcctgcttcattagcttggtgactgtttggtaatttgcaaagtcactttcgcaagttttaatactgcccggttgaggatcacagcaataaatgtattaggtttgaatagtgttatgattctgtctgaagtgaaaaaattagaatcagtcattagctctgacctcagcatcagcccacaccgtgcaggagatgatgcagatagatgatgcgatcacagcctccgccatgggaagaatcctgggtaaggccttggagccctttgtctcagctctttgccaagactcgaagcagtagctcctacatctccagtaccttccacgtttctgttctccttagagtggcttaaagctcccccttccatataagtctctcatgtctagactcagccctccagggaaggcaaatggagactttgaagcccccaaccttgggctccccctccagcttttttgacagatgatggtacctgctgagagaatgtgaccagaggctttcattgggattttgggggccattctgttttcttcctcctcctgtgttgaggccatctctgagccatgctgagaaaacagggaggttgccaagggcagagatgtccagcccctgctctgaggctgtcaagtgcctcctcagggagaaggggagggtgcgcattgctcgattttgctcaattcccagcaggcttctccacctcccaggaggcgcctctgagtccctcccagcccgagactctttccccctggaagagagggtgggcaggctcggggagaaccccagagcctcatgtggccatgtcgtgtttcatttgccctgattaatttggcatctgtatgaaccagagggagtggtgctcgaccctaacctttcacagatgttccaggccgaggttttctggcaaaatcgattttgacattttgataagaaccgttttgctgtgttctgtattttgaatctttgactctaagctgttctgaaaaccagctgtgaagctaaatcttgtttgtaaaatctgcatactgcatcagcagcagaaaacgccagagcctcgaggtcatttcatagacacttgaagcaagttaggtgggatgcgaggatattgaattgcggtggtttgtcagacttctgccatgggaagcattgtgagagatgcataatgaatgtcttgaaccctcttctgtctcttgcagtgtttggaatgcaaaaaaaattagacctttaatggaaagatttggtattcatgagaaagacagagtccctactacttaggaaacttggttgccttgtaaaacagaacatctgtatcaggagcacggtgatcttttgtcatttggtataaggaaaaaaattaaacattggattggaaacatttgaggtcactgtgtaaaaggcacacacctgctgtccaaactgaagttctcatttgcaagcgttatttgagggggaaaaggagtggtttccaaactgccttagcttccaaagaaatggcttgcttccctgcctccctgcgtacctgcactcagaaggaggctctgtttcctgcttcactgtcggagacctcctgaagaaataacacaaaccgacggggacaagcagagtatgcaaggagaaaggtccagagcccaggcgggagggaaaagatgaggcgagtgaccggcaacctcccacctgctctttctcacagcagacagccagtgggaggtgatctggtgggcggggacattgcagctgccctagggctgcctctgacatgagggccactgcaagttcttgaccctctttgtctttcttccaccgtgggtcccttgcatgacagggacgcattctaggtcttgggagcatttcatgaatgacagtggacatgctgttaaaaggctggatgtggcccctgagaaggctgcatggtgacaccaaacaaagaccaaaggaaccaggagccactaggcctgggctccggccacgattctgctcctggcttcctctgtgatgtgggcacagccatctccctttggggcactgggtgtcctgtgtgtacctggggacagtgggatggatgagcagggccctggaatttccgagtgcctgtggcaagccattgttttctctggagcatcactgtacagttagggtgggtttgtggcaggtacttagagaagtcctagtaggagacagcagatcaaaatacagggagatgctgggatccacccactttatagttaaggggtaccctttctagagtcagaagatgaacagattgaccctggaggtaacccccacccgagactcccgtctgtaggtgttgaggtttgcatttgatagcaggaaaaggtgctattaagatcctggagtcattgataaatgaggggtgcatcagtgaatgagcctgtcttagatttcctctctttttcctttgtgaggtcgatggggtttatcttcagctctccaggcctcctcctctgtcccctttccaaccccgccatcacttcccatctctgggcacttagatctttcactgctgtccacatccctttctggcaggagaggatctgagaaattgactcacactaaggcaataatgaatttatgtgtaatctgtcctgtgcgtgtgatacttgctctaaagaggactggatgaagagagtacgcttgcctgaagggaaggggtgctgatggtggggttccaggcatgtgacacccacccgagttccgggatgccctcctgtcccccacaccagcccggaggctggaagctcttgggaaaggagactggtcaagggcttgtgggcagtctctttgggtttattggactccaaatctttactgtccaggagttaaaaggtgatattcttcctctcagctcctcagggagtccatggtttggctgtggggagagcaggtctgtttccctgcagagcccctccccactccagccgggcttgtgggtgccagcatggagcctgcagcctctgcgtgtgcacatccttcattaaatatctctcctgtcctgtgggcagaacatcccctgaccagtttgcagtctgtccacactgggcccttctccagccaggatgagtaaaaggtacacggctgaacatcagtgccagtgagtgagaggctacagaggcacggaacaggatggtggcagagaggtccctgggaagcctgtgccggggcagcaggggtgtggggggctgtgggccggaggaggcagcatcactgtggacaggcaggaaggtggcctcggggggaaggggacagggcagaatgagcctttcccaaaagtgagacactcaaagcctcgtcatgccgggcagcgcccatccctgcctacctgtcccttttgctgtctcggagggagcctgtgggagggaggtcgagatcccagcctctgtgagggcaccgttgggggggggattgggcagggaaaagagtggcgcccacagagcaggacacggagaagccttgagctggaaataaggaggccaatatctaggcctgacctgtcattaacgagccatgaggcatgaggtctttttttttttttttccaagagatcctcccacctcagcctcctgagtggctgggaccacaggtgggtgccaccatgcctggttaatttttaatttttttagggaagaggtcacaccatgttgttcaggctggtcttgaattcttgagctcaagtgatcctcctacctcagcctcccaaagtgctgggattactggcgtgagccactgcagccagtgagccatgaggtcttgagcaaggccgcccctctgttagaagtccccttctctatgcctcatggttccacagcctggggtaccccagctccaaatgacacatctccctgcgtttgctgtgcacgtgcctgggtgtgggtgatgctgatttctaatgcatttcttcattcattcagttccacatttatggggcatctcttctagagctagctctgtgccaaaaaggaggtataaagataaatagagcaggcgcggtggctcacagctgtaatctcagcactttgggatgccgagatgggaggatcacctgaggtcaggagtttgagaccagcctggccaacatggagacatgtttaatagagacatggccaacatgtctctacaaaaaatacaaaaaaaaaatagccagatgtggtggcacgtgtgatcccaggtacttgggaggctgaggcaggagaatcgcttgaacctgggagacggagattgcagtgagctgagatcgccccactgcactgcagcctgggcaacaagaatgaaaactccacctcaaaaaaaaaaaaaaaagataaataggagagggtctctatcttcaaggaacccccagcctagtggtggaagcagatagatacatgaatggtgaaagttaaagtaatgtaggcaggacagtgagagagacatgtgggatcagagagacaggcgaccagctggcctctgagggccagagagggcttctcatcagggaggtgatgtctgaactgaattcccttcaaaatgagctccctctgacctgcactgactattcacagatattctagggctcctaccttgtttgcaagaagctgagccacacgccctggtgaatacaaaatagggtaaggaattttttggccagttgcctgcagctttgctaatcctgattgagcattcttcataccaagaccaagacgatttcagaagtatctgtagcatgtgtaacttctgtccttttgactgttttggggacgacatttaattttatggcaagcagatcattcattatttcagatgacccggatgggctcatactttgaacagtttagacagtcttgtcttcactgctagccctattcctttcttgctaagtcctccactaccaccgccatactcaccctggcttgctcctcttactgtcaccagtgggttataggccagcagaaactgtaagagacgggctttcagaacaaaaattcccaatcacctctctgttcccaagaaaatcagggatcagaaagaatttttatgcagaaaaaagtatttgacaacacttaacacaaaaattaataataaaaacttttggccgggcgcggtgactcacgcctgtaatcccagcactttgggaggctgaggtgggcagttcacaaggtcaggagatcgagaccatcctggctaacacggtgaaaccccatctctactaaaaatacaaaaaaaattagccgggcgtggtggcaggcacctgtagtcccagcgactggggagactgaggcagcagaatggcgtgaacccgggaggcagagcttgcagtgagctgagatcgctccactgcactccagcctgggtgacagagtgagactctgtctcaaaaaaaaaaaaaaaaaagcagaaacaaagaaacaaaaaacaaaaaaaaattttttagcaagttagggatagaagagcccattcttaatctgataaaaggtagctatcaaaagtctgtagcacaggcaaatggaaactgaaaccagaatgagatataacacacccaccctactggtgaaaattttaaaagactgaggataccataagctggcaaggttgtggaacaacaggaagcttcatacattattgatggggatgtagatggtacgaacaatttggaaaagtacctggcagtttcttaaactaaatatacatctattgcatgacccagcaattcctctcttggacatctaccaagagaaatgaaaacatatgttcacaaaaagacttgtatgagaatgttcttggcagttttactcatagtcactgaaaacagaaagcaactcaggggtctaccaacaggtgagtggacaagtggaggtatttttgtacaacagaatgctgccctgcaataaagagaaacacattttgggggccgggcgcggtggctcacacctgtaatcccagcactttgggaggccgaggagggcggatcacgaggtcaggagatcgagaccatcctgactaacacagtgaaaccccatctctactaaaaatacaaaagattagccaggcgtggtggtgggcgcctgtagtcccagctactcgggaggctgaggcaggagaatggcgtgaacccggaaggcggagcttgcagtgagccgagattgcaccactgcactccagcctgggtgacagagcgagactctgtctcaaaaaaagaaaaccaaaacacgttttggatacatgccacacacatggatgaatctcaaaaatgtcatgcagagtaaaagaagccagaaacaagagtacatgttatatgtttcatttatatcaacttctagattaggcaaaagtaattggtggtacaaaatgatcctaaccatggcttcctctgttgtgggtgatggtgtctgcaatttactgggaaaagacataaagtaactttcttgagtgagtacaatgcctgtatcttgacagatgttggattgcacagtgaggcgcatttgtcagatgtgtcccatgatgcatttgagatccatgcatttcactctgtaaaatttacttcaaacaaacaaactgcaaacaaatattgaactctagctaatgatatgcctttagacttgtactgatgttggcaatttactctgaaatgcatcaaaaaataaaatggatcgatgaatgcacaaaaggatggctggatggatagttacgagatagagcaaatatagcaagatgttaattatagaatccaggtggtggaaacaagggtttcctctgtaaaatgctttcagattttctgtatgtttgatagttttcatagtaaaattttggaggaaaactgagcaatctatctttggattcatgcacatctggtaaaactagattcttaaaaatgatgggaattttatgcacaaagatcaggaaggaggtttccctttgggttaggcttgctaagagtggggctcaaagaaatacccacagtggcttaatgtggacgattctagttcctaagttggggtgaggtgggggtggggtaatgggtcttcttttatttaaactttgtgctttataaatacagaacacacatctttctatgtatgaagtgttacgtactattttttttttaattatatggctcttaagttgttttctttttttaaaggaaatagtggggtctcaggagtagggcagttctgtttttaataggctttaaatggtttgggcctaagatgggctgcctttcatcaccagggtgagctagagttcaggagaattttgaccttatttgattgcaaaacttcaaagtgatgggcattttcagtatgcttacttttcaatgtgagtagaaaaacatacaaaccagaacagctggaatttaaactctggtaacacagacctcaagtccggtcaccttcccttctccctgtcagccagtgatctcactttctacttctccagcccaaacagaagacaggaaatcagactgtcctcacccatgccccacaggctaccgacttccctgtgtgccttccgttctccacctccctgagctctggatcccaccattttttcctcttcatcttcagttttgttttcgttcttgtttttgtttttgagacagggtcttgctctgtcacccaggctgaagtgcaatgacacaatcatagctcactgcagccttgaactcctgggctcgagcaatcctcccacctcagtctcgcaagtagctaggcctacagttgcacaggatcatacctggctaattaaaaaaaattttttttgtagagatggggtcttgctgtgttgcacaggctgttcccaaactcctgacctcaagtgatcctcctgccttggcctcccaaagtgctgggaattacaggcatgagctaccacccctggccttctggacaaatgtagaggatcgccttgcccctccgtgcctacttcatagtattgttccataaagattagaatggttcctggcacatagtacactttcagtaaaaaacttagctgtggctgggtgcagtggctcacaactgtaatcctagcactttgggaggaggctgaggtaggcagatcacttgaggccaggagtttgagaccagcctggccagcatggcaaaaccccatctctactaaaatacaaaaattagccgggcatggtgatgggtacctctaatcccaggtacttgggaggctgaggcaggagaatcatttgaacctgggaggaagaggttgcagtgagctgagatcatgccattgcactccagtctgggcaactccatctcaaaaaaataaaagctgttattattaatgacttaactctccctatcatatatcctttctatatcttcagctttactccccctgtccctccccaaatgtcctgaaattgtccaaagtggctgtctttaccttgtcacctggcccccaccaacgacctcctggttgccatcggacgtttctcagtcctcgtttctttgactatctcggcagcattgattggacactctgagccccgtttttttttcttgaaacagactcttccctaggccctctggagtaccatgcttcctggctttccttccaactccctgaccaccttctctcttctctttgtgacctcccattcctatgctcatcccttctatatttgtgatgctcaagattcagtccaaggcctccgttttccttactttaaaaactttctttgggaaatttcatctatttttatggattttgtttcaatgatgacacacagttctctgtctacagcccaggtagtaccactaagtttcagaacagtaaccccatttgactactgaccacttccccttggattccccacactgttttcctctctcccctgacatgcgtttctcttgggttctctttctcagtatatggtaccatccatttgagttctcctccctgctccaatcagtcagttggtccagtcattcaccacttgtgttgactgtacctctgatacctggaagtcacttctttctctctgtccttcttaagcccatctgagttcagggttccatgatctctttcctgtattgctgcaaaggcttcttcctcttctccttgctccctctcttgccctcctctacttcattctataaacctcaattctgtgtatgtcattccaatacttaaaaccttttagtgcctttcctctgctctcaaacaagatccaaactcctgaatttgttcacaaggcagcactcatgctggctctagcctctttccccacattcctttcatctctctgtgcccttttcctatgggctttcaggtctctgttctctcttcctgcagccctccttctccaccctgcacagttagctcctgctcatcctctagtgctcagcttcacagtcacgccacccaggaagccttctgtgatctgtttccttcactcatgcagcaaatctccattgagggctgatatggtttggctgtgtccccacccaaatctcatcttgaattggaactcccacaattcccacatgtcttgggaggtgattgaattatgggtacgggtctttcctgtgctgttctcatgatagtgaatgagtctcaggagattggatggttttaaaaacaagagtttccctgcacaagttctctctttgcctgctaccatccatgtaagacatgacttgctcttccttgcctttcaccttctgtcatgattgtgaggcctccccagccacatggaactgtaagtccaataaacctctttcttttgtaaattgcccagtcttgggtatgtctttatcaatagcacaaaaacggactaatataagggcccattccatccgggcaccaagggtggagtggtgaaggacgggcaagggtctcattctcagagctgacagccactggggaaaggcagtaaggggcaagcaatgaatctgattggctccaatagtacaatagcaatgaagaaaacagggcaaggtgtgcaacgccaagcttactgtgtgtgtctctctgtgtcggcaacgtcagatcctctcgcctgagaatatctgaactcaaacttgaaggagatgaagaaactagccctgcaaagattagagggaaggacagccctggcaggaggaacatgtagaaggccattgggcaggggcgtttcttgatgtgttagaggaatagaaagaaggccagggcttctggagtatggtgggtgcaggagaaagcagggagctgtcaggtcccaacagttggctggggcaagaccatgtatggtcttataggtcatggtagggagctaggattttatttttggtgcagtggacgccattcgaaggttttaaccaagggagttccacagttggacataatcctcatataatacaattcaaagagtacaatttgatggtttttaatatatttacagagttgtgcaaccattgccacagtgtgtcttagaaccctaatcagttttcatcatccccaaaggaaaccctgtacccatcagcaggcactcccttttccccccagcccctccagcccagggcaaccacaaatctactttctgtttctattagactgatgtattgtggacattttatataaaaagaatcatacaatgggtggtctcttgcaactggctttttaaacttatggtaatgttttcaaggtttattcatattttagcacttatcagtaagtactttgttcctttctatggctgagtaatattttgtggtctggagggaccgtatttcatttatcagctcctcagttgatggacatttaggttgcctcctccttttggctaatacaaataatgtttctgagaatcttcctgtatgagcttctggatatgtgccttcccttcccttgggtatagacataggggtggaattgctgagccatgtggtgactccgtggctgatcttttgaggagctgccaagctgttttccaaaatggctatgccattttatgttcacaccagaggtttagttttgaacgttttggcagttccagatctctcctgccatggaaaatagattgtaggcagcaagcggggaggcaggaggacctgtgaggcactaagggaggctggatgggcctctctgccttcaagattgtgtaacaatagtccctgaaaccatgctgaggagaagagtgaggctgaacaggaatgatggggagtgaataaaccatgtggttggaagtcctgctcagcccgagaatgactgggtgatagtcctggtgccaaagacctagagccacagatgctggtccgagaagaggtttgcagtggtggtttcagaggtggtgctgttattggtggctggaggtgtgggtggccaggctggggtggggggaaaggtcactggatggggggagaccaaggagcgggaggccggggggtgggtgggtcatcatatggatgttgaggtcatccagaatagtggcaggggtggacctggagaggaagagagtgacccaggcctggcagaacagagcaggcagcacggccaggagtccacagatggcagtgatgggaagcgagggacggcagtgatatggaatggcaccggcttccagggaactggggttttgatggaggaagcaggagaaatactttggaattggtaacagggaacaaggaggacatcaatttagctctaggctctgcaatacttggggtatgggagaaaagatggcattttgggagtcctagagagatggggtccttggggaatggcaggtttcatctgaggcctgacctgaaagcaggtggacaacggtgaacagtatgtcaatgatcctctgcgggacccaaagcaacatggtcgaaggattggggagggtgcggggagcaggccagggagggacagtgcctgtgcaggaattcccactatatgctcttagcacctgtcacatccttatcaagctctaccctaattactggtgcactcgttttccctttagactgtacattttgtgttatagagagcatatctttttattccttgctgtagctgcagtttctagcacagatatgctagcacctactatgtgctcaaaaatgttggttgaatgggtgagagaatgctgagctcttcccagatgccatcacaatgccaggatagcagttagctgaggtttggggaggagggtgtatagatttagaggcttccccactcctcgctccccacgtttcttctcattctgactctagtgtagaagtcaagtccatcctatattttatctcagaagttttggcaaataacaaggcatgcaatattgactaagagcctccaggatcccacaggccccagtgggccccattaccagctatttggaagttgaggcagacagactgaattgggtcgttgaaggagtttgccagtttgtggtgggaattgagttgaatttattatcatttttgccagcaaccctttgccacatatttatttaatccaaggattctagagaaagctaggggtttgatgggcaggtggctggatgccagcgtggcccgtgtttgggctggcacccctcactccacttggcgctttattccaaagctgtggcacccctgcaacacacagcagccagtgtcttggggtctatgcccgtgcctaggactggcccatcctgtcatgtgcggaattgggcatctggtcagatctcacaggaaatgctgaatttatatttgcagctttgaaagccagggagaaacagaaatggacagatcatttgaaaattcaaattatttgttccttgtttttgcagcgtttcagccagtaaggtttgtttcaccttcataaaggatgattaatcgaactaagagaagagccctgtctaattgtgtgtgggtgtgtttggggcagtgtgatcattggaacaccaagagaatgatgcagacaaatatttatgccctctttgtttcctatttcaatggtaacatcatctgttaaagtattgctctttgcaggagtatcctgcattagaatgctcgtccctttgtccctttcggaattgtcacttttctttatgagaaagtgtttggaaaagcttcttaaataaaatgtagctgaaaaatgttgaaagcacgacagtaataaagtagacatcactgcctagaaaaaacgatctgcttttgaaaagaaaaactacattgaaactggccaaatcacttcaaatggctagattgcaaaatcatcccaggatggatgaatgttgtcaacatagaaatgagtggttggagatcttcatttgaaatgcattattaattacttcataagatgatacctacagacaagcatagagaataatgtaatgtacagctgtttacccaccacttagctttcttgatcaaatcttaccctttgccccatttaatttgatttcttaaaaagaaagaaaacataatgtatacacataatcttgatctaatttccttccctctggccccagtgatagtgtttttcaccctcatgcttcttttcttttcttttttttggagacggagtctcactctgtcacccaggctggagtgcagtagtgcgatctcggctcactgcaacttctgcctcgcaggttcaagcaattctcctgtctcagcctccccagtagctgagactacaggcacgcaccaccatgcctgactaattttagtatttttagtagatacggggtttcaccatattgctcagtctggtttcgaactgctgacctcaggtgatccacccgtctcgtcctcccaaagtgccaggattacaggcgtgagccaccacgcctggccacatattttcattccaaagtatttgcaatacttttatcacatatttatgtatttattaacaatacatggcattgttttgcagattttaaaagtttatatgagaccatccaatattctcttgcaacattgttcttaagtgttagatccttacagagagatgatagagagagataggggtgtgtgtatgtaataggtattatgtatcttacatatgtatatcataacaagacatacatatatttctagttcacttattttaactgctgtatagaattttattgcattaacatttatatgctagtgtctctctaagcgggggggtgtgtttacttggatactctctttttttttttgagatggggtctcgctctgtcgcccaggctagagtgcagtggcatgatctcggctcactgcaagctcctcctcctgggttcaggccattctcctgcctcagcctcccgagtagctgggactacaggtgcccaccaccatgcccagctaattttttgtatttttagtagagacagggtttcaccatgttagccaggatggtctcaatctcctgactgcgtgatctgcctgcctcagcctcccaaagtgctgggattacaggcgtgagccaccgcgtccggcctacttggatactctcatattcctaaaagtggaactgttgggtggtagagtacctataccttcagcgattatcattgctgtccaagatgtttgtattgatttatggtcccaactacaagtggagtgtgtgatggttcccatttcttcacattcccatcacagactttgtcttcatttctactttccttgctacagtgaggctgagcttcttctcatagagggttattggccatttgggtttcttctgtgaattgcccattcttttccttgctattggattgtctgtcttttagttattgattgatttgcagggattcttaatattttctagaccctgatcttgagtttgctctatgcattacaactgttttcttcattttgatacttttaagaaagtgttcctaatggtgtcttggtgggtagaaattcttagttttgatgcagtttttttttttttttaaattgagatggagtctcactctgttgcccaagctggagcgcagtggtgcaatcttggctcactgaaacctccaccttctgggttcaagtgattctcttacctcagcctgctgagtatctgagattacaggtacccgccaccccgcccagctaatttttgtatttttagtagagatggggtttcaccatgttggccagactgttctcaaactcctgacctcaggtgatccacctgcctcggcctcccaaagtgctgggattacaggtatgagccaccgtgcccggacaatgcagtttaatttaattttattttttatgttagtgcttcttgttcttgtttactaaatctttatcctaatccataaatattatcttctaaatagtttaggagtttggtttggctttcacatccaagttttaatctatctaaaattcattttgtgtaggaaaattctcctttttttccgtgttggaaagaggtgtcccatgcattggatgagtcatcctttccccagtgatgtgcatatgtcaagtctgtccatagatgattcctgtcttatgtcaagtagctgcctgtgcgtagatctgtttctgggccccttatgccatcactgtagtcgtcagtttgtctattcttgtctcagcacaccatcagttcagttgctgtagttcactgtagcttggaaataagtcttcacaggtggttgatcacattctcctctccctcctaccactatatatatgttctgcatttcacctattcttggcctttgctgtttcatgaacattacggaagataatcttgtcaaaatcctcaaattcctatggggagattttgattggaattacattaaatctgtcagtttggtgagaattgacctatttaggatattgagtcttcttttttaaattaattggttaattaattaattaattaattttagagacagagtcttgctctgtcacccagtctggaatgcagtggggtaatcatagctcactgcagcctcgaattcctagcctcaagtgatcctcccacctcagcctcccgagtagctaggactacaggcatgtgccaccatacccagctaatttttacctttttggtagagacagggtctcactatgttgcccagactggtctcaaatttctggcttcaaacaatcctcccaaagtcctgggattacaggtgtgagccactgtacccagctgagttttctatctttgaacagaagatctatcttaggttaaacactaataatttattcttataaactttagcttttaaattgcaattatgtgttattttaaaaagtatattttctgtttgttgctattgtatataaattaatttattttttgtatgttgaccttatgttaggcactttggtggaatcttttaatactttgcctctagattctttgaattctatgtagataattcacactcaatgaatattgagagttctttcttcattctcaacccttagagattttatttcttattcttgcattactgagcagattagaacttctgttgtactagacttctattgtattagaagttctttttgtttgtttgtttgtttgttttttgagacagagtcttgctctgttgcccaggctggagtgcaatggcacgatctcggctcgctgcaacctctgcctcccaggttcaagcagttctcccatctcaccctccctagtagctgggattacaggcgtgcaccaccacacccagctaactttttgtatttttagtagagacagagtttcaccatgttggccaggctggcctggaactcctgacctcaggtgatccacccacctcggcctcctaaagtgctgggattacaggcgtgagctactgcatccagcaattgtactggaagttctgatctgcacagtaatgcaagaacaagaaataaacttgaagttctaggacagagaacaagaatagaactagaagtcctagtacaacttctagttgagtagaaatattaatagcaggaactcttgcctcatgtctgattctaaaggagattcttctagtgtttcatggttaatagtaatatttgctgtaggggttttatttgttggttggtatagtataaactctttattagatcaaggaaggtttcttctattttagtttgctaagaattttaaaatcacaactggatgtttaatattattgaatgcttttaatgtcactagtaagaataatcatatactttttctcctataatctgttaacattatgaattatagttattttctaatattaatctaactgtaatcctaggataaacccaacttgttcatggtttattatttttagacattactggatttggttttctaagattttgtttaggagttttgcgtctatgttcatgatttataatggcttctatatttcttttctcatgatattcttgtcagacttaatgtcaaacatgagtttgaggccatggaataattatgctgtggaataatttgtgtaagatgatgatttggattgttacctgaatatttaattagaactatttaagtggtaccatcatctggacctggtaatttttatctactgcttcttttttgtgtgtttacaagaatattcaggtttttatattttcttaagatggtttagataagtttttttaataatttgtcaatttcatttagactttttttttgttgaatggagtcttgctcatgccaggctggagtgcagtagtgcaatctcagatctcagttcactgcaatctctgcctcccaagttcaagtgagtctcctgcctcagcctcctgagtagctgagactacaggcatgcaccaccacactcagctgatttttgtattttcagtagagaagtggtttcaccatgttggccaggctggtctcgaactcctgactggacttgagctgggctcaagtgatctgctctcttcaacttctcaaagtgttggaattacaggcatgagccactgtgcctggcctaagcttctaacttattgtcatgatatagtcatatatcctctcaataattttttaatatttgaagcttctctggttatgttcttttcactcccaatattatcctttttaatcagaattttgtcaactgtattgttcttttcaaagaaccaacttttgactttgctgtttgtatctattttagatttgtttcctgttttgtgaattccgtttttatgctgttttcctactttctattctttgaatttattctactttccttcttctaatttcttaagcaggagcattggttcattaattttagctttccctcttttctatatgaacatttaaatgaacaattcctttctaaatatgttttagcgtatgttccatgtgttttaacatgtagtagtttgattatccttcagttcgcaatgttttttaacctccattatgatttctgttttgaattgtataaaatgggtttctttttttttttttttaattttactttaagttctgggattcatgtgcagaatgtgcagatttgttacataggtatacatgttccatggtggtttgctgcacccgtcaacccatcatctaggttttaagccctgcatgcattaggtatttgtcctaatgctctccctccccttgccctccaaccccgacaggccccagtatgtggtagtcccctccctgtgtccatgtgttctcattgttcaactcccacttctgagtgagaacatgcagtgtttggttttctgtttctgtgttaatttgctgagaatgatggcttccagcttcatccatgtccctggaaaggacatgaactcattgttttatatggctgcgtagtattccatggtgtatatgtgccacattttctttatccagtctatcattgatgatcatttgggttggttccaagtctaaaacatatttcttaatttccaaacatatagggttttttctgggatctttttgttaactgatttctaatttaagttttggtctgtagttcacttcattgttatttggacaatatgatgctagcggttttgaaattttttgagacccagtattggttccagcaaatatggaacatggaatgttttccattttgtgggtgccatgttctaagtgtttgtcgaatcaagtttgttaatcatgttattcaaattttccttatttttcctgattttagtttcagtttgacctatactgagaaaagtgccctaaaaatctccccttttaatggtggatttgttcagtttctcctggtcttcccttcagagctttcctttattgactacttcacttttgaaaaatgttttcaacctgttctcctggaacgtgaggaaaatgcagcttgttccttgttccatttgtccagtggccagttcaagaaaggttggacccacatctatcatttccatcagcagtgagctgttcagagtatgtgcaattgccttggtttggagacatggctgcacacatttaggactctggctttgctcaagctgttcccctgcacagaatgcctttaacctctcccttttccctgccccttgttcacctggtgaactctttctctttccagccctgctcaaatgttacctcctattacgattatttgtttccacttctgcctcccccagtatctcagggccaacacagaccaagtggtcaacaagtatttattggactgaaatagtttctgctcttaagggactcttttctatgaattattctcccctgcccccaatcaaatccatcccttaaattttaaaaaactgagatgaaattcacataacataaaattacccattttaaagtatacaattcagtggcatttagcacgtccacgatgttgcgcagtcactgctacctaattccaatgtgctttcatcttcccaaagtgaaagcctgtacccacggctcaggcagtccctccctggtccccctcctacagctcctggcaggcactcagctgccttctgtctccatggatttgcctgttctggatgtttcatagaaatggaatcatataatatgtgaccttgttgactggcttccttcactcctcatgcagtttctgaggtttgtctgtgttgtcgcacatgtcagtgcttagttcctcttcgtggtggaataattgtctattgtactggaccacattttgtttatccattcatctgctgattaatatttgggtagtttcccatccctgttccatttttccttttctctcactcagccccatcattcagcattttgcttttcattgtcacgggacaggttcaggttgaatcaagtggaggtggagatcttgtcctgtgacttctctttttttttttgagatggagtctcgctgttgcccaggctggagtgcagtggcgctatcttgcctcaccgcaacctctgcctcctgggctcaagcgattctcctgcctcagcctcctgagtagctgggattacaggtgcctgccaccacgcccagctaatttttgtatttttagtagagacagggtttcaccgtgttggccagactgctcttggactcctgagctcaagtgatctgcccacctcggcctcccaaagtgccgggattacaggcatgagccactgtgcctggtccccaatgacttcttaatccaggagagcttctagggaggtgaaggtatgcggagcatgaacaacagcatgacaggccttggaatgatcatggtggtcaccaaagggggcagggcatggagcgacttaatgagcacagagagcctgaatttctgcacacacatctgatgagggatgcccagcctggggatgctctgtgatctttaaacaacggtctcactgggcagctgagcctctcagccagcctgatgttttcattcttgccaggctttccctggggagacaggaggacactggactcagcagaaagaaggacatttgcttgctaggaccatgcccgtgatggctggcatccccggggccctggagggtgaggcgtgaggggcagtgacgcaaatgcacgatctcctctcatggtgggtctttgcagactctccgtctgctatccccaaggtttgggagcagccaagtgtttaatgatgttctgcaccagcaattttagactctcggagctaaaattagatcccttcctggtgcctcggggaggatgggctggctgtgtccatccatcccgtgctggagcgtggctggggacaggctgtgcgggaggcgcaggggtgaggctccgaagcaagagcagccagacgctgcgtccctcctgtctcttcagctgcgccttcctcaggagagacagaaagagcctttggctgccctctgtcctcttgagggtcactatgtctatgtttgcatcccagctttacagcttcccagttctctggcctcaggcacatcatcctaaactgggcacgataatccccctgaggcggagttgtgagctgaaatgaacagaaggcagagcggggtgcagggcctggccgtgactgaggctccacgaacgctggctcccttcttaaatttttgtggaactgtgggaacacacagtttaatttttttttttaagactgattttcactctagtcatccaggctggagtataacagtgtgatcttggctcactgcaacctctgcctccagggttcaagcgattctcctacctcagcatctcaagtagctgggattacaggcacgtgccaccacaccaggctaattttgtatttttagtagagatggggtttttccatgttggccaggctggtctcttaattcctgacctcaggtgatccacccacctcagcctcccaaagtgctgagattacaggcgtgagccaccgtgcccagcccagagcttaatttttttttttaattatttctttctagccttctttacatggtccctggcttgactgggggttgggaggtgcaaggaggaaggtgacagttgactttccttcctacaaaaactcaacatggctcagtggactggaccccagcagaacttagcagaacccaaaaaggcccagtggaacccaggggacccacagggactcaacaggacccagcaggtaccaacaaaacctagtggaactcagaggggcccagcctttaccatgggttacctttgacaccaaggttcccccacccctacccttcaagatacctgggtacctttccttgtcattgtgactgtcaagccctctaatcagtccacacgagagcccctccactcctcacctcccacctccctctccctgaggaaaaacagctgatcagggagcagtgcaaagcaagctctctgggccttatatcccctgaaggagcagctctgtcaggccgggaaaatggttgtattattcttctgcagaacttattagattagaaacttagtacaaacagccccagctgcaaccgctatacatagtcactatcaacaaggaaaatttatgctttaaaaataaaaagaaactcaagtgcattagtcagagtgaggaagcgttcacgaaaaaaggtttgttctccaagtaaacagccacaatggaattgtaatcaaatttcttaattatttctataaatcttgggaacataaaaatacacaaggccctttttcaaaaagtcactgtttgcaagtgccttggatgagagaagaggtaaccgaaacagctctggcatgactggaagattccagaaggggtgaagccacgattcgggagctgagagcacattgcctcgtcacagaccaggagcagaggctggggggaccacttctgagggggcgccacgagagccgcatttagggcgactgcataaagaacctgagacccagttctgcagagctcagcttcctccagtcacgagaggccgtggacgagcaggaggcaggtggccctggggggcctgggaattgggaggagttagagctgcttctagggaggcaggagaagctgggcatcattggtgccccacggcccaggcgaggcagaggtgccctgtctgtcctcgtcaggcaggcagcttgtgggtctgggatggtttttccctgctgtgtgtctaaggcagaagagattggcctgacatccggatgtcccatcatgcctttccccaggattagggagcagttcttttataaactatgtttgaaactaatttagaaaattagaaacatagaaaaaaaatgtcataagttatcttggtacatcctggtgtgtgtgtgcgtgtgtgtgtgtgtatgtgcgtgtctgcaggtgtgtaggacaggaaagtacaggagtgggagggtcaggcactctggcccatgtgcccaagcacacacttggatgttggcacttttcaggtgtccaggtgttgcctcttgtcccagtggacactctgggaaggacaatagacagggtcgttgacatctggccacggtgcggctggcagttttaatgccatagaatatgtgatggagacagatgcatgtcaataacataataaagatatttttccatccacaaatgtctgatattggaattactattcttctgttttctgttctgctataacctgcttaactcttcaagaaagccagagtatcttgtttgaacagttggccacacgctcgcatgataacacaattccattaaaacattcataccttcagcagaaaggcaccccgccaaatgctctatgtgttgtattaagccataagcagaattaaagtgcggaatcccagcctttccaaatagtgcaggaattgcgtggggggctgcaggctggggaggagcaggcaactgcactgttaaaccccaggtccaaatcctgcagccaccccagccgcttgaagcggggtatcccctgggatcaaaccgttagtccatcaaacactgccttagtgcaaagccctgtccctggccgaggcttctcccctcccctctgggcagtcctcagctgagcagagcaggtgcccttgtcctttcagcccccaggtatttgcaggtcctggactgacaggctttgcctgaagccatgtgggtttcagaaaggctctttcctgccgatttacactgtgacttcacaaataagctattttcatggtcattgatcttgtcggtggtccctcacatttccccagatcatctctaagcaaactctgaagtgggtcagcaaagcagctccccccagggagggcagcctggagctgctgcagctcccaccacctgaccttggaggtatgcacctcacttgggctattctgacctcagattcctcctcttcggtaattggggtatagcggggatagatacctcttgattcatgttaaaacaatgtaatccttttgcaatgtgatgagctgcccctgctgcattttgtcagatcagagttttgcaacaaggactctcttaaagtgagatgcacttgtcactgcagctggatctttctgtccgagcaggaggagcagcgtgaaggtgaaactgaagggaagaagaacccacactcaaggcattctgagctctgtggtaaccagaagccctgggtgactggggtgcttgagggagatgtaggctgctaactccttccactttggtgtctgtacagagggagggaccttttccaagggaacaatgcctttatgttctggaagagttctgtactgagcccatagggtatccttaggcctcggagtcaggggcctacacatgctaaactccagctgctctttgagtctagacactcgctccagctccaactgcttctgattctacagctcgttcgcactttttcctggttgccctgggttagccattgggatagacagatgctgagggcataggagcactcacgggtttctactctggatccttccatagcatatttaatcaagacatttttgcaagaatagatgaattgggaggcagtatagtaaagcaatgacaatgtgaattgtagcaatggtcaggccacccctggctgtgccatcttgggcaggccctgtgaccagtgtccacaggagagattgttgtggaccaggcctggaagtggcatgcatcatttatgccacttcccactgggcagaagtgagtcacaaggccccactagattgcggagaggctggaaaatacagtttaaaaatgtgcccaggaagaggaggaggaaaccacattgctgagcatctgcataacggggtgcctggggctggctgggcaatagaccatgccccctcccctcacaaggcccctcctacccaccaaggctccttcccacagaggcccctcccacacactgaggcccctcccacccatggaggctcctcccacacaccgaggctcttcccacatactgaggcccctgtaacacatcaaatctcctcccccatgccaaggctcctccccacacagtgaggcaccacccacacaccgagtcccctcccacacactaagtccccttcccaacacgcaggctcctcccacatgctgaagcctctcccacacattgaggtatctcccacacactgaggcttccttcagcacatcaaagccctgtccacataccaatgcctctcccccaacacagaggactctcccacacactgaggcccttctcacacacacaagtcccactcacacagaggcccctcccacaccctgaggcccccccacacacactgaagcccctcccacacactgaggcctctcccacacacaagtccctcccatattgagacccctcccacatactgagacctccagtgcatcaaaactctccccataccgaggcccctcccatacactgagactcctcccacacactgaagcccctcccacacattgaggcctccttcaacacatcaaaaccctgcccatataccagtacccctccccacacacagtcccacacattgattaccctcccacatactgaggcctctaacatgtcaaagccctgcccacacgccaaggctcctccctacacacagaggctcttcccacacactgagccccttgccacacacagaggctcctcccacacattgaggctcctccccacacactgcgcctcctccccatacactgagccccctccctcaggcggaggctcttccgacacagaggctcctctccacacacggaggctcctcccacacactgaaccccctccccacgcgtggaggctcctcctacacactgagccacttcccaagcactgaggcctcattcaatacatcaaagtcccgctcacatgccaaagcccctcccacacattgacctgcctctcttcctgagaagtccctcctgaggaaaaggcttgaacacttaaaagaacaaggaggtccgttctcttttctgtatagcttttgttcctctctctgtgctcagggctgccagaactggtgcagagtgtagggccataggaaatatccctcactatttctccccaccatgctctatctctgccactatttttaaaatgctcttttaaagggtttgtcaacagttatcccccgtttgtctctgccctgatttatatttctagtgactattaattgcctaccaaatgaaggctcagcatttgtaattaggctggcaaattctacctgacatcttcggctctgtgttggggcaggaagggagcatgtgttaatggtgttgaactaagccacacccctcccccagcccgctgattaaccccaggttcactaatcaatgaagtctaactgattctctttgcatttacatcctgccttgactcttagccaagggctgagggctttggttccaaaatgctttctatgcccagagaggatgcctctctgccttgttcctgcagaaggaactctcaccctgaatgggtagggtgggggttccgtaaagagctagagggagaagggcacttgcggagtagccaagctgcagagagctccctgtagctgttctggagaatgaagccctcctcagcctcctttataaaaagtctgccataattcagctgaacacaacatggtaccaagaagccacaacctcagggatttccttggttttctgttctgttaatcttttcaaaacacgattggattggaagcatccattctcagccacagcaggttgcttggcagtggccgtggaggagctgtccaggatgctggctgtgtgaaccagggaacagcccaggattcatgtatacttattggcacaattggtgccctaagtgaggaacaccagtaccaacatcccagggtgtcttcatgaccaaggcgaagcatctctgtgcccctctgtggtcattgcttccaaatacatgaaaggacaaatgatgatatgggttctgccttgcccacagcaggtgctcaatgactacactcagaaaaatggctgctaataacaattcaaaagagttatatatcagtcacgaatatctatgcatgaaataacacaggaaccacctttataaagcagatactgcaaaagaaaccaggaaatgcagagaaaaccactaataatgggaaaatttaacataccacattcagcacaaggcagatgaagtggaaaaaaataacaatggaatcaagaagataggtattatggagatatagatatctttatgtatacatttatgccacaataatatagaatatactttcttctcaggtatacatggagcatttacaaacagttatatattagctcacaaagaaaatttcagtaagttctataaggtagaaatattataaacaatactttctaaccacggtgcactaaaactggacattattaacaaaaagatgaaaataccctatcatctggaaatgaaaaacaacctattaactcttggatgaaatggggaaagcaaattaaaaattaaaaaataatcataatgaaaacactacctaccagaatgtatgagatatatttaaagcagtgattggaaggaaattcatatccctaaatgcttttattaataaaaacacaaaaatgcaaataagtgaactaagttcttaccccaaaagctaggtaaagaaacacaaggtaaaccaaaagaaagcacaagaaacataatagtaaggataaaagcagaaaatagtaagatagagaatgaaagaacagtagacctgattagcaatccctaaatatgggtttttaaaacattaacaaatgaatgaaacccttgctagcataaaaaatggagagaaagcacaaatatatgaaataaatgacaaaagagacataaccattgacatagaagacatttttaaaaattatgagattaggccgggtgcggtggctcacatctgtaatcccagcactttgggaggctgaggcgggtggatcacctgaggtcaggagttcgagatcagcgtggccaacgtggtaaaaccgtgtctctactaaaaatacaaaaattagctgagcatggtgtcacgttcctgtaatcccagctacttgggaggctgaggcaggagaattgcttgaactcgggaggcagtgagctgagatcacaccattgcactccggcctgggtgacaagagcgaaactacatctcaaaaaaaaaaaattatgagattattttgtagacctctattaaaaatatgaaaacagtatcaatttggtataggaagcttaaagcttaaataaaccaatttccataaaagatctagaaaaaatcctgaaggaactaccccaaatgtcactagacttttttttttttttttttttttttgagaccgggcccccctctatcatcctgaagtgcaggggtgtaataacggctcactgcagcctccatctcccaggctcaagccatcctcccacctcagcctctcaagtagttgggaatacaggtgtgtgccaccacagttggctaatttttatattttttatagagacggattcaccatgttgcccaggctggtcttgagcaccggggctcaaacggtccatctgtcttggcttcccaaagtgctggtattacagatgtgagccaccacacctggtccaaactttcaaagaccagatattcttcattctttattaattgtttagagaatcgaaaataaatgaatgttttctaagtctttcttgaaagtaagtactacattgacacctgaatctgaaaaggcaagtaccaaaatgaaattacagaacaatatcacttataaacttataaatattgaagtaaaagtgctaaacaaattattcgtaaactaaccaataccgcaataagaaatcaatgcaccatgaccaaatggtgtctttttcccaggaatgcaaggttggttcaacatgaggaaatctattagtgtactatattaaggtatctaaggaaaaacataatgattatctccataaatactgaaaaccctttgaaaaaattcaatatgcattcctgatatatcattgaagaaaataggaataaatagatgcttttttaacctgaaaaaatatttgaatcctaaagtcaggatgcttgttgatgggaaaacactagaggcatttccacttaaagaccaggatcaaggcaaggatattcattatctctgctactatcccacaattgtactggaggtattagcaattaggtaagataaatcagttactggcatgaatattagaaaagaagaaccagaactatctcagtttgcacatgatatgatagtatactgggataaccctagagaatcaatgataaaagtaaattaaacaataaaatcattatggtagcaggaaaaatttaacatatagaacttattaactttcttgtacataaataagaaccacataaataaccagtttgaggacgcaatagcaacaaagaagatacttaggaataaacttagaaagatatgggcaaagccttgataagaaacatttttaagctcttctgaaagatgtgaaagtagtcttgaacaaatagaaagacatcccttgattttggatggattgatttaacatcataaaaaagtttgtcccaagttaatttatgaatttaacataatcccagagaaagtatcagtaagtttttttatggagctacacaactgatacttaagttcatatgaaaagacaaacatgcagtaaccacgataaccctgcaaattaagaactactgggaggaatagctctaccaaacattaaaatgaactataaagcctctataattaaaacagtatggtgaaattgatgcatgaatattcaaaatagcagtagaattgaatagaaagtcttgaaatagaccccaagttcatatggaaatttagtatatgacaaaggtggtatctcaaatcactggagcagagattaccttttcaatacattgttccgggatgaccaggcagcctttggaagaagataaaattaatgcataagttccagtatacacaagaaaaactccaaatggattgagatctaaatataaaaggtgaaatcataaaagtactagaagtggctgggcacagtggctcatgcctgtaatccttgcactttggggggccaaggcaggtggattgcttgagcccaggagttcgagactagcctgggcaacatggcaaaaccctgtctctactaaaaatacaaaaactaaggtgggaggatcacctgagcctggggaggtcgaggctgcagtgaaccgtgatcgtgccactgtactccggcctgggtgacagagtgaacaccccatctcagaaaaaaaaaaaaaaaaacactagaagaaaacatgggtgagcttttctgtaacatggatgtaagaaaaggttttctaacaatgactcaaaatccagatgtagttaaagaaaagattgacaagtttgattacaaaagtccatgataagcacagtcaaaatgcaaatgactttgtaggagaaggtatttgcagcatatatcagaagtaaagggttaatatccctgatatgtaaagagctgttatcattgaggaaggggtacttgatagaaaaaatgggcacaagacatgaaagataattcacatcaaggatatacaaatgtcctttaaacaaacgaaaagatgttcaacatcactcataattagagaaatgaaaatggctttgagctgtcatttttaatctgtcagattggcaaacatgaaaaagcaaggctgtgaagagacaagcaatcccacacattgctgggggactgcaaatgggcttagcccttttcaagggaagtgtggcgattgtactcgtctgttttgcattgctataaaggaatacctaaggctgggtaatttataaagaaaagaggtttgttttggctcacagttctgcaggctgtacaggaagcatggtgtcagcatctgcttctggtaagacctcaggaaacttttaatcatggtggaagggaaggggacctggagtgtccgatggtgagagagggagcaagagaaagaggaggaggtgtcatgtaccttttaacagccagctcttctgtgacttcgttactgaagggagagaccaagccttttttgagggatcccccccaatgaccccaataactcccatcaggccccaactgcaacttggggaccatatttcaacatgagatttggaggggacagatattcaaaccatatcagcaatatctatcataactgcttatacatttacattttgacccagaaatcccacttctgggaattcacccttgaagatatacctcaaaagtatgaacatccccacccacaaggttatccactgcagcattacttgcaattccaaaatattgggaacaacctgaatgtccaaacacagtggggtggttgaataagtgctggtgcataatgcatagtacatggcacagtggatactatgcaactgtgaaaaagaaagaggatggtttctatgaactggcatggggtgtatcccaggatacactagtacatgacaaaggcaaagagcggaagagcatctgtgggtgggagtagggactgaaggcaggtgagcatgaggacagttcttggtgtaatgctggtgagagttgcacactctatgctttcttaaatctcatcagactgtacacctatagtgagtaaatttatgatatgaaaattgtacctaaacagagctgttaaaaggacatctttattatgccactgtttcatattaaagaaagtaaaataactttatctgcagtagccaagatttggaagcaacctaagtgtccaccaacagatgaatgaataaagaaaacatggtacatctacacaatggcgcactattcagccataagaagagtgagatcctgtcatttgcaacaacatggatggaactggaggccattgtgttaagtgaaataagcccggcacggaaagacaaacttttcatgttcttgcttattcatgggaactcaaaattaaacaattgaacgcatggagatagaaggaggatggttaccagaaactgggaagggtagtaggggcagtggggatggttaatggctataaaaaaatagttggaaagaatgaatgagacctagtatttgctaacacaatagggtgtctatagtcaataataatttaattgtaatttagaattaactaaaagagtataattggattgtttgtaacaaaggataaatgcttgaggtgatggacacaccatttatcctgatgtgatttttacacattgcatgcctgtatcaaaatgtctttgtaccccatgcatatatacctactatgtacccacaaaaattaaaaattaaaaaaagtaaaaaagtaaaataagaaaacatacacagatctgtgtagtttagtaaaaaagaaatataggaaaggtgagttagaatctaatgagattgattactgatggggttgttgggaccagggttgaaaggatgggaggatgggaaggagacaggagacagaaagttagatttctctgagtatatctgtttatatgcttttgacattaataatcttgtcaatatttcaaactaaaaacatcatgggctagagacgaagcctaatgtggaataaaaacagaaacaaacgaaagcagccgtatttcaaatggataaaaagccatgctgaaagttgggggcagctccccaagtaacttttgggctctgtattttggccatgtaccaccagtctaataagaggaaacaactgtaaaagaaaaatatatggctactgtagtagggtttgttttttcaagtgatgtggattagcagttctgaaatgatttatattcaagattgaagaaatatgtaaatgtattataagtaatgggagccattttttcctctcaatcagtgaagggagttacacatatggaaaggtatagaaggctagaattagtcctgtggtgttgggttggaatttgaggtatcagtatgaacacatatatacacacagagagagttctagaaatataaatgcatgtattaatgtagcagtctgctaagatagcctagaggcaatgatgtctcagtagtaaacctaccaccctgatttttttcttaaataacttctccactaaaaggtagcagggtgatatggttaattctagggttagggcagagacagtacaaatgagcctggaaaaattttgaccagaaagtaagggagagctgacacactcatggagatgtggtaaaagacacagagccaggcaactactggtcagagctgtaataattgagcgtcaaaattaatataaataagtgaaaaagaaggaatagtgtttcttatagtagattgaaaatgtagaaggaatttacatagtcctgacatatctccccacaaagttcttactaatttcaaagggggaattacaattttacattgaagaaatatagcagacactacctgaatcaagtgatcaaaagtaacatcgtgaaatcgggacaaacacacagctgtggctctggtttgaagaatgaaggacctgacatcgtttctgtgatattcctgcccaaaatgtacaacctgaacctaattatgaggaaacatttgacaaacctaaactgagtgatgtctacaaaataattggcctgtactccaagaaaaatgtcaaggtcatggaagaactgttccacattaaaggaaactaaagagatacaaaaactggatgttcgcgtaatgctggatcggatcccggaccacgcgagtttgtgttcttttctttagctctcaagggctttataggacgcttggtgaaatttgaaggtctgtggattagataatatgttttatgtcagtgttaatgttctgatttttagggaatacacagtgaagaggtacaggggcatcgtggctttgccttactctaaaacagttcagaaaacaatgtgtatgtggggatatatttgtgtgcatgtctgtaggtagagagggagagcaaaagagcaaaagagagagagggaaggaagggtaaagaaagcaaatgagataaagacatttggggaatctgggtgaaggatatacaaaaattgtactatttttgccaattttctgtgtcttgaagtgtttcaaaataaaaatctattaaaaagtgggctagtataatatctttcttagtagtgttaaggattaaatgagataatacctacaggtgctagtgctgggacctggacataggaattaccaaagaaatgatagctttgatgatcaggagtgatggccttgagggtatgtgtgatgctggctctgagttgatctgttggagatgtccctttcttattgggggatgacagatggcagcctcctttatggcaaaagccctgatctgagaatctggtgacctgggttcccatcagctctgacacccacctgctatgtgactgcaagttggcagtcattcaagtttcattttgccggggctggttggggggagggtacattttcttaggcttactttagaatgagttttattcattcattatttaatttattcacgcattaacatctttattgaaaactatgtgccaggcactattccttgcaataagccaggtccacggagaatgaatgctgtagtttaggggagagaaatatacaccacgctggcagtgtagagaaacgtgcacaaccaggtaaatatttcctggtgaggtgcagttcaggagtcttcccggcgggggcgtgaaaatcagtctccctagtggggtgtaattgaggagtgttctggtgggtaaaattcagagtcttcttagtagggggtaattcagagtctccctgggaagtcagtgctcacttggtctgggagaagggctggaggtgctcacctgtgatggggggaatataggatgggcagtgaagccatgctggtcactgtcctgacagtatgagagagtggctggggcacagggcagggtgggtgcgggggcatttgaaccaagattgaaaatgactccaggtttgcagagaggaatatgggctcaggaagcagtcccagactcaagaatcctgaccagtgccagcctgcagagtttttactggtctatggcaagatatgggaaatgaagacagtggtggtgtctgcatactcactgggaaggattgccaactgctgtttctcggaaagaactacttttatgcccaagctcattttttaacataaaatacacattcttttatgaaattatattgaaagcagatggtgattttttttaacgtcgttacttaacaaaataaaaagttgtcaatcctatatttgtctccccattaaatttttaaaaactggatcataaaatctaaacagctgggaacttaagcattctagacttcctgaatgaagtttcatggtaatttctggttttaaaagatgtattttaaaaaatgaatataatatttttaacatacatgaaattatagagaataagaggcacatcagttcacctgccctctggatttcagaaaagcccatacttcctggcaccaaccttcattatctttgcattttcattttcactgatgatttgtttacccaccctttccccctccatcccattagagtgggacctggcttgaggccagggtctgtatttgcatgcagttattttgatagaactcttttggagctccttcttggagacagctcttttgatgcaggaacattgggatgggccctgtattagtctgttatcacactgctataaagaaatacccaagactgggtaatttacaaaggaaagaagtttaattaactcacagttctgcatggctggggaggcctcaggaaacttacaatcatggtggaagctaaggggaaacaggcaccttcttcacaaggtggcaggagagagaagtgggcaagaggggaactaccaaacacataaaaccatcaaatctcacgagaactcactcattatcctgacaacagcatggtggggggaactgcccccatgatccaatcacctcccaccagtctctcccacaacacctgaggattacaattcaagatgagatttgggtggggacagaaagcctaaccatatcagggcccaaacaaaccattaaacttttaaaaggaaattgtggtgaaatgcacctaacataacatttaccactttaaccattttccactgtaccattcagtgacattaagtatgctcatattgttgttcgaccataactactattattctgcagaacttttttgactttccaaactgaaactctgtacccattaaacagtaactccctccctctcccctaaccctggtaactattgttacactttctgtctgtatggatttgactactccagggacctcatacaagtaccaatacatacaagtatttgtccttttgtggcagacatatttcacttagcttgtcatcttcagggttcatccatgttgtagcaggtatgaaactatccttcctttttaaggctaaataatattccactgtattccatattttgtgtagctgctcatctgtcaatggaaatctgagttgttctctaccttttggctatgtgaacaatcctgctatgaacataggtgtacacatgtttgttcagttctctgatttaatttctttggggtatatatccaaaagtggaatggctggaccatgtggcaactctgtgcttaattttttgtggaaccattataccattttccatagcagcagcaccattgtaccttctcaccagcaatgcacaagagttccaatttttccacatcctcaccaactcttgttttttgttttttaataatagccatgctagtaagtgtgaagtggtatcaaaccatcacactttaagcttcacatttttgtcaacaggtaatatacaaagctggtgtctgttctctatcctgaatcccatcctctctttggcttcatgctctccttcagcctcaattattgtttcctgtgcacaaagttgtacataaaatactttctgtgtggtttctaacagggaaacactgtagaaagcctaaatgtccatcagaaaaaccaaggttaaataatgtatgccacacagagattggaaaataccatgcagcaatgaacaagaatgagctatatctgtaagtgctggcattgagtgaggtccatgacatattgctaagtgaaaaaaatcaagccatacaagagcacattaaaaactacacgtctgaatatccagaaactacagtgaactcaaacaaattagcaagaagaaaacaaacaatcccatcagaaagtaggctaaggacatgaatagagagttctcaaaagaatatatagaaatggccaacaaacatatgaaaaaatgctcagcatcactaatgatcagggaaatgcaaatcaaaaccacactgtgataccactttacttctgcaagaatggtcataatcaaaaaaatcaaacaataatagatgttggcgtggatgcagtgaaaacggaacacatctgcactgctggtgggaatgtaaactagtacaaccactatggaaagcagtgtggagattcctcaaagaactaaaagtagaactaccatttgatccagcagtcccactactgggtatctacccagaggaaaggaagtcattgtacaaaaactttcacactcatgtttatagcagcacaatttgcaaatgcaaaaaggtggaaccaacccaaatgtccatcagtcaacgagtggataaagaaactgtggtgtgtatgtattttggcaccatctttttacacctagtaagaaggaatgaattaatggcatttgcagtaacctggaggggattggagattatttttctaagtgaagtaactcaggaatggaaaacaaacatcgtatgttctcactgatgagtgggagctaagctatgaggatgcaaaggcataaggatgacacagtggattttgcggactcgggggaaagggtgagaaggggtgagggatgaaagactacaaattgggttcagtgtatactgcctgggagatgggtgccccaaaatctcacaaatcatcactaaagaacttactcacgtaaccaaataccacctgttcccccaaaacctatggaaataaaaaattttttaaaaatcaagccacaaaagagcacattaaaaactacacatatgaatagatatatgtctatgtacacatatctctgtatgtgtaatacatgtgtgtattacacgtagcatatataatgatgtactatatgtaaatgattcttatacgtgtgtagaaaataatcatgatgtaacataaatgtacatataacttttttaaacacacagaaagctctggaaaaataggcagagttagttgactgtgattacttctgaaaaagagactgaggtgagtagcggaggggaatttcaatttttacttgttatgcttccaactgtttgagtgttgttccttttttaacaagaagtatattacttttgtaatttaaaaaaatagaaaaaaacaaatatagtaagcccagcctgcaagtcataaaacacaaatcctcaatcatggggccacacatgttttaggtgcacgtaatggtaatgcattattctaatgcgtactgggaggcagactccattctaagcacttgaaataacctagtttcccagaaaactacactatgaaggaggttatccatgttttacacataaggatataagctcagagaggtgaagttacccacctaaagtcacacagctagtgaatggtgtgtaattagtgctttaatggtgagacttctttcttccagacaggtacactggtaattttttagaacatggattttaacttctgatttatttatttttttacatactgagatagtgcaggttgtgtttgtaagattcaaggaccattagggtctcgcattttgtttgtttggctttatttgaacacagctctgattataagagcccttgggcatgggaagagtgccaggagcttgtcagccatctctatcagaaataaatggtgctgtgtttctttttaaataaagagaattactgggtaggacaccccatagctttgttctgaattctagatgtaaatggagacttcatagtttatcctaaagttgctgttgaattctctaattctggatataagcgttctattgatttccctctgcacatgcaccatgcatgaattgctcctagaaggctgagtggcggacatggtatgccaccttgcaccatattatcaatagtgttgcgttttcaagaagcgttgtttagttcctttacaaatcatccttttctttaaattagctctcttgggtggcaccatcttttttacacctaaatgaacagatttcacaacaaagatttctaagtgcatcattttgttaaactcttaaaactgttaaattaataaaatcagcttaacagaaccctgattagttcaaaattgctttaaatttggtcattaagtttcagggaacatgtaattttctccacatctggtacagctgcaaggcgtgagggatgaggacacagtgctgtaacaaatacagaggatggggaagaaacgctttgtcatcgacagtttctgcactgctggtttgcagtccccaggaataagcttcctgaggagacattaggccttgtgttatttctctaagaacgtccccttcctgcagcgagaaggccaatgcagaaccgctgggcatcaagagatctgggttcactttttgagaaccctgggaactcactgtgtcactagacacacattcctctctctgtgcctcaacatcccatctgggaaatgggctgatgttcttgagatcctcttccattagcttgttgggggctgggactggtgggggaatagtgtcatcttttgctaggagctattggacacatctgagatgcattatttggataatcgcatgtcaagatgcatttgtctgtcttcttggctacaatgctcctggttctggctcttctggttgggactccaggatcaggtctgtgagatgctgacactgatgtcgcttgcgtggtagcagccagcctcttcctctgcatctttctccactttggggtcaaggtttgacaagctcctcagctgacttggtgtgctatggcgtctgacctggctgaaagccatgacgcttggcctttggttgggatagcaccacttgattcatcactggcagctgcggaggggcagagcggagggaacatgtcagtactttatgggcaatcccaatgtgagaagggactgaggccggatagcccagtggtggaaatcccgtcattgtagaagggagggcctgggatctcaaatctgggaatttttgagttagatctagaacctgaggctggaggcaagttggatggaactgtctgtgcttgtggccgctgctagccattgagccgagtgccacctgcaggagcagtgatgatgggggtcaggcccagcccctgagtgcacgctgcccgccagtgtgtgctgggcatcacggccccctcacaaccctgcaaggtaagacgtgtgactcccatttaacagatgaaggagcgagcctagtgggattatgtaggttacattgtgagtcaatgacagggttaggatctgaacccaggagtgaggagtgaatgcagcgtcaccggaaggaaaaggaaagaaggagaactggaggatgatctgtctcaggcaagctttagtctgaggttctaagtcatgctgtgaaggtctctgcagagtcactccttggcttcattatgcagagagcttgtagccaggtggcactgggcaggggctcatcccaggtgcctaaaccccacatgcatcaaaacttagaggagaccagcgtcttctgctggtcctttaaaaatagtcatttgggccaggcacagtggctcacacctgtaatcccagcactttggaaggccaaggcgggaggatcacctgaggtcaggagttcgagaccagcctggccaacatggtgaaaccccatctcaactgaaaaataaaaaaattagcagggtatggtggcaggcgtctgtaatcccagctactcgggagcctgaggcagggagaattgcttgaaccaggagttggaggctgcagtgagccgagattgcaccactgtactccagcctgggcgacagagtgagactctgtctcaaaaaaaaaaaaaaagtcatttgctctgtagtgtcagtttccaagtcccaagtctcccatgaaagccaaatgccttctgatattgatggtacttcagcaggtgactgcagcccaattgtatcggatgtttctgatgacagcagataagtgccagtgaacagctaaagttcagtggcacttacctgctgtcatcagaaacatgaggggaggggatgggatagtggaagaaaggacatagggaggtgaaggacgcagaccctgaagacaaagtccttccactcatgtgcccacctgcagaagggggtgcggaagcttgagccacacacagagggtctggtcccaaatgcagagagcccaggcagtggcttttctgagggatagaatgtgagcactttggatgtctggaattctgtaagaacccaatggaaagaaaatatgaggtttggaaacttctcctccgagtgctcctttaggtgttcaggtggattttacagaagaggctgacggcccgaaggggaggctagccatcagatttccattaatgtctcccaccatctctgaggcctaaatgacagggttcttgaagacagcaacagaacagtggtaacctatattttattcactatctttcatgcccttagcatcatatctcactgatacgtagatagacacatgtgaacggaagcattttatacgtaaacgtagggatgtgtgtgacctagatttaaaggatgcatattaaaagaattgtacctaataatatgaactatttttggcccatgacatgcggcctttagaagcatgacaaaccaaaaacacttttaccaaattccttccctttacaatcccctaccgtcctcctatctggtcaaaatatagctacttttttggtacgttggttttaaaaacagctctgtcctccaaagatatggcaaagttttctagttactgttttttaatacttcctggtattcttagagtccacagctttgagtgcagctggaaaacatctacacagaggatatgtttggacaggtattgaatataataaactatatttaaatatttatacgtgaaatttttttttatggtgctgttctttaaatcattgaacgaggtcctttcatttctccaaaagatatatgagcactgtcttttggcatatagatcatttttgcctttgaaagatgtctcagttaaaaatgatttctacagatgatcttttacatacatttgttattgtggtgagcgttacatcctgctgttttacagcgatacttggaggatttctcctgaaaatagccctttatttgtggcaagctgaaagggagagggcaggaagaggacttgcgatatttcatctgcctagagcttagtaaggagaggagagggccgtgcagtccccagtatgaccctccttccctgtgctcgggaagcagcttgaggctaagagaaatattgggctcttctcttctgctaagaggcttagaattctgtgatttttattttctgcttctgcctgcaaggccctccttctcctttgtcaatttgaagagctctctttctattcctagcagttatctagataacaatcatttgtttttgagattgattcctataaacagtacgtggagcatctcatggactaaaacgtggtaaattgtcaaacttctcagagtaggaagatgtctgctggctaggtagaaggtttctggtttaatggtgaaaacagccaaacacacaaataagcaaacacgcacataaaccaccaactaacccagcccagcagcaggcgaggttttctgtcgtccagcacgtgcaagagaagggctgggcagcttgatggacatttgtgccgtccaccttgcaggcatatggcagctcccacgttctcacaccattcgacatttggggtgaccaagtcatgcactctgaccagtgaaatgcaagtggaaatgacaagtgcgacttcatggcacagattttcggagtccaagtgttgctatacacattctctgcttgtcttggctatttggaagcacattcagtgctgagcttccctgggcttggtggccgagtggagtgaggagtgcagactccccagctgcccgtagtgaccatggggcacaagcagggaatagagctttcctgttacagcatcatggcctcacctgtcctgactgatgcaggtggataccagcaggcaacagtggttggcactgtgacactctcccgccacacatggcacactcaccttcagccaggtgcccgcactgctcctgagaccactctgaccccatgaggaggttggcttgtgagtgcttatatttagccagccattgctcacagcagaaggataaaggggttcgattaagagagcttgtgggctgggcgcagtggctcatgcctgtaatcccagcactttgggaagccaaggcaggcagatcacctgaggtcaggagttcaagaccagcctggccaacatggtgaaaccccgtctctactaagaatacaaaaattagccaggcatggtggcacatgcctgtagtcccagctcttaggaggctgaggcaggagaatcacttgaaccaggaggtggaggttgcagtgagctgagatcatcccactgcactccagcctgggcaacacagtgagatactgtctcaaagaaaaaaaaaatgtgtgatacagtttggatttgtgtccctacccaaatctcacattgaatgagaggaggggcctgcaggaggtgattgaatcacgggtcaggtttcccccttgctgttctcgtgatagtgagttctcaggagaactgatggtttaaaagtgtgtggcacttcccccttagctctctctctctctctctcctactccacctggtaagacgtgcttgcttcccctttgccttctgccatgactgtaagtttcttgaggcctcccagtctgtgaagcctgcagcactatgagtcaactaaacctcctttcttcataaactacccagtctcaggttgttctttatagcagtgtgagaacagactaatacagtatgtgtgaagaaaacatacattcttagagatctgtttgcctgctctcacagagcccctgaccagtgatgggacattccagttagcaggagagagggtgtggtggagcacagcgtggctggaggaaatcactctaaacgggcttcagtgcactaacagattttggagtgatttatatgaaaacagtttaaagcatttactagctgtaggaactaatttccaataaatcagacaggattcccttgggaaccagaaataaatgagggcaaaagaaattgctaagggttgttgagcaataaagagatgggttctagataccttaaaatgatatttaaatggacaaagttgatttagctgtcttctctcatgtctaggagtaagattgaagtccatagcatgtcattatgaccaggaattattcaccaggagacctgcagcatttcatgcacattccgctgaatggcaattttaatattccagtttcagtcctcggttgtaatgaaaaggcattaattgcttggttccttgcaaagtctgtaacaaaagtgttcctagaacaagttcaaatttggcacacaaggcagaacttttatgatctaacgttagtcattttttttctaattaagaatttttaatgcatatatattttgtgatcttcaagttctcaagtaattatttcacacacacgggtcatctggcatcgtgccatgtgtcttggaaaatgcagaaaaatagaatatcactgtggtccttgcactctggaagtgtacatttcataggaagatgaagctgtgacaccctctgagaacactgaagccacacgtgtgtgtcaaatgtgaggatggaaggaccagcagccaggagatgctgacattgcttcagggaggtggaggccaaacaaggggctctgaagcactggctagacttggccagagtggggagacagctcattgtcccgaatgagcaagacctgtggccagagctggatgcagtttccaaagaccaggagatgctctctcagctgcccacacagggttcgggagacatctgttctgttaaacatggacacttcttgtgaccaggacgtagcatcatttcctaaagaggtgggggctcagagctccctgggaccagggggatgactgttctctgttttaggaacctgcgtgtgggatgttcttgggagatgtgaagagagaggaaggaaaggacactcaaattattgtcccccaccacacacacacacacacacacacacacacacacacacacacacacacacaatctacttgcttatttatctgctcatttcattgacgcttcccaacaactggggtatttttcattcccttttcctagttgagaagaaagactccgagagggtggaatcctaccctaggtcatttagctggaaggttgcagagtggtcttcaaatccaggtcatgccccttttcgggacactggaacattccaatcaacagcaggggaagccgtatcttcccctgctagacttggccagagtggggagacagctcattgtcccgaatgagcaagacctgtggccagagctggatgcagtttccaaagaccgggagatgctctctcagctgcccacacagggttcgggagacatctgttctgttagacatggacatttcttgtgaccaggacggagcatcatttcctaaagatcccctgctagaacttactgatagtaagttctaggatattggggtgacccaaacccaggaatccagtttctgcccttgcctttctcttgcataaaaggttgaattgtgcctcattcaagtgcatgaacttccccaggccctgctcagtgcatctagtagagccaggatgtcccagctgaccctgcatttggaggcctggaggtgggctcaccacagtttgcagcttaggtgtgcccccactcccctacccccgacctgtcactggtcctgaccccaactcttctggaatcacgtggtgtgagtggtacaggaggcctctgcttgcaaagctgggtgctgacctgtgtgtgcccctgatgactcctgtggaccgtgtttgctgctgcacttcagaaggtgtcaggaatgtgtcccttccatgtctcagcagccctgggtgctcccgacatcaccctgagaaacccccaggacctctctgggtctcatttccagagggtgtctccatcactcatacccccttggccacgctgcgctggcttctttgagcctctgctaagaggcgagtggcagcttccacctctaggacctcttcttgctgtgactctgcttgggaccatctttcctgacacccatagcttcccttgttccttcaagtctttgcttaaagtctccttcctggccagatcttccctgaccctggccctctggtttgggacagatgcttgcacaccgctgctccattcctgtagtgagtctgggggagccctctgcaggcagggagccccgcgggcaacgctggatgcaggcaggagcacacaggcccccaggctccagttcttcttccctactcctgacctttttcttctccaaagcacttactcccagttgacatattgtgtgctggcttgtttgttttgtttattgtctcttccaccgcctcccaggagggcagaggtgtttgtcttttcccccccacttctctcccctaagcgcctggaggtttgcgcggcacgtggtgggtactgtctccatctttgctgaaggagggaaggttccttgtttactgatgccccccccaactcctgttcagaggacaggcgaggcctgggactcggattggagcccgcccccacgcctccacccgctgggcatcctgcctggagaagcctcctcatgtctgactgtgggaagcaagctgcgctcagcggggcatcagttccaagcggagggtaaaagggagccaggcagagaccacttcttttgttactcagtccatgcgaggtggtggcgtcagccctgcttcagggaggacgcctgctgctcagcgtcccttctgcaaggagctgtggggaccccattctctttcccagacacgggcacccgaccctagggctgggaagtcatctgcccccatgtcctgtgcctggtgcacaacccccttcccctgtccttctccgaagcaccagccgccgcctggaagaattcttccctcccacccaaggcagcggtgggcacgcccagcccttggtcctgttctccagggaacccagccgtgtgcgcagggagagtttctcagtgtggctgaaatgtatccaaggacgcatgggaactggccgcccagtgcagtcctgcagttggtggaaaggaggatggtggctggggagggagggtggggagtgggtttttaaattttaaatgttattatacaatattctagatatacaaaaagataaataacaataaaatggatagcctcatacccgccaccagcttgagaagtaaaacacagttattgcgtacctggccccatcctccccagagctaaccactgtcatgaatgtttatacacctttgctgcatgtgtatatagatgaggataattttctttcatctgctttagaactttatataaatgacattgtactgcaagcatgcttttttaattaaaatttttatttgaaacaatttcagaaagttgaaaagttttttaaaacatacaagtaccatttgtatatcattcgccagatttcatagttgttcacatttcactatatatacttaattattctctgtgtatgtgggtgtgtgtatatatatgaagtggtgtacatatgtaacattttaacactcttttgaaatatttgagaatagattgaagacatgaagcttcttacctctaaatatttcactgtgtgtttaagaccaaggacattcttgtacataaccacgtcttatacataaccacagtacaaatatcaaagtcaggaaattaacatcaatgtgatactattattattttatcctcatcccttacagaaatttcaacaattgtcccagtaatgttctttatagcaaatgaaaaacaaatggttgtttgagttttggtcctggattcaatctgggatcatggggcgcatttagttccagtttcttaatctggaagagttctgccgtctttctttttctttcttgaatcggacatttttgacgagtacaggcctgctattttgcagcatgtccctcagttctggtttgtctgaggttccgcatagattagattacacagtgttgtccaaaatactacggaagccatgttatgtccttctcagtacctcatatcaggagatttgcgcattgctggttggtgttaactcattgcttgattaaggtggttgcctgccaggtttctctactggaaagtactgtttattttttctaattaataagtatctcatgaggtggtacttggggactgtgtgaatatcttgtttctcatcaggcttaaaaattttgaaaaacagctttattgtgatgtaattcacgtgctgtacaagtcaccatttagagtgtacaattcaaaggtttttagtatattcacataaatgtgcccccattgattttaaacattttcaaaacctccagaagaaatgccatgttatgtagccatcacttcactatctccccatccacactccccaccgccagccctctgcaaacattaatccacttagagtctctatagctttctctgttctggacctttgtaagaatgaaatcgtataatatgtggcctttggtaactgtcttctttcatttagcatcatgtttttaaggttcatccacattgtagcatgcagcagtgcttcattcttttttatggctgaataatatttcattatatggatataactcatttggcttcattatatggatataactcatttggctattattaaccatgatgctataaacatttgtgcacatgtttttgtgtagacatattttttttcatttcttttttgggtatccacctgagtaaaattgctgggtcacatggtaactctgtgtttcattacttgaggaactgttagacctagaccattttccacagtggccacaccaatttacattcttaccagcagggtatgagggttccagtttctctgtcaacacttgttattatctgactttcagattctcatcttcctcctgggtattaaagtgtcatctctttatggttttgatgtgaatctccctgatagctaataatatcaagtgtctttgtgtgtatatttgtatattttccatttgtatttcttccttagagaaatgtctattcagaggctttgcctatttttaaattgggttacctgtcctttttattattaagttgtaagagttctttatatattctagacataagttctttatcagatatataatttgcaaatattttatcctattcttccacagtttcaatttttttggtgtcctttgaagcacaaaagttctgtgttctgaagaagccccatgtgtctattttttattttgttgttcatgcttttgatgtcatatctaaaaaatgctttgccaatccaaggccgtgaatgtttatacctatgttttcttttaagaattttagttttaactctttcatttagctctttgatccatctgttttgagtttatttttgtatatggtgtgagataaggattcaatttcattcttttgcatgtgactagctagttgtcccagcttcatttgttgaaaagactatttttttcccagttgaatggttttggtgccattgtcaaaagtcaattgatgacagctgtatgggtttatttctaggctgtcatttctattctattgatctgtacgtctcctttgtgctagtaccacattgtcttgattaccattgctttgtagtaaattttgaattcagaaagtgtgaatcctcctactttgttcttttcttagtattgttttggctattctgtgtctcttacagtttcatatgaattttagaatcagcttgacaatatctacaaagaagtcagctggaattctcacagagattgaattgactctgtagagcagtttggagagtactgatatcttaacgatgttaagttttctgacccatgaacattgaagtttttccatttatttaggtctttttaaatttgtttcaaccatgttttatagtttttgcaatgtaagttttggacttcttgtaattattcccaaatagtttattattttttgttaaattgtgaatgcaattgttttcttagtttcactttcagattatttattgcaattgggtaaaaacacaattatttttatatattgatcttgtaacctgcaaccttgctgaatttgttcattagttctcatagtgttttttagtggattcctcacgattttctaaataaaagatcatctcatctgtgaatatagttttatttcttcctttccaacccggaggtcttttacttatgtttcttgcctagttaccctggctagaacttccagtacaatgttgaataggagtaaaagtagacattcttgtcttgttcctgccctaggagaaagccagccagtctttcatcattaagtatattgttagctgtgggacttttgtaggtgtcctttattaggttgagaaagttttcttctagttgggtgtttaggcatgaggatttagtcaaattctttttcagcgtctattgagatgattctgttttttagtctattgattgatatgatgcataacttagttgattttcagatgctgaaccaaccttgacttcctgggataagtcttacttggtcatggtatgtaattctttttacatgttgctggattcagtttgctagtattttgttgaggatttttttatccatacccataagagatattggtgaataattttcttataatgtttttgtctggttttggtatcagagtaacacaggtttcataaagtgaattggaacatattctctcctcatattttttgaaagagtttgtgaagaatcacattcattattatttacatatttggtagaattcagtggtaaagcgacctgggcatgggtttttccttgtgggtagtttttttttttttttttaaattgcctattcagtcttttcatttgttataggtattaatatattcagaccatctattttttttcttgagtcagttttagtagtttggggtctttataggaatttgttcatctaagctatctaatttgttggtgtacaattgctcatagtattcctttgtagtcattttcatttctgtacggttgataatactgtccctgttctcatttttgcctctagttatttgagttttctcttttttttttcttggtcagtctaaagatttgccgattttgacattttcaaagaatgagctttttgtttcatcaattttctttacttttctttctttttttttttttcgagacggagtctcactctgtcgcccaggctggagtgcagtggcgtgatctcggctcactgcaagctccgcctcccgggttcatgccattctcctgcctcaacctcccgagtagctgggactacaggcgcccgccaccatgcccggctaatttttttttttggtattttttagtagagatggggtttcactgtgttagccaagatggtctcgatctcctgacctcgtgatccgctcgcctcagcctcccaaagtgctgggattacaggtgtgagccactgtgccaggccaattttctttatttttctattctcacgtcattaacttccactgtaatatttattattttcttccttctgcttacttttggattagtttgtgcctctttttccagtcttaaggtggaatattaggttattaatttgagatttttctttcttagttttttctgagttcctttaatatttttgggggagaagaagtttcacagcatcccgtaagttttggtatgttgtgtcttcatgtttaccaatattcgtatttttttatttcccatttgattcttaaggcattgattatgtaagaatgtgttgtttaatttatacatatttgtgagtttctcccattgtttttctgctactgatttctaatttcattgtcattagaagacatactttgtattatttctatccttttacatttattgaggtatgttttatggccttgcagatggtctatcctggataatgtttcatgtacccttaagaagaatgtgtatactattcttgggtagagtgctctagaaacatatgttagtttgttggtttatagtgtagttcagatcttctgccttcttgccaatattctatctagttgttctatctattattgaacctggactattagagtctccaaatactattattattattattattgttattattttgggtcagagtttcttttttttttttctttttttctttttttttttttttttgaggcagagtcttgctctgtcacccaggctgaagtgcagtggcacgacctcggctcactgcaagctctgcctcctgggttcacaccattctcccgcctcagcctcccaagtagctgggactacaggtgcccggaccacgcccggctaatttttttgtatttttagtagagacggggtttcaccatgttagccaggatggtctcgacttcctgacctcgtgatccacatgcctcagccttccaaagtgctgggattacaggcgtgagccaccgcgcccggcccagagtttcactcttgttgtccaggctggattgcaatgttgtgctctccgctcactgcaacctctgcctcctgggttcaagctattttcctgccttacccaagtagctaggattacaggcatgcgccaccatgcctggctaattttgtatttttaatagagacggggtttcactaagttggtcaggctgatcttgaactcctgacctcaggtgatccacccaccttggcctcccaaagtgttgagattacagacgtgagccaccatgcccggcctccaactactattattgaatggtctaccttcatcttcatatctatccattttttcttcatgtattttggtgctgtgttactaggtgcattgtgtttataattgttatatcttcctgatagattgaccattttatttttatgaaatgtccttctatctcttgcaacatttttttaaagtctattgtatctgacatggtataacaactccaactttgtgtttgcatgacatatttattttcatgcttttactttcaacctttttgtgtctttgaatatcagatgtgtcttctgtgaaaaaactttttatttctgtgtagtcctgttcatcaatcttttcttttactgtgtgtgtatttttgagtcatagtaagaaaacctcttcctacatccagatcaaaaagaaattaacccaattttcttctagtactcgtatggtttcattttttttcttacatttaatctttgattcatttagaattcattcttgtgcttggtaggagatactggacttaattttttaaaattgttattcagttgttccagcagcatttatttaaaaacatctgttttctccagtaattttagaggccacctttatcgtatactgagtttccaaatgtggttggggcatatctggacttcttctactccacttctctgtcaactcatacaccagtatacactgttttaattatgaaggctttgtagtatttttagtgtctggtagggcttatgttcccattgaggcttttctgtgttcctggctattcttgaaggttaattttcccacatgaactatagtatcaatttgtctagctccataaaattgcattatatttataaattaatttagggagaactggcattgtgatgatactgagttgtctcatccaagaagaatttatgtcttcccatttgctgaggaatacttttgtgttatttagttttgaaaggttttctcatggaggttttgcacatacccgaataaatttattcctaaatagtttatctttattgttgctattatacatgggagtttctttgtagtactgatttctgagtgccagttttatattctgctagtttactgaatccttttttgtgtgttcgagttataatgtgcttttttccagtatattttcatgagattcatctttgtggatgtttgtaactctattatttattttcactgctgtgtactattccattgtataaatatatcacaggatatttatctgtttgtatttggatggacatttagattgtttcccatttgttgaagttgtcaagtagttttccaaaggcgttaattctgttctcactcctttctgtaatgtgggagcctctgttgcttcacatttttaccaacattagctattgtcaatgcttaaattttgtcagtctgagggagtgcaaatggcacagaagcagcatgctttttaatgacttctcttaagtccttggtttccaaattctgacccaaatgctgcttcccacatggacacagtctccatggattgcacaccccacccccggcctgcttcttctaagtgcccctctctcattcagtggctgctggtaggagttgagaatggcaacgctgctttcctagtctcctgagagggaaacacacttctgtaaaaattaaacactttattagctgagaagtgtctggccctggtactggcctcctagaggaatttctttgctgacttacttgcattatatctgttgtataattatcaacaatcagcatccactgagtagcatcttgtacctgacactttactaggctctgaacagggcttagtgatgaataagacccagttccccaccactcctggggctttccacccgcttggaagaggagacatgtttacattaggtgatatcgctggataacaccagtgatacccagtgagcgtgtcaagggccaggttgctgacactgacagggaggtctgtagaaaatgaatgtggaaagaaaatcttctatcatattatattacaaattcaggaggaaaatctgtcattgaatgttttcttcttgttttaaaaagctgaattcattctgataaaaatgtatataccacctaaaaatatacactctatttttccaaccgacacaatcacccacaactgaaaattgaccttggagccctgtcccacctctaatgggtggatctaggatcaaccctatttctaaaggggtacattgcaggatcctgggtcacgaggccagtggctggtccagttgtggccttgactcaggtgtccttcccttatttcttatgaccaaaccaccggctctgtgcttctccatatggtgtggtctattccaagctcctggtatcttgtggatccaagacctgcctttatctccccagtcttcgtgaaataagagctcttctcttcctttagtgtttggggccctgctacctctcctgggcatttgaaagctaagtgcccactcacctcaggtccagggatgtcctccattagcatttccctcattctgctgcccagcaaaaccagggttaaactaaggtttggttacagcatatgggtaagaagtttccatgctcaataaaatgccacgtcatctactttataaaagggtaacacatcccttccgagctggaagcctctctctccatgcttgctcctcttgtggccaacagcacaccctccaggcaactggggagcattgcaggtgtagaccgggcttccgtcaggcagtgctttctggcagaagccagctggcttgtgcagacatcttgtccatagccttgaccttactggatacacttgctaacctcccagacaaactgatccaggctcatgaaagttggtttgttctttggtttgttcattgtgcattcattcatttgtttgttcatttggtaaacacatactacatacttcattgaaaattctgcaatgatcaggtcagtcaaaatgcacacacacacaaagagcctctttctccctttaccctattgagtattgggtaccttattgggcatctgagatgctgtggaatttttgccagaattttacctgtttgtctacccctgtgctaggtgatgtgaaagctacatagggcaggggcttgactcttgaaaaccatgtgattctgttgaaggtgtaaatcaagccagcccacaggaagcaatgagtcaacatgtgcacctctgtgttttgctcttgtgggtccgagaagaggcgcttaaattgcccagtgttcattgagggctgccgtgggttgggattgtttcctagaaccatagctgagccttgaagagtgggaaggctttagacagattctggggaaaggtgtcatacctggggagaataacttgactatgtgggctgagagtaaacatagtgggttctgatgatgtcgaagggaccagcttgatgatatgtgttgtttcacatgttaaatccttgggacctcctacttgactagatcagcacttgagcccttcgtatagaaagctatgtgctacagtgaccattgctgggccgactggctggcatggggctgtggttgactctgtcctgggtggggccgtggagacaccatagtctattcctagtctggccatgataccgaaatagcctttaaccatgattcaaggccccaccctttctcctatgtgattgttgtttgaatacttctattttgttgttgttgttgttgaaactgtagggtaattacccttgtccttaataattgctttagtttccttgatgcgcagagatgctctagagtctacgctgttaaaaagaggttaggattaagtttttcaacctgccgctggtgtgagaaggatgtctccatgccaattactgtcttcttgataggattagtcactgtgttaattgctactcagaaaaactgccaagtttgttgttttagacattggcttttaaaatattgcagatgtcatctcaaatgcaaattgtatttggtattagagataactgttgatctattaacactttggggttgattcatatctgaggctgtgtgagtaaaaggagtctcacccttggattaattgcatctttgatggtggttccagaactgggagggggaggcagctgtcaggtctgtttcttggcactctctttgagagaacccagagctctgtcagcaacaatctgttggaattggccagcgtaatgtatgaaacaacctcgttcttcagctcaagagcatcacctacctactccacaggtcgcagtggttggtaagctcctggtttaccttgaatgttgacactccagggagggtcaaatggccacagaagttcttaatccttagagatttccgagtcagtagaacctccccattttggaccaggaaagaatagagaattctgacattacatagcatttaattttttattaatgttttatttttaagtcatttcaagatttcagaaaagttgtaggaataaaatgaagaattcccatatgcccttcacgcagattcccgatattaacattttatcatatctgtcttatcattctgtatgtgtgcatgcacatgactgaaccatttgaaagtaagtttcagacatgatgccccgttaaccctaaacacttcaatgtgtatatcctgagaactaggacatcctcttgcataagccagtgcaatggtcaaagtcaggaaaatagtactaatgcaatagcattatccaatctgtagactttattcctgcaaccaacaatatcctttattagcaaaatacaataataaaaacaatagtctgttgtaggatccaattcagaatctcacgttatgtttagtttccatgtctctgtaatcgccatcaatcaattcttcagtctttgtctttcatgaccttgccatttttgcagcatacaggccatttattttgtagactgtcctttggttggggtttgtcagatgtttccttaggaccagattcaggatatgcaattttggcaggaacaccacagaagcgacattgggttgttcttagtgcatcgtgttagaaggtgcatggttgcctgcccctttactgggattgttgactttgaccattggttaggatggtatctgctaggtttctccagtgtaaagttattgtttattctcttcataattaattcgcattttatggaaaaatagtttaggtctgtgtaagtagcttgtatttcattaaacttttaccccttgatttagcatccattgataattcttgtctgaatcaattattataatgcatgccagatggtgatttttctctaaatttatttattgtttagtactctgtaccaaattggaaagctttttgctttcttacatttatttatttactcattgattcgtttatacccatatggactcatggatttctatcttagtgagtgacattgactagattatgttgactgagttacattcattaggttatatatttgtccagtggtttataacctagttgttttggtaattatattgtcacagatttggccaatggaagccctttcaatttggctactgtgtccttttgacaaatccccataatatttttccacaacattttattatgaaaaacttcaagcatagagaacgttaacagatttttttcagtgaacactcatgtacctatcacctaggttctttaatgaacattttattatgctgtctttatcatagatctattcagctatccacccagcaatgcatcttgtgtttaaattgcatttcaaagtaagttgtagatgtcagcacacttcatccataaacactttggcaggcatgatagtgtctcgactttaacatttatttacagttcttttactcagcaaaacttacttacagtgcaaggtacacatagtaagtgtaccatcgaacaagctttgaccagtgcatgcacctgtgtgactcagacccctatcaagttgtagagcattgcagccagttcagaaagttctttcatgtttctttctaaccagttctttctccatcgtcttcagcagcaaccgctgttctgattttattctcaccatagattagctttacctgttctagcacttcatctaaatggaacatgtgcaatatacattcttttgtataaggatgatttcactcattattgtgattttgagattcatccgtgttgttgttatcagtggttctttgcacccgtcattctttgagcgcttccttttttctggtccagcaaaatgtcccaaggtcgccttccacttcctctcaccaaccctgggattagctcaatctctaatgagccccggctcctttcagcagagaatggtttctgaattccagctgtgtgccttgcgagtggtatgccattgcttctagacactctctgccttagtagaagaagctaagcaatgcatgtgtgaggatacattcatagatacacaaacacatatatatccacacctacttctaaacatccgtgttcatggatgtgtgtaaaaccatgcattgtgatgataccaattctagtccaacatcacagggttcctcctagccgttcatctttccatatgtggcactttcttttccaacatggagaaattttcctgagtatattattgtctaaatcctaaatatatataaaataatgaaataagagttaacctataccactgaagaaagcaaacctaccaactatagttcaatgtttgtttatagcactttttctttagcctgagggcatataatcaaaatactgtgttcataagccttttgggttaatctctaccccctttctctctggttatgttattcttggaaataaaatataattaggctcttttgtttttttgcttgtgttctattttatggtctctccccatccttgttgatttttttaaggatggaaaacattaacatgtttataaaaatcaaaactatgcaaaaaagttagatccagagacgtgtcactgcccccatccctccccacacatgggtaaccactctcattattatctccttatctgttttgtgtttctttgctgagataagcagatacatgtatactttcttattttctcctttttttcttacacaaaagacagctactataaatactcctttgcacattgcatttttttaaattaaactttctatttcaagacaactgttgattcacatgcagttgtaagaactaatacagagagatgatccatgcaccctttgagctgtttttctcaatggtaacatcttgaaaactatagtagagtatcacagccaggatacttgatgttggcacaattaagatacagaacatgtccctcacctccggggtgctgcaggatgccctttttagccacacccacttcctcccctcccctacaccctctttgactctttgcaacccctaatctgttctctatgtctataatttttatcatatcaagaatgttatataattggaatcatacaataaattaccttttggaattggctactttgactcagcataattgtctcgcgattcatctagattgttgcatttattaagagtttacttctttttattgctgagtgatgtaccatagaatgaatgtgctacagtttgtttagccctttatacattgaaggacatctgggtgtttctagttcttggcaattacatataaaatgtctataaacatttgtgtacaggtttttgtgtggtcacagatttttatttctttgagataaatgcctaggaatgcagctgctgggttgtatgataactacatatttagcttttaaagaatctgccaaagcacttttcaaagtagccgtgctttattttcccaccagcaatgtacggatgaccccatttctctgcatccttatcagcatttggtgttgtcactattttttattttagctcccctgacaggtgtgtaatgttatctaatcgtggtttaagtttgtatttctctaattggctaatgatgttgaacacctttgcatgtgtttattgccatctgtatattctctttggtgaattaccttttggagtcctttgtccattttctaattagattattttattttttattaagctttgggggttctttatatatcttaaataccagtcatttttctgagaggtggtttgcaaatattttctcctaatttgtatcttcttttgcatcctgtccttcacagagcaaatattttttttcttttttttaaatttcttttttttattatactttaagttttagggtacatatgcacaacgtgcaggttagttacatatgtatacatgtgccatgttggtgtgctgtacccattaactcatcatttaacatgaggtatatctcctaatgctatccctcccccctccgcccaccccacaacaggcccctgtgtgcaatgttccccttcctgtgtccatgtgttctcattgttcaattcccacctatgagtgagaacatgcggtggttgtttttttgtccttgcgatagtttgctgagaatgatgttttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacacacatgtgcatgtgtctttacagcagcatattttataatcctttgggtatatacccagcaatgggatgggtgggtcaaatggtaattctagttctagatccctgaggaatcgccacactgacttctacaatggttgaactagtttacagtcccaccaacagtgtaaaagtgttcctatttctccacatcctctccagcacctgttgtttcctgactttttaatggtcaccattctaactggtgtgagatggtatctcattgtggttttgatttgcatttccacagaacaaagattttatttatttttttctttttttgagacagagtttcactctgtcacccaggctggagtgcagtggtgcaatctcagctcactgcaacctacacttcccgggttcacaccattctcctgcctcagcctcccaagtagtggggactataggtgcctaccaccactcctggctaattttttgtgtttttagtagagacagggtttcaccacgttagccgggatggtcttgatctctggacctcgtgatccacccgcctttgcctcccaaagtgctagtattacaggcatgagccactgtgcccggcccaaagattttaattttcatgaagtctactttacccatttttccttttatatgttgtgctttaggtgttaagtttaagaaccctttgcctagtcctagttcccaaattttctcctatgttttaagcccattgtcccttccaagttagtttttgcaggtgtggagaagactttggtggagactttttctttctttcttttttttttttttgcctgtggatgtctgatcactctaacaccaattgttgaaaaggctatctttcaacaaagctatcttgaattaattttggcatttctgtcaaaaatcagttgggtgtatttgtgcaggtctctttctgggttctctattctattggtttatgtgtcaattcctttgctaataccacacagtcttgataactgtagctatataataagccttcatctgtatcctgacattcttatttggaatatttgtgttttctcattctttgatgaagtttagcttgtgattatcctattttttaaaaaaaagacccgaaattttggttaatttgacccacctcatttatttctacatctaactttattttcccctttcttatggttttgctgttgttcttcttctagctttttgagcttagaattttaaaattttaatttttcatttttactaaaataatgaaaaaggctatgaatattcagtccgaccactgttttaaatatgtctcataaattctggtatgtagttttttgtttgtttgttttctgagatggagtctcactctgtcgcccaggctggagcgcagtggcgcgatctcagcccactgcaacctccgccttccaggttcaagcgattttcccacctcagcctctcgagtagctgggactacaggcacacaccaccacacctggctaatttttgtatatttagtagagacggggtttcaccatgttggccaggctggtctcaaactcctgacttcaggtgatcctcccaccttggccccccaaagtgctgggattacaggtgtgagccaccgtgccttacctggtatgtagtgttttcatgatcacatgtacatttttggaatttctattgctttaattttgaaaagatttttaacattattttccagttttattagactgtgatcagaaaatatttctttgtaatatttctattttatgaaatgcattgattatcacctaacacgtgaccaacttttgtgaatattctatgtgtacttaaggagaaggtatagtagattccccatctactaataggtaattcaaggaaaaagtatgaagtatgactgtattagtctgctctcacattgctatgaagaactacctgagactgggtcatttataaagacaagaagtttaattgactcatggttccacaggctttacaggaagcatggctggggagacctcaggaaacttacaatcatggcagaaggcgaaggggaagcccgcgtgtcctgcgtggctggagcaggaggaagagggtgaagggggaggtcctgcactcttccaaacaaccagatctcctgagaactcactcactatcacaaaaacagcaagggggaaatcctcccccatgattcagtcacctcccccaggctcttcctccaacactggggattacagtttgacatgagatttgggtggggacacacatgcaaaccacatcagtgacaaattgatttgtcaaggaaattgattatattgtttagggcttctgtgtccttacttattttttgtctatctggtttctcttgtactgacagcggtgtggtaaacacactattcttagtgttttcatctatatttcctacagtttctttctttcattttccttccttccttcctttctttctttcgttctttcacagaactgtcgcccaggctgcagtgcagtgttgagttctcggctcactgcaatccccgcttcctgggttcaagcaatccttgtgcctcagcctcccgaatggctgagactacaggcaggtaccaccacgcctggctaatttttgtgtttttagtagagatagggttttgtcatgttggccaggctggtcttgaactcctgacttcaagtgatccaccattcttggcctcccaaattgctgggtgtgagccatcaaacctggcctatatttcctacaatttcctctcctgtaaaagtggttgtagtcttgtttggtgcactaatactcattatggttatatttttattgtggaatgtgatttttagcattagaaggtgtcataatgttgtttcttaaattatacttattctactttgatatcaagattgcaatacttgttttgttatttccatttgcctcatatgtctttgccatccttttagttttaggctttctgaatctctttgatatggttcggctctgtgtctccacccaaatctcaccttgaattgtaacaatccccatgtgtcaagggtgggaccaggtggagaaaattaaatcatggggacagtttcccccatactgttttcatgatagtgagtcctcacgagatctgatcgttttataaggggcttctccccctttgctcggcacttctctctcctgtcgccatgtgaagaaggaagtgtttgcatcctcttctgccatgattgtaagtttcctgaggcctctccaaccatgtggaactgtgagccagttgaacctctttccttttataaattacccagtctcgggcagttctttatagcagtgtgagaacaaactaatacactctttttaaaagtatgcctcttatatataacatatagttggatctttctttttaagccaaattgaaaatttttttattttcataagtaaacccattcacttttatttatatgtccaatatgtataatatcttatataataaatgcaatgtgtattatgttctacttgctgtacttgtctttctacatgatgcattttctatactcatttaatttctttttatatataagaaattctcatttttagtctaatgggtacctttgtactcattacctttaaaaatccctttagtctcttactaacttttaccatttggtctttcagttgttaatggagtctcttgactcctacctgttgcttatacaagcatcactgagcttattctggttttgtctttcctttttttgtttcctatcattttgtagttgacaaaacatatataatctatgtatgattctcttaaccttagttacacacttaatttaggtccataattaaatatattaaatgttccccataagttcctttgccaaagagtccctagtcatctcctggttggatgaagttaattttctagaagattccttcagaggcgcctgtgggtacatcactcaattctcccatattttaaactcttattctgtacctctgatttttgagggtctgcttcgctagatataaaatctttgagttttatgaaactgctgctccatccttgccccaccttctaagttgtttttgagaaggctgacaactgtctctgttgcccttatagtaagttatttgatcttttcatttacaagcgttgaggatatttttcaaatgcatcgttgaggtttttaattcagtttgtagtgttatgacacagttcctccccctccaccttatggttgggattttggggtaagtgtcgtattctcattttagttttttttctttcatagtcttctacagatgaagaccacttacatcgccacattgagtggttcgtgtgatttttagttcaagagctccctcttctgtcagtgcagcgaagtgcagtttctttatgactggtttttgggggaggggcgggaggagttgagggtccttggatgtatcattattttttgttttgcagaatcctaaatgcccacatctggcttctccctccctcccctgcacatttgccaatgctgcccctgcctacctttaaatcacttccttctagtccatattctggtctatctggattcatttttggtattttcttccctgtaggatgtactttctctttcttcaggtaattgtaatttattcctaaactctccatgctcgacgtctgccttcattggcttttggacccatcttatcctcttgctctttataaaagttctgggtgggaactcaagaatttgttaatttgatgtttatagtgtctcttttttccagtcgtgtgaaaggtgtgtgggatttgtgtggttgtttttgttcttcttgttgatctgtgtagttttcagaggatgcgttgggagatttgagtttttgtggctatcattaccttggcgacctggaagtcccttacgtggcattttaggagacgtgtgcagttatatcaatttcaagtacaattgtaactcaagcctgttatgaacaccatcttttcatgttaattgtaccataaaagaatcttgaggatatctttaaaaggtctgctctcttacgaaggtgaagtgtctcccctgtaagcttgtttacaccggcatctgttcagccagccctttttcatagacacttcagccaaatactggcgtgttttccgtttctgtgtttacggttggactcaacgagccttttactattgtggcatatgggagggagcgttgccattctgctgccaggggtgagtgtgatctggtggctgttacattgtgtatatgcgagtaggtctctatcaagaagggacccgccatgcttacctggcacgggagatataccaggatcctgaaggtggtactcccagggtgaggcttatccattgtgcgccagatgtgttgacccttgtgatttccccaaatgtgggaaactcactgcatcatttgtggtagtgggggactgtgtctgtgctctctcctgacatttgaattttttcttaaaaaaaaaaaaaaaaaaaaaaaaaaaaaaggagacacaccatcttccatggactgaatatctgtgtttctccagaatccatgtgctgaagccttaaccccagtgtgatagtctttggagatggggtctttgggagggaattaggtttaggtgaagttgtgagggtggggccccatgataggattagtgcccttataagaagaggaagaggggcctggtgtggtggctcacacttgtaatcccagcattttgggcagctgaggcaggaggattgcttgaagtcaggagtttgagaccagcctgggcaacacagggagaccccatctctaccaaaacaaagaaaaaagaagaggaagatactagagctctctccctgctttgtgaggacacagtgagaaggtggccgtctgtaggccaggaagggagccctcaccaagaatggaactggctggcatcttgatctcagacttcccgtctccagacctgtgagacataaatgtctgctgtttaagccacccagcctctggtactttgttacggaagcctgagctaactcagatgtcagccaaccatatttttacagcattctcatacaaagcccgaaaccatagtcagattcagcgctgcgtggcttagggaatgcgccacgcctgactcattgcagggggtcaagaatgtttgtgagatgaatacatggagtatctttgttctggaaatagaccacctatgaattattatagtagagaaatcccaggcctcctcgaaggacagggaaaacctgtaaagtgtctgtactttgggcccagaggaataatggaaagaggccaggcacgctgggaaatttccatttacaaacccgccttctgctgggttgagtctcgcctgctgtgggctcagggatcctggcctggcctattttttctctgggtggataccccattcccgggagcgttcagatccctgaagacagcttctgtctcctccgagaccactgctgagtcttgtcacctggtgttcccacagtgccaccctgtcttctcttgttctctgtgggttccagaaaaagggaccacctcggctctgtggctttggatctctccagaggagggttaaggcctcagatagcttctccaatgggacacagccaacatctgagctgcattttcaaaatgagagccaatcttaggctgagtcggacagggagaaaggaattgtgctcgggcacccaggtggcacctgctgtcccctgacctggcaccacgggcccaactttgggttttaacttcccacgagtgcctggacatggagaagaagtggtggagaggatgaggacatatggggagcgatctccagggtcactgaggtcctgtctcctgcctcccgctccctagggccctccagctgggcccaggaggtctccctcccacctggttgtcagtcagcttctgctgtgccctcacggggaattcctcctagagcccaccaggtgggagagccagggcagcaagcaccgaaggccggcacggcaccagcacagatgaatggcccggctttctcagaacccatcccctggaacgctggaggcagtgcaggaagggccgggttctatgagaggaccttaggcagcaggaatactccatgacagcagagatgctggggccttttccccagagccttattcttttttttttttttaatctttagacagaactctcattcacagcatttagttacttgttcattcattcatcattcattcactcaagcacttgatgggtattgcactctcctaccttgtgccagagactgtgtgagactcggagagttggtaacacacccagagtcttgccttcgggggctttcacgagcagagccattgctccggcttttgggtttccatagtgtgcattagcctttgaaggcctccaggaagtccctccagaatcagacctgttccattgtgttcactgagaattctgcaaatttctttggtgatgggacttgattcttctttatatggtaccaggcagaccagtgaatgcgtcgtgaaacacctctccaggcccgtggaatggggtggggaacgctggggtctcagtgtgagcctggcctttggattcagacagtgctgaattacagtctcagccctgcttcttgctggctgtggggctggggccacatgaaccggctaagctttggctttctcagaaatagtttggggataatgattcctgcctagtgggaagattaaataagataaaggaatggcaaagttttatcccatggtcagggaggatggtgactgccttgtgccatgggtgacccctgccttccttcagagggcatgtgcacaagctggtgcatacacacacacacacacacacatacacacacacacacacacacaggcttcctgtagtcctcggttgcctgggaggcagcagtgactctgccttctagaagtcgtctgaactgtctgctttccaaacaggggcgacaggactgtgactcgaggtgatgggttgctgaactgctctgctgccagacacattttgctggcttctcataatgtcactgagatctgggaaatggaccaagcacgatttccagctaaatgaaacactttggggccatcagctaaatagatgatgcttttgagaaaaccccatgagcattgtgtcagacaggccgtgggaccctgcaagcctgtctttttctgtgctcgtctgggtgatgagacatcgcccgggctggttccatgagcacctctggctgtgaggacctgcgtcttctgtctcaatgcacctgcggggaggctgagatttgatcctcatggaacattcaatcctttctgcatctcgctgtcttcctgccctcctctttctcccttcctcttgcctgactgttgactacaaaataggatattatttaggaacgtgtccttgcctccctccctggctctacatcaccccatgacatagtggctgtgctcaggcggagagtgagttatgtttctgtgggcaggagtgggtcatgagtcctgagtcctccctagacagccccagccctttctctttgttccaaggggcccagccaccatattgattgtttcatccctctgcactgcccagagctgcctcctggagcacgctctcttctttcctgatggcaacggtcccacctgatggcaatggtccctgggccagaggatgcccattggtcttcatggagagagcttgggtcaggcccacttggtctccaatcctggcttcgccgcgtgccagctctgcagtggtgccagcttatcctgctaagcctagcttcctcttctacgtgggtatatctgcctcaggtgcagctgtgaggatccggggtgatgctcatgaggtgcccggcaccctgtgtggcacagaaatgaccagaaaataccaactcacccaatgccaagtcttcactgtccttaagatctcaaacctttttttcttgatcttcttcccttgatgaccaacgctcttgttcctctcgcccttgcgggccaccccctcatacatctttccttgggccacaacttaggcctttgccttgcctttacttacctgttgatccacccacccacccacccacccacccatccaaccattcatttcttgcttcattcatccagtgatgtactgaatgtttcctacatgtgtatgtcaggctagggtgagcaaagcagattcagtgtctccctaccctaaacttagtgcaggagaggatagagacaatggaacaggtgcatgtgcgtgtgagtatgtgtatgtgtgattgtgtgcgtatgtgtgtgagtgtatgcatgcgtgtgtgtatgtgtgtgtgagtgtgtgatgggaggtaggtgctaacagggagagtcttgagaaatggatactagggtcacctaacagggtcctgaggggtcaggaaagcttcatagaggaagtgactcttacctccttgagcagatataagcaacctgaggccaggggttgtgctttctagggcctcagaacaccagcatcgtcaacaggtgagtgcctgccatttatatgaggccctgggtttgcaaagagggatgaatatgcaacataaatagtaatgcaaagggacagttaataaatacttgtccgatgaattcatggatgcatgtgccattgccaggcttatatttgctaagcaatcttcccagcatgtgttaaatctctgactcaccatgaataaggagcttagaagagctcatttgagtttccacgtggttcatgaatatgcaagcgagattccttttaatctcaaattttattttattagatgtatttacatgtatttattagttctcaggtttaccttggggcctatgggatatttaacgaaggtatcatcccatcttcactgcagttgttagagggcggggtggaagattgctgaataactcgatcaccccagatgaccagagatcttctgggtgtgtaatgaccacagactaatcttaatcataatcactaccatgaacccacatgacatgcagttgtataaaggatggggcaccttaacgtttgtagcacctttacataaagccagagtgctcaagccatcctggacctcacccgatgggagggagaatgatgctctgccaggtggaggccttaggtcttgtcagtctccttttactgcaggagaggctgcaggcttagctggaaacataatcgctgctcaaggtcaggctgtgcccagtggccgaggcgcttggtgagctttccactggatggcctaaatttgcaccgctctgcaggctctcgtcccagttggcaagggcgccacagctggatggctcagcgtccacccaaagggaagtggaaaaaccagcagctggctgaatctgagaaggttttcatgttcccaacgagatccaagagcaaaacagttttctgaaactattttccacttgctaaaattaaggttattattattatttttcaggaatctgctgtgtacgggttttatttttaaatgtcatcatcgttttgtacaggagcacaaaactcatgaattccgtccctgctcaagcggggtcccaggttggaggcgtgacacccgcgcctctccgctggtgtcattgattgctaagggcaaggctctagggttagtggggacctgatgaaagcccacctggggctcttgatgtgggagtgtttggtggatatgcctccctgccccgctccccagggccctgctccgtagctgctccatgtcgtctggatggtccgttggcaccctgcccaccgcacttcagcttcccttgctgccacctgcatgggctgctgccctgatgagtctcgggtcacatgagctgcatccttattgccgcagccagcagatggcagaaagcgccttgaccccatcgtctagtgtctccttgactgagatgaggaggctggaggagaggctaggaagagtcaggaaggggctgtaaggggccagctgggcagggcactggagcctggggcaaattcttactgatcttggcagatctctttttttttttgagatggagtcttgctcttttgcccaggttggagtgtggtggcacgatcgcagctcactgcaagctctgcctcccgggctcatgccattctcctgcctcagcctcccgagtagctgggactacaggcgcccaccaccatgcccagctaatttttatattttttagtagagacggaatttcactgtgttagccaggatggtctcgatctcctgacctcgtgatccgcctgcctcggcctcctaaagtgttgggattacaggcgtgagccaccgtgcccggccagcagatctcttttattacccagaaagacctctactgtcaccctttccctccccaccaacaatatcctgggagccttttctccgagtggccctgggaattcttcatttaaggcattggatttcccttggaacttccctttcctggggttgtgggtggggtgttgctgagaacacctgggagggtccatcaacaacccatcaagagtggcgaggccggcaccccagtgcaatgtgccagcggggttgacagctaccccagaggaaagggtggaagctcagacacttagcaggatttcgggggttcacttctctgcatcagtccctctttggagaaggtcacaggcgcatgatcatagacttttggttggctcagagttccctcgacagtggcatttccagctcagaagttcagggtctagtctccctgcaggaagatggtgagtgacagaaacacatcccctcgactgttccagtgtggctcctctgctcatccctacagggttcctgccagcagcgaacctttccgagccactgattcctcatctcaggggttgggatcctagcatccccttttgggggtatcctaggatggcagatgtgggatggcctggcgtgttcagcccagtgcctgtccacagccccttgaggcaggtgtttccttcttgccttctctggctttgagttcagttgtccccacatcccctgaggatccaaaaggggctttttaactctgctcaatgagaactttccttgaggccaaacacgtgcctccaaagaacccacttttagggggcatgcaggccaaggtttattgcagtaaaaggaggtgacacaaagctcactgcctccccctcaaattcccgccccgccacctcaccctcattgcctgcccctcgtggaattacaatcatctgcttgttatttgtgatttccacttgccttcaggctgttccaggcaatggctgagtttcatcacccttacatccctaggactgggtgcagagcaggtgccccgtgaatgcttgctgagttcatgctgtaatccctgtcctttaatttcatttaaattaacatctttctctctgataaagatagaacaggctcattgaagaacattcttaccacacagaaagatacaacaaaaagcaaccaacttcacaaacatcctctgaagtcccatttcccagagatagccagggtcaaggttttagagaactcaatgcttccggacttttccttatgtacacatagacatataggtgctgggtaagtgaagaattctatagaaatgagatctcaccatgcattccattttgcaatttttttttaaataatggagctctttccatgttaacaaatagagatatgcacattttttctaataactatctactattctatcaatatcctgtgattcatttaccaaagcagttaactgaagccttttttattttttattttttttttgagatggagtctcgctctgtcacccgggctggagtgcagtggcacggtctcggctcactgcaagctccgcctcctgggttgacgccattctcctgccttagcctcctgagtagctgggactgcaggcacccaccaccacgcctggctaatttttttgtatttttagtagagacggggtttcactgtgttagccagcatggtctcgatctactgacctcgtgatccacccgcctcatcttcccaaagtgctgggattacaggcgtgagccaccacgcccggccaactgaagccatttttaggggttttccacactcttcctatcataaactaggctgtggagaatgtcactctgtccgtctctgtgcccctgtccgcccaaattagtgggaccaaccccttttacaggacaccaaccccatttataagtagtttacaggatgctactttgcttctgtgaacttatccctttgttttattgtttttcgtttttgtgagatggagtttttgctcttgttgcctaggctgacgtgcaatggtgtgatcttggctcaccgcaacctctgccttctgggttcaagcgattctcctgcctcagccacctgagtagctgggattacaggcatgcgccaccatgcctggctaattttttgtatttttagtagagacggggtttctccatgttggtcaggctggtctcgaactcccaacctcaggtgatccacctgcctcagcctcccaaattgctgggattacaggcatgagccattgctcccagccgaactcatccctttgtaaacgtcaagtttctcctgtgtgggccaatgttcctgggggctgcctgggtttcctaaaatgggggtaatgatcttttatgacaaggggcatcctgaggagtgaccagtgactgagaaaacctggtagtctctcttgctgcaacaggattgtatgctgcgtgaggacaggaagggctgtttcttctagcccctcccctccccaggactcctcacccagggcccctgcacatggggactcggggtggctgctgactgcaagaaagaagggccaaggcgggagccccaggctggcagcgctttgtccctcaaacctgccaaaggttgtcgccaggctttgcactcatcttctcagccacctagctcccctggcagtaaaacattattttctatgaaatgatatgtctgacatttaccaaatttttatgtgacaatttagaaggaactggttgcattaaacagccttattaatattgcagtaacatgattggggaacatcatggctgttagaccacagggctctgatttataagctctggaggcacagaggtctccattgaccaaaacaccttcagctcaattcatgtatggttatcgaaatccagagatgcagtcctgtgatcacgcagcccgtcaaaacaagggtggtgttgcgagctcttcaagaactccggactcagccgggcatggtggctcacgcctgtaatcccagcactttggggggccgaggcgggcaggttcatggcagtagtcaagtggggctcgtgcatgtgagccctcggcatagctcctgactctcacttcgtgctcagcaggtgtgggctctcactgcggttccagcagggccctgtggtctctgttcccagccccagttaggaacacactggagatacttttggagactcttctagatctgcagaagaccccaagataaagggctgtggctctcccaggggttttcagccctctggggacagacatgtggagcaaactgtaatgaagcaagagcacctacaggggcctcggaccggggatggcgttgcggcacaggaggggtgagaacctgccagcagagcaggaggcagtggcattcgggattggccctgaggaaccaaccaggatgctggactttggccaggggatgaagctctgggtttgaaataggagcctcatgatccacagctgccttggggcactttggactaaggtgacagtgtgtgctgtgacaccaaggccttagggcacattgtgctgctggagggggatgggtttgggtcagggggcttaaggatgcatgggaaggggccacagagcaggctgagcccagggggagggctctgcacacagcccaggaattcccttcacagcagtacagaaagtgtgtgcgtcaggacaggcatctccctggagcaggtggaggggagcccagagggcagccccgcagagtccaggaggagatgatgaggccaccccagggacagcagggcctggggcagaggagggagagtggaggtgagagcagagggggctgagagagctctaggggacaggggttgctgtccttccatcctccctgggccttctgcacggctttgccctggcactgtgggccatttcccagatttgtagaggttgtcaaatgcacccctgttcccagggagccgggaaagtgagggcagatggtgaagtgttgcagggctggaccacgaggcagctggaggccaggacaatggactgggcagggttgcagggccaagtgcagtggtgagagcaggtgagaggaggggaggggaggaggggggtgtgaaggggagaaggaaggagggcaggaggaggggaggggaggggaggaccagaggaagcggagaggaggtgggggggtgaggaggggaggattggaggatggggatggggtggagagggggagaggagggtgaggagaggaggggagggcaggaggaggggaggctaggaggagagggggaaggagaggaggaaggagagaaggaggagaggggaggaggcaagagccagtctggagggagcgagcctgtgagccaggagcacagagggcgggggttgggcctcagcgtccttcatgaagaactcaattcttcaatggcagaggatgtttctttttcctctggttataaaacagttgatgttctttatagagaagttgagctacagataggtaaaaagaagaaaatagcccgcatagtcccccggctccccgatgaccattggtgagaagtgaggcctggtattcacaatgactcacatccagatgtttcttcttggggttttgagaggccggttgggctgaagctccaaggaatgacctgaaggccctggtgaagtgttcctggggcgctttcaccccaaggagctctgagcagccggagaaggggctgaggtatgtgggcctgtgaaggacaggagcacccagaaagccggttcctagggtgtccccccccaccacatctggggaaagcccagcctggcctggctcctggcccggccctgaagcctaggtttgaaattgtggcttaatgatccacagctgcgcttttggttgccagcgccctcctgaaaaactaaagaaggccttagcaatttgagagagctctgggaagcaggaatgaggccggggtctggggaggagggtggaagaggaagaaagagtctttgagggcactggcaacccccagctctgagcctgtgccctctcccggctttcttgggctcctgggtgctgtggatcttggctgggctgctgctctgggctgaccccccccccccgccccgcaaagctctgtggaaagcgccttacctgcttatctcccgccatctggaacatcctcctgaatctctgcctcatcgcccatcatctgtaccaaaagccattcctctgattctagtgttagtcctggcagagtggctgcagttggctgtcttaggtgtgcgagaaaatcattgtttagccaaggaggtggagggtggagggttatccctcaggctcttcagctcgggagcccatgccggagagatctgggaaagcatccttatttgttggcccaggtgaagagcagccaggcagggcagccaaggtgactcctggacccagccccagcccccgggagccacgccagttggggagatggcatgagggactggcgcccgcaatgtctctaggagctgttggctgagggtggctgaggccctcagtcctgtcttgttgggggcacacagtgggatcctctctccttgaacccagagtcactcagcaccatgctcgtggctgagggaaccagtgtacagagggaccccccaggagcctggagggtgtggcagcaaataggagccatggctgcatccaaggtggaaggaggccaactgggtcacatggcaagagggactcccaactcagggtgcagtcgagtctgatcgtgggatgagagccccggtggctacctccctaagtaggataagcagcccccgggggatctgcccaggcaacctcctggccccttgacgtgggcctgaagcttggaaatagcctgatggtgtccaggcaagggctgaggaggaggatagcaggagagtccagggaagccaagcaggctggctcagggggccgttgcaggcactgcgtgaccccagcattcatcacatactggcttaatgtgtgtgtgtgtgtgtgtgtgtgagagagagagagagagagagaggttttattttttttgaaagagtctcgctctgtcgcccaggctggagtgcagtggcatgatctcgtctcggctcactgcaacctctgcctcccaggttcaagcaattctcctgtcttagtctcccaagtagctgggattacaggtgccaaccaccatgcctggctaatttttgtatttttggtggaggcggggtttcaccatgttggtcaggctggtcttgaacttctgacctcaggtaatccactcatctcagcctcccaaaatgctgggattataggtgtaagacactgcacccggccgagattttcaatcaaagctgctatgtggctccgatgagatggagatgacagctcccctatgcggcagccagacctggggccaagcgcagcctccctcgggtcactgcttggcctctgacatgtgctgtcctcttctgtcaaatggggatctaatcctattgaacaggattgtgcaggttaaaggaaaggcttcttatagtgcaaacaaagcaagcatggcctctgccctcacagagacttcttggagctcaaacagaacaaatgtggcctctgccctcatggagaccccagcagcagggatggctcagcctgccaactttcatgttgggggtgcatgcgatgccggggaggacttggctgggagacaccacccatcggaggctggttttgttctccctgagtgggtggtccccgcagagagagcggggcctgttagaggactccagggcagaggtgccttcctgatccaggaccctccagccctttgtctctggcctgtgtggctgggggacaccacgtggttggccagcagatggagggacagttgcctggaatcccagtctcagtggctgagcaaggcaccctggactccccaggtgtggctgtgctgcacacggctgccccggcttctcagcactcatggccggctctcgcttccccggaggcaccgacatctgcctgttcatcccagttgtcctgtttgctttggaaccaggagcatgatttacgtccgagtgcgtttttatgttttgcaccaaaggttttaaacagttcctagacaaaacaattctattttaatgcacagaattcctatcttgggttatcttctttacagccatatatgttttattagtttatttttattggcctatctccttgctagaacataagctccctgaggaccagggcacacctgtgtagcactctgttcccggtgcctaccacggggccaggcacgtagggagcctccagaaacaggttgagagggtgcacagaccggtgtttgcaggggccggctgtttatgtagctctccctttgtggcagctactctccgcccatctttctcttaatagttatggattatggaaaagaagaacaaagcgcattaagaggttcccctacatttgatttgaggaagttttcatccgaatggctccattgattggcctttcgcgtgcagccttattcccttctcacaaaatgaatattgccttgtctccttgagaaaaattgatttcagccagaaaggagaagagcaaactccctcctcctgctcttcttttttttttttccctcccaccgagacggaatttatctcttaggtaggtggggggtagaaataggaataattggaccagaagctaattcccagagattcattgtctcgaaagctcccaccagaatgtgagaagcttgccttgaattgcatgctaatgataaatgacaactctaacagaccgtcacattgagatgtttagtccttcctgctaggagatgacacattaattttctctcagatttacattggattcttaataaaatatcggtgttggaatatgacaagtgaggggccacggaagcaccaggcaccatttgggaggcatggactttggccggaggagactgcggtggggctgaacatgagccaggcgctgggtggcattggagcagggctcccatcactgtgctgggatggggcttacgtgacctggctgcaccaagcagcaggaatggctgatcctctttcttgactatagtgttgaatgcaaagacaggtgatgccattaattctctctcatcttaaacccccttttctttggcttgtcactgaccaaatgctttcagcgtaataagtgaagttttctatttttaagaaaagttgctgtttcttgattaatttgctcatttgatgaggacttatggagtgtttgctgtttacaagttatgaaggtagagaggcagaagcagcagccagacatgccaagtctaagtgatcatcccacttccctgcttcaaaacctccagttgcttccatggcctcgagagcaatgttcggaattctcggaggatccacaaagccccgggatctaacccctctggacgtgcagttccctttgtctggaaggcgcctctccccgttctttttggctgacttttactctctttaatccctcggcctactatcactttttcaaggggccggggaggtgggggtcataacccctctgccctggtctggacccagcctctctgtaggatgctgtcaggtgccctctgctttttcttccttgcgcttaccggagttgcactctccaggttaatttatgccgtcttacattttatgctacatttgtattaagattggagtcctcgcttttccttcatcgctgttaatacacgtgtacccttggttaattcgtgtctctcatcactcttacagtaaaatccaccctggttcaggagcccagattacttggggtgagccgctctctcgccccgtctcctgcccctgccctgttctttgtctgccagcctctgccaagcttcctctccaaacctgggcctcgccacgctctctaccgaaagcccttccagggagccagcattcatgtccttgccttcgcctccgcttccacccagatgctgcgtcctgggagaggcctcttggctgcccattgccacccactcacagctgttctcaaacccactcattcgctatctctggtgggtcccctttccctcctgcagctctggggcctgcccagggcgggcctctgtgcgtcattgttcttcctccctaccggactgcaagctgtgcagaggcagggctgtggcaccctcagcacccggcgtgaatgctcagccgtgatagctgctcagtaaatattaactgaacaaatcagtgaacgtcagcgtagagtttcaagccgaggccctgggagccctgggaaggtgccatgaaggaggcgttcctccagtcttgctctggagcgagtcttggtcattaccatctctccaaatgggcagcctcttcttttcagggacctccagagacaatttatgtgaacaaactgtggcttaacgatcttgggaaattggaaaatacaagttgacctttttttttttttttttagatagagtctcactttgtcacccaggctggagtgcggtggtgtgatcatagctcactgcaacctccacttcccaggttcaagcgattcttgcacctcagcctcatgagtagctgggattaaaagcacctgccaccacacctggctaatttttgtatttttagtagagatggggtttcaccatgtcggtcaggctggtctcgaactcctgacctcaggtgatcctcctgcctcaggctcccaaagtgctgggattacagtcgtgagccaccatgcccagccaaaaatacaaattgatttctgactctgagttctggaagccctagccacccttcatcctgttctcaactctccacaaagacattgtggcccttagagatggaatctaggtgtgtcccgacccgccaggttctcctcttgcttggttgttcgggatcagccttcctagggttatagcgaggattcgatgagactgactgcatgaaacactagctacaggatagtgccattggctatccttgcttttattcagaaaaatgaggccgggcgcatggctcacccctgtaatccagcactttgagaggctgaggcgggtggatcatttgaggccaggagtttgaaaccagcctggccaacatggcgaaacccctgtgtctactaaaaatacaaaaattagctgggcgtgtttggtgggcgcctgttgtctcagctacttgggagggtgaggcaggagaattgcttgagcccaagaggcggaggttgcagtgagcagagatcatgccatggtactccaccctgggtgacaaagcgagactttgtctccaaaaagaaaagaaaaatgaaagcacacgctgaatctctgggaacgaagctcttcggaagcaccagcttctgggccctgcccattgaacacggcaaaagcaggagcaatcacggccgtctggtggcttgtggggggcttttaggccgacaaatctatctagtcgtttgttctctgataagaaaacctcttttacgattttcaatttgcccttattttaatgaaaagaagctgggattggaccgcccaagaaggagctaatcaaataaagcaaattggtgctaccttctccttgtccttattattcgtatggctctagctggaatgtattatgagaagcaattggttttcatatctggcagattgcagcctgggccgggcctgtcagccttctcttccccctcttttcataaacagctgagagtggccgggctgcggggtgtgggggaggacacggaatgcttgtaaccagttttcttgctccttgtcccccaaatcgtgaagacccctgtaaacaagtcagaggaagtctccaggttgaaagttagtaagccagttccttcctgtgagattcgggctgtcgccgtggcttcttgaggttccatgtggcggtcctgtcaaccttgctatgtgcaaggcatcaattactgccctcgctgggtttgtgcgagggagagataagcagaggagacgttccttcatcgcactttttccctccccttgcaacaaaaggaagaactacaatttaaatcaggctcagcccgcccttgctctgtatgaagtgttttgccatgggcggttcttgggctccccaaagtactatgagttgttgtgactgtagaaggggaggggtagctggggcgtgccagggatttgaaacaagacatcaggagggggtgcagtggggcaattccctggttctccccttaccggctgtgcgacgttggggaagttacttcacttctctgtgccctaagccttctcaccctgtaaaatgaagatagcaatacccagctactaaagtgactgtcagattaaaatggaacatgggtgtaaagggccctccccggcacctggcacaaggtccatgcagaataaatggcagctcttctcatggtcgcagttgtcctggttgttactgacattttagtccaggccacgtacctctaatggtgcatggaaatcaggccattccgtgttggaaagatcagaaagaaaggtgcaggtgcatgaaatatgtaagctgcaataaagggtgacattcctcattttccaactgcccactggaacagagattctgcactggcctcaggaatagtgtccactcttctaggacactgcaggccctgtcttgtcacgggagcctgattgacatttggggtcagggctgggaggcagttggaactgcatgaactgcctttccctccagccaggcccttccctgtgccttgtggcaggagcgataggaccaaaggcattgggaggaaacagtggagctgacctagggtttgggttccagctggaaaaagagttctttagaagccatccagatactgttcctggagtcccactgggaactgggacatcatctgttcttaaaggggtgctgcaagtaacagatcttatgaattcagaggagcaatagccggtcaacctgaacagagcttattgcacaaaatctgctgcctccgggccagggctgggggaatgggctgacaggagaaagatccaccgcaagtccacggctcactggaatagcaggctgggtctcagttgtctgcacagatgaaattggtggttgttgaggtcctggaaatgatcagttagtgacagagaaagtgggggtttgagggagaggggccatgaaccagacctgttttggatgcattgatttctaaagcaagacgctggaaagagtgtctacactttttattttgcagaattaacctagtcttcgattcaatccccagttgctccataaatttctacttaatatccacacgcaaaacgtctcaagaacacatcacccctctgatcttcagttattaatcatcttttatctacctaatttgaaaaagatcactccctaaagtgataggtgagtctgtgagctgcaagtgtttggagctggcctctcccatgggtgggtttgccggctacaccttacaatgcaccatttcattactctctcagtcccctcattgttactccccacaggggaaccctacaaaaagaggacaagtctgttagttacagagaacatgtgctatatgacaggcagcacaccgggcaccttacacacatcctattcactaaaacagagagaccaagtaatttgttcaagatcacacagctcttaaggagctgagctaaaatttaagatacaacctagatctcactccaaatctcataatcttcttttaaaaaacatactattatggaaaaatttcaaacatctacaaatataaacagactagcataatgaattcacatatacgtatcattcaactttaatatggtcagtcttctttctttttttttttttttaaagcaaaaacattttgctatggaaatactggatggttttataggattcaaagggagagatacatctgaagcttgggcacagaatggcaacagggatgagactcggtggtttagagcaaatgggctgaagtcagatagtctggatttgaatgttgactctcacgcttactagtcctctgaccttgaaaatttgcttaaccactcagtgtactcaactctaaaatggatataagagcagtgcttcctcataggtagttctgagcattaagcagttaatgtacgtgaagaatagaacatggaatgaccaagactcgctgcagagcaagactggaggaattccttcatggctccttcccagggctcccaggggctcagcttgaaactctacgctgatgttcactgatttgttcagttaatatttactgagcagggccaggtgtggtggttcatgcctataatcccagcactttgggaggccaaggcaggcagatcacctgaggtcaggagttcaagaccagcctgaccaacatggtgaaaccctgtctctactaaaaatacaaaaattagcggggcgtggggcatgtacctgtaatcccagcttccagggaggctgaggcaggagaattgcttgaacccgggaggtgcaagttgcagtgagccaagatagtaccattgcactccagtctgggtgacagagcgagactccatctcaaaacaaaacaaaatatatttaccgagcagctatcgtggccgagcattcacgtggggtgccgtgggtgccacagccccacctctgcacagcttgcagtccagtggggaggaaggacaattttatatcagtgcccgctatttggtaagcactcaataattgttgtttctttgaattcttcttgttattataccatggtcagtcttatttcatccatactctcccattccttccctcaacattatttggaagcatctctcagacactgtataatttcatcagtaaatatttcagtatacttctctaaaagataagttctcttttaaaaaaatacttctgcactacactgatcactgttacaaatgaataataattctaaatctcattacatacccagtcactgttcaacatttcggttgtttcacaaatgccatctttcattttacagtttgtttggctcagacagtatccaagtaaggtctacatattgcaattggttgattatttctttgactttttcaggctatatgttctcattccagcacactcctgctctttttttctctcttacttactcattcttcctcagagaattggttaaagaagccaagtcatttgccccgtagagtcttccatagtctggattttgctgactgtatccccatggcatcatttacgataccatgtcccagcgccctctgcagattgtagaaagtggaggttagagcaagagttctcaatagcttcaaggtcaatttttttttttttttttttttttttgcagcaaaatgtacttccatcaggggatgtcttagtccatttgtgttgctataatggaatactacagactgggtaatttataaacaatagaagtttacttggctcatggttctggaggctgggaagttcaggagcatggcgccttgtgagggcctttgtgctacatcatcgcgtggtggaaggtggaagggcaagagagggcaagaatgagagaatgagaatgagagaggaggagggggccaccagactcacttttattaaaaaaaagccactcctgtaataactaactcactcccaaggtaatgacgttaatccattcatgacctaatcacctcttattaggcctgacctcccaacagtgttgtagtggggattaagtttccaacacatgacctttagggggacacatccaaaccatagcagaggacatgtactatctggttgtctctcttttgtgatgtcagccaccattgatgatccatgcccagatccattaattcattagggatgacaaaacaatgatattttaattctctcatttcttcttcatttattggctggagtacttttatagagaaagttctttctcctcctatttggtaactcaaaagaacagtttgtacaggaaaggcaggatatgtggcctaattctccttttctttttttatttttttagttttcaaaataatgtattgggtcactagcatcttccaacaatgagcaattagttttttgtttgtttgaggactattatgaactcatagatttaaacatatttaatgtatttcagtcgaatgttgatgttcaaattgtcccatctttggttagtgggagcctcttcaagttggttccagagtctttttttttttttttttaattgagatggggtctcactctgtcacccaggctggagtgcagtggtgctatctcggttcactgtaacctccgcctcctgggctcaagtgattctctcacctcagcctcctgagtagctgggaccacaggcatgtgccaccacactttgttgtagagacagggttttgccatgttgtccaggctggtcttgaactcatgagctcaagcaatctgccctcctcagcctcccaaagtgctgagattacacacgtgagccaccacacctggtctggagtccttttcatattagcttaagtcttccatacagctaacatcatacttaatgatgaaagactgtatgcttccccctaaaatcaggaacagggcaaagtgttgattctcaccgcttctattcaacattggactggaggtgccagccagtgcaataaagcaagagaaagaaaagcatccacaatgggaagaagaaagtggagtcacaggtgacttaattatatatgtaaactatcctaaagaatctacaaaaaaaatttactagaactaataaataggtttagcaagggtcacaggataagatcaacatacaaaattcaattgtatttctatatagtacaaatgaacaatccaaaaataaattgagaaaacaatttcattcataatatcttcaaaataataaagtgcataggataaatgtaagttacaaagtgtaaaacccatatattgaaaactacaaagtcttaatgaaagaaattacggatttacctgggtagaaagacattccatgttctgcaattggaagtggttggaagactcaatattgttaagatggcaattctctcaaaattgatttctagattcagtacaactccaattaaaattctagcagccttttttcctcagaaattgtcaagctaaccctaaaatatatatggaaatacaaaggacttaaaatagccaaaacagttttgaaaaagaagaacaaagttggaggacttatagtcccggatttcaaaacttattataaagctgctacaatcaagatagatagtattggcataaaaatagacaatggaacagaagagaaagttcagaaataaaatcatatgtttatggtcaatttattttcaacaaaggtgcaaaagcaattcagtggagttgggggtggagaaaataggctgtttaaatttaaaaaatggtgctgggacaattggatattcagtgacaaaaataaacttgacctttatctcacaccatatgcaaaaattcactcaaaatggatcatgacctaaatgcaagagctaaagatataaaagatatagaagaagacataagacatgtttattaccttgggttcggcaaagcacccttagatgagactaagtactattcataaaagaaaaaattgataaattggaacttaccaaaggggaaaatttttactcttttaaagaaaccatcaagccattaaggaaaagagggacaagttatggattgggagaaagtatttgcaaatcatatgtctgataaaggacttgtatctagattatatgtaaagagctcttaaaactcaaaaaacaagaaggcaactcaattaaaaataggcaagagattcaaatagattcaatgtctatctgaatggctaacaaggacatgaaaaggtactcaacatcattagttattagggaaatgcaaattaaaaccacaatacactcactaggatgcctataatccaaaagacagataatgtcaaacgctggggaggatgtggagaaattggaaccctcctccattcctagtgggaatgaatggaaaatggtgctgccatgttggaaaacagtctggcagttttatttttatctaataagatgtaagtatctttcacatattgttgctgggttttcaatcatggttaagaaagttttctccactttcaggttatagagaaattcacctgtattttcttgtagggtaggtatgattttatttattacattgaaatctctgactgtttagcatcagtgctgctgtatgatgtgaggggtaaacccattttggtattttccatgtgccttctaggtcccccaatttcacttatgaaaaacttgaccccttcagccaggcgtggtggctcacgcctgtaatcccagcactttgggagggtgaggcaggcagatcacaaggtcaggagatcgagaccatcctggctaacacagtgaaaccccgtctctactgaaaataaaataaataaataaataaataaataaataaataaataaaaattagccgggcatggtggcgggcgcctatagtcccagctacttgggaggctgaggcaggagaatggcatgaacccagaaggcggagcttgcagtgagccgagatcgcaccattgcactccagcctgggcgacaaagcaagactccatctcaaaaaataaaaaataaaaaaaagaaagaaaaacttgacttcttctcccactgacttgagatacctccttgattgtgtatactgaatttgtatgtgtaagtggaattatttctgaaatttctattctgttccattggcttgtctctgcatgtgtaaattccatactttttaagatataaaacttttctcatacgtgttaatagctggtaacgctagcccctatgccttggtcttcttttgggaggtttatttggctattcttagtgcttcttcctttcaaataaactttacaataaaatgttctagatccagaaaaaaaattactgatgggattctcattgttatgacttcacatttatagattaacttgggttttcttctagggtttttatggttttaggtctaacatataagtctttaatccatcttgaattaatttttgtataaggtgtaaggaagggatccagtttcagttttctacatatggctagccagttttcccagcaccatttattaaatagggaatcatttccccattgattgtttctgtcaggtttgtcaaagatcagatagttgtagatacgcagcattatttctgagggctctgttctgttccattggtctatatctctgttttggtaccagtaccatgctgttttggttactgtagccttgtagtatagtttgaagtcaggtagcgtgacgcctccagctttgttcttttggcttaggattgacctggcaatgtgggctcttttttggttccatatgaactttaaagtagtttttttccaattctgtgaagaaagtcattggtagcttgatggggatggcattgaatctataaatttttcaggacataggaatgggcaaggacttcatgtctaaaacaccaaaagcaatggcaacaaaagccaaaattgacaaatgggatctcattaaaccaaagagcttctgcacagcaaaagaaaccaccatcagagtgaaaaggcaacctacagaatgggagaaaatttttgcaatctactcatctgacaaagggctaatatccagaatctacaatgaactcaaacaaatttacaagaaaaaaacaaaccaccccatcaaaaagtgggcgagggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttagtgggactgtaaactagttcaaccattgcggaagtcggtgtggcgattcctcagggatctagaaccagaaataccatttgacctagccatcccattactgggcatatacccaaaggattataaatcatgctgctataaatacacatgcacatgtatgtttattgcggcactattcacaatagcaaagacttggaaccaacccaaatgtccaacaatgacagactggattaagaaaatgtggcacatatataccatggaatactatgcagccataaaaaatgatgagttcatgtcctttgtagggacatggatgaagctggaaaccatcattctcagcaaactatcgcaaggacaaaaaaccaaacaccacatgttctcactcataggtgggaactgaacaatgagagcccatggacacaggaaggggaacagcacacactggggactgttgtggggttgggggaggcggggagggatagcattaggagatatacctaatgctaaacgacgagttaatgggtgcagcacaccaacatggcacatgtatacatatgtaacaaacctgcacgttgtgcacatgtaccctaaagcttaaagtataataataataataaaaataaatacataaataaattaattaattaattaacttcggaagattgacattttaatgatcataactctacctaaccaagacatgtttttgcatgaatcaaaacctactcttgtgtctgttagaatatttttagagtttttcttttaggttttgggaatttcttgttaaatgtatgcctaggcatttaattttgtttttctgtagtaaatggggacttccatcatttcatcaatctatctagtcaatagtttatattttaattatttagccaagatatatatatatatgtgtgtgtgtatatatatatatatcacacacacacacatacatacatacatacacacacatacatacaatgtctataagctattggctgataatctataagccaatagcatatagatgtttcatatatttctgtcttatatataatatatattatacagttttactctgtgtaatctacgcagtcttactgagactgtattatatatataatacatataacagatcttatagaagatgtatctataagccaatagcttatagatattatatatatacgatatctttcttggctagataattaaaatataagctaactttatacccatttctttactgttataatttgtagtaggtttccattgatcccctgacctttttgccatgttgcactgagcgctattggttttgctcgctattagtctcttagataaaaggtttccttggctagatacctccctagtgagaataaagctccctgttgtccccgtatttttcttgacatgcctctgcacggctgcagtggaggtctcggaaggtttccctgtggctgtctcacaccatcagccttcgttcagcttccccagaaggagatcccgagatgaagacttgagtgtgaacagtttatctgagaagccatcccaggaaacaccagtcagggcatgtggaagtgaaagaggaggaggaggaatgcaaatgaagggccattccccctgcaagtcaccactgtgggaactggagctaacaagcagaggggagtttcacatagggcactcagagcgaccccctccaccgggcagggaagcctgagattgccccagagtgaccccagccacagggaaaggaagcctgggattcacccatgaaatccctgtctatcgggtaaaggatgctttcagggtggtaatgatcacccagcaggtggagcagaacggagactggccccacagcctgtgctagcccagcagcctcaggggcaactctggagtcagaccaactcagcgtgtatcctgcctgaacactttgtggctagaatggtttgattatatgctgggaatgataataatacctacctcatagggtgggtgcaaggatgccaataatatggatcatagttaagggttataggtataagtacggatatagatttaggtgtagatgatacagacacgcaagtggcgtgccccactggtaccgggcacacagtaaatcaacaataactggaagtgggtggcattattaagttgcaggacttccatgcctgccccatgaagcttctgttatcctgtctgcctgcaattccattcctgttttcctgctcttcttgtggggaggggggctatcttttatgccatcatgaagtgtgttaaagccctcccctgactgggccctgtggtctagcccacctgtcattcgtcccagagcaggaccccacttccctcctccttcctctgatcccttcccaccagctctgacctgcttttttttttttttttttttttgacatgctttgtgccccaggccagagtgccgtggcacgatctcagctcactgcaacctctgcctcccaggttcaaaagattctcctgcctcagcctcctgggtagctggaattacaggtgcctgccaccatgccaggctaattttttgtatttttagtagaggtggggtttcaccatgttggccaggctggttccaaactcctgtcctcaagtgatccacctgcctcggcctcccaaagtactgggtctgacttgcttttgattcttttctgggacggcagtacggcctcattttctttgccttgggggcacgtgggcccttctgcagcctgtctttctcctttgctgttcctaggaccctgagttgtggtaagggccttccccatcacacagagccgaacaagttctaataaaatcagattggtggattaaacactattaggttgctcattattgcaagttaaaatgatgattccatttattaaggccatttaagctggacacttaagttccctgtgggattgtatcctgctgaaagtgccggatgacagggctactctcagaatgccaaagggcgggtcaccagaggaaggtgggtttcctagggtgagtgcagttgcgattctgactgtgtacatgacagtgtttgagagagtcctctctctgtgggtcataccacttacgatgtgggaacggtttgcctgagtaccctgctgaggttattagtcatatttagaaagggcaagggatggaacaaatcacagttcatgtcttagctcacaagaggctagattggatcaacgtccagtcttctccttggatggagtatcttcattctccagtcacagaaaacccatccacagaagaagacccggcattgccacactctcatgagtgtcttcattctttttttggagagaatgagccacacgcagagcccacctgtttcattaaacaagttcccttgcttattccttaggaagtggtcctaagcacagtccgtggacctcaggcaccttctaatgggtctttcaggggcggggagggcttacagcacggtgaagattaaggacaaacatctagagaggggctgaagcgggaagaggctgacatcgttggccccacatgcaagcctacctgccatttagaaatggaagtgaattgtaaggtttccaatgcagacttgtaagcaggagacagataccagcgggtgacagcattgtgacaagcgcgtggagccatttcctgattgttttagtcgatacagacttagggaggaaaccaacactgacacaaaccaattgtgccctgatcgggaaacaatgaagtatcgggagtcgctgttgaaagtctgtaatttccagcggaattgctgtttagtcatcatattgccgctgaatgacatagtggggctgggtggaaactacaattagctgcagtcaccctggtgggactgtttttttccccccagacaatagaatatgaagccatcaacagccaatgttctgtgctgcttgtgaaatggcccattgttcgtagcaagaagaaaagaaaggcgctggagggtcttgccccagccctgcgggggacagatggctgacttatggtttcctcgcctccgttgtagcagagcaacatacaagccaggctgaagaagccccacttcatttgccttatttgtgtaaagagctctctggccgtggctgagagtgaggtggcaagcctgcactggcctcgtggtgcgcagaatcgctggcattcctcttcccctgctgcacgttcaggtgcagagtggtgcagcactgcgtggggtgctgctagattttgggggagtcttccttgacgttggatctgcccacagctactgaaactttattctgaaagtggtttatcacagcacttgccctcagctgctagaggggtttagttctttctctccttggggtttccaaacccaaatatgtgacctgaccaccgcatctgcagatatgcacgtcatcagcctctcctctctgtggtggacgcgtgttttctttttggcaaattcaaggttctttacctttttcatcatcacacgaatgaccatctaactcttagcatttagggagcaagccgctatttccctgagatgctctggctgtggactgaatagatgactttacctggcagtatctgagacccctgacagctgaagcctaaatgggaaagaatcgggtacttagcttgcttgagaagcaagaccgcagatgctctttcatatctagcagtaatctaaatgcaggcaatgaaccaacagcatttggcctcggtgaacagctctgccatcggtctgttcttaacatagtcatctagcgtctgcgttaaacttatttatttcctaatgctgggtgatggattaaaagatgtgtagaaaatccttccacaagagataagatattgcaggctgccacgacacccctggctctttttgctttctgtctctgttttgcctacttttcagtgcagagctcaggcccccacatcgtatatcctgattactttgtggttattactgaggggatgttttttaagcctatcattgacacatttaattcattaggtaccaaatccaaagcaaattttggctggccataaaacatggttaatccagggagatgcaataaaaggtgaaaaattatgttccagcaaatgtggaatattgcttttctgtagagacttttactggtcgatgatatctttcttcataaatttttcttctacttggtactcttggtaacttaaccatttgttgtttccagaccacagaatggctcaatgatactctacaacaggaagaaagtgaaatacaggaaagatgggtattgctggaaaaagaggaaagatgggaaaacgaccagagaggaccacatgaaactcaaggtccagggagtggaggtaaacagcagaaaaggttcccttggtgcacaaatgtcatttgcaggctgcagtggagaatggaattgcttggagtaatttgatgcgagtcacctctgtccaaagaatttttgtttgccaagaccctggtttttgcttttgtttcgtttttctaccttcttaccctatagtctccattcaagttttcagtgaaactggattgaactaaagcactcctgtttcttgggagtcattgctatatagatggggatttgcaagtttcctgtggactcatttgttgtatttatcacggaagagcctctggatgcattgagagtttgcaaagtgtcagggaagaggggaggcagcgtaaggaacttccctcttgaggtgaccctggcctccccctgccaagctggcaggcccctcacagagcctggcttcaccccctccaccgacaaaccctgggtgtgtcagccttaatagaggtttgagatcattagatgggatcacaggtgtgcatgattcttgcatggttggggtcctgcagaaacatcttgggatcttgggccgacttcgggttttggcccttgggtaaagactggtttccttgctgttgttttcaccccacagactctcaaccttgggcagccatggagaaattcccttattcctctttgccatcgtttgagggcctgagccatgtgtcacagccgtagagggggagggcatgagtcaaggtgaagtcttggcctgctggttaactagcatccacttccctgcgttcctaactggtcctgggaaggaacttcccctgggaacagggaaggcattgccttgggcccggagctgagaagctggctcgtgatccacctgttatttcgaacgggtcaaagagaggcattctggagtctgttggtgtgttgagtttgcgagcatacaggatggatagctgggaccataaacccacttgaattcaatgtgttacccttccacgccaatgttttttgtgacatgctttgtcatgatgactttttccgtataaatcatgtgcttttatggctgttaaaaatagcaccaaatggcctgtattatatgacctcacagagggatgacttttgttttatgttttttttaaatacctaataacaatgctttatggagatgcaaaaagaaaagcctctatccaagaaattccagttcctgcattctcctgtgctcagtgtttgcacagtgtggtttaattgactgcacagaacattaaaatgcagattcccccaaacacactgctctgggcgcacctctaggacggtgaccgctgatcgtacaaaggcattagccatcatcgcagggagccaaaggagggagggcttggttcttcctgggaggaccctcatctcctacgctggagggagaggtagagagtgaggcaaggctgggtggggcccccgaacaacgaggctgctcgcaccgggagtaatagggctgcgggaattcaaactggaagtcacggcagctcctgtgcccgtaggcccctggtatatttcatctttagtaatacgtacatcaggaacttctgctcgtgagtaacagccgggtggaattcttcctcagcagcagctgagaagccgaggggagaaaacaacccacagtgttcgttttctttcctcatgttataaattagagttgtcactggatggaatcagaatgatttatggctatttgttaggccatatttgtgtttggagttatttgtgtgctcatacttgcaggcaacagtctgtcccctcagaacttcgggaaagggagacgggcaggatggggaggggtttccatgacctcctaacatggatggcagtgtgggcagcgggaagagccggtgacacgatgcttgctttgggttctcagagagaggccacctactatgatgcattatgtggtggccttgcccgtgagctcagcgagttgtcccactgagccactcagcagatatcgaccctgtgtgcctactctgtgcaaggcactatggtgtcagcagagagaacaggagtcatattctctgccccacggactcatggtcaagttgaagaggcttgaagtacgtgagggtcatcaatagtgctgagacgcagagcagcctgggcttttatgataagcatcccgggagtgcagagtgggctggaatggtcagagacacttcctaggtcagatgggatacaagctgagcccttaaagtcgggtgggactctgtgtgtgtgtatatatgtttgtgtgtgtgtgtgtgcgtatgtgcaatttacatattgtttgcagtttaccttttccactctgcattgtggtctgagctgtgtctatgttgatattgaggtctcttcatcccttttcacaatcctatagcattctactatataaacacttgagccgtttccctggccatagcccccactttagattcctttcagttttttagcattataaataacacttcaataagtgttcttatacacgtctttttgggcacataggcaacctggacccagaattgctgggttataaggtctgagcatgttcagtttattagacactgccttatggctgcataattacatgcccaccagaactggcgattacagttttccccacatcctctcgcttagtgatagatgagagatggtacccccttttatttgaatttgagtttgtcttaattattagtgaggatgagtgccttcttatgttaatgggagcctgttgctatgaatggtctaccatgggcatggacatggatttttaaacagccctgaagaaggccttttcagacaagatcaacccccacatctcaccagcatttctgctgcattacctctgatctggaccaagggtggggaagcccagggggtgtgctctggcacagtgggtggttggtcctttccaccaggaaattgcaacagggatttccatggggctttgtacctcacaggaggagggggcttctgagtttggactctgcgtccgtctttggtggattcaatcaggtggttcccatagactcagcatcttcatcacgtcaggcacggcgccagccagctactcttctgctggttggggtggacagtcctgcacagggtcttggagctgtgatttttctaccaccggggctgttttcctcagttcaggggcatgataaagatatttggatctaccgtttaatatatcacttgctataagccttccctcaggccaggaaaacttccagccctgtttatggaactgttcagccatctcgcttcttttgttctcagaggctggggccctctctacacacggcaattcaaaggcacattgattttctcagccaggcacaggatgggggcagctgcttttgaagctgacgagctgttaggtccatgattagttgtcttgtctgcaagccaaggagaagctagctcgataaggtttccagggatgacaaaggttggcaggaaggaaaaagagggtggttgcgatgtcactgtttcaggagatgaaatctcagcaggtctggagttggccctgcaccccatacagatttatgccagcttctttggtgcctgacagtgtggaggagctttgggagtgggagactctcagagagcgaagagctggatgtgaagcatcaccctggttccggggtcactgcagctttgtggtcggatgagctgagggaggttagtcagaggtgatgctgttctctgggccacactggaagaattccttccaagttcatgatacttttctctggccccagaagcttgtggggctgccttaggtcctgtgtccgcatctctctgctgagagtgctgggtgtcccagaacccaaggcagctctgggctcttgtcctctccagtttctttgctgctgggttcccacaacagatgggagccacacaattactactgagacagtcatgggcttacacatttcctatataccaggtatatcatctcattgaatcctcataaacacatccatgcaaagtacatggtattatacccattttatagatggagagattgaacctcagagagggtgtctcttgccctacgtcatacctcagtcagtggcagagctggtacttgagcctgggtctgcttggttctaaagctcaagctcttgccattatatcagttccttcggggtactcgggtggggcctgtagacttttcagatgaagtcagcacctatttatttagcacacatccttccttcatccactggggattggaggctttctatccacctagtatggcaataggtgctgggatgcagtgatgtaaagagaacgtgtggtcccctatctcatggggagactaaaaaaatcaatcatgcaaccctgatgcagggttttgagggctgtgatagaattacaaggccctgtgtgggggatgcaggaggggaacctgaggccgacttggcctgaaggaagtgacatgagcataaggaagtggggtgcggtgggagcgggtcaagtgacagaggagggctgggaaatattaatgaatagagtctgttgagaatcagccaatgtgacttgaagcaacaggcaaccagaatcgtgatgggtcagtatttcccccaggcctatccagaccaggtcttatcctcctagcaacgcggccctctcggctcttaaggcgtgacttgccatggatgttctgcctttggaaccagtgggtggtcacagcacagaggctgttggtttcatggctgtcacatgcacagagacagccctgtccactgagcctgttctgtggcagaaggaaccccctagcctggaccatctttgggtggaaacaccagcccctcacgtctgactgtcattttcagatgtgaagagaacacacagtgttgctgatgtgtttgtattgcctgtaaacaacgaagagtttctttgacttcttaactgccttaaagctagaagcccggcattaggatggcagtggtggtaatgaggttatgttttgagacttggcctcattagaagtgatgttctttatttgggcacttaggccacatataaaaaaaaaagaaagcacctcttttaaaataggaatgatattgtagttactgcattaggaattaacagggcatgaaataactgtctgccctgtggcaatgccagatcatttcagctccgcttgcagccataagataaattggtatcttgcttgcagccactggaaaacattttaaatagccagccatgaacatgtatggtgcccaaatcaagtttgaaaaacagcaataaatagataaagtggaggtaaggtgcctaatgaaatgaatgaggggcaggagctcacagaaggcaaacaaaccagcagggaggcgctgcgtgtttcacatacaatacgtatttctacttttagtaaaaaatcatgtgtctcacgaacagaaaacccaacaccgcatgttctcactcataagtgggagatgaacactgagaagacatgggcacagggaggggaacatcacatacctgggcctgtcagggagtcgggggctaggagagggagagcattaggagaaatacctaatgtagatgacaggttgatgggtgcagcgaaccactgtggcgcgtgtatacctatgtaacaaaactgcatgttctgcacatgtacgccagagcttaaagtacaattaaaataaaaaaataaaaaattataataataagaaaattaaattaaaagaaaaacatgtgtcttcggtctgtggacagattattttactccattaccctccagcctcactgtgcacccaccagtccataccctaccgtattcctcattcagaagctgtttttttcccacgtctaggtccacattgtcttagcctcataacttctgattctcccccgccccgccccaaggctatctcccctgatcttctttagccagaagtgatgatttcctcccctacattgccgttgctttccatctgtacccttcttaaggaagtgttcaggttgccttcctatcagccttgtccagttcaaaaaagatacatcgagtatttattttctccctgctagaaatcctgtatctggtatccaaatctaagtaacaaggagtctccacagagtgtctacagaatctaccccacacgaccttgctctgggaagtagatttgcccagtgactaactgcttccacagttacacttcctgcaaacctcaccccaaccctgtgattcagtcctggcagatacgtttatcctcgttggttgtgcatctgggacttgaacctaggtctttggtttcagaagtggggctgcccctcctgtctggcttcaagccctgctggttgaggtgtcttagtctcatgaccgtttctagtacagggagcgtctgttcaggggcacctcagggaatctcccggggctctctgctggcttttcatcatctgaatttttgtgcctcgttctgctggtatactaacaagttaaaacttaatttcctgttacctggatgtgttttggtagaatcaattcaggagctcaaatccatagttcttccttaatttctaattacttggcatccctggtgacatgtttctacccaattcatataattaaaaatttaactaataaataacattaagctagctccattttgaagtagcaagagcagccctaggccgggcacggtggctcatgcctgtaatcccagcactttgggaggccgaggcaggcggatcatgaggtcaggagatcgagaccaacctggctaacatggtgaaaccccgtctctactaaaaatacaaaaacattagccgggcatggtggcgggcacctatagtcccagctactcgggaggctgaggcaggagaatggcgtgaacccgggaggcgcagcttgcagtgagctgagatcgcgccactgcactccagcctgggcgacagcgagactccgtctcaaaaacaaaaacaaaagcaaaaacaaagcaagagcagccctttctgtttgcatctgctgagttcacaaaggcctggcagggtgctggttttgcttctccttctgtcttagccacatctagttgctatcacaaaagatcatagactgggtggcttaaacaactgaaatttattcctcacggttctagaggctgggaagtttaggatcaaggtgcaggcggatttggtgtctggtgagggcctgtttcctggtgcattttggtgtctggcgagggcctgtttcctgggcattttggtgtctggcgagggcctgtttcctggtgcattttggtgtctggcaagggcctgtttcctggtgcatagatggccatcttctcactgcatccttacatggtgggagggcaggaggagctctctggggttccttttatcagggcacaaacaaaccccattcagaaagccttcactctcacgatctgatcacctccccaaagccccacttccacataccatcgcatggcgggggcgggggttggttttcatcatatacatgttgggggaacacagattttcagtcttcttaaggctctctcttccctaactacagccaaatgacaagagcagcagtaatcacagcatccttttttgaacttttactgactatccagtcctgtgcgcatcatcttatctgcatcatctcattcagttacttggtaacatccctatcaggtagatactattgtcatcctcatttcatccacggtctgcaagacaaagacacagcaggtccctcgctgtccacttcagtggttgggagttggtccccaaacacactgcataactggctgtcactcctcagttgcaatttgatccaagagctgttgagtcctatacattcacacgagagctttcacttaggaataacaagttgtttatctcctcccagcatgaactgcccatttccatttgtcctgaagccgtagcttccgagcttccacggcacacccactctggcagcgagggtctgtgcgtactcttgctacgcaggccagattgtatgttgccagatttagtatgtacatgcacagacatgtgtgcatacacacacaagggagaatattgatgcccagttaaatgtgaatttcagataaacaacagtttttttttagtacaagtatgtctatattaaaatattgtccgttgcttttgtggaactcacagtttgctgggcatcatgtattttatctgacaaccctccaagcatcagagctgttcctttgaacctttgcagacagaggtttgtctgttttggatattggtcccattgaagacatgaggaagtgagttggtttatctccagacacatcattgatgtggggaccataaaaggcaggaaggacactggccattgctgaggagaagacacgctagcaggttgctagcaaagccaaatgctgccagggctggggactttcgtgctccctctgaaaagtgagtcctggatgtttctcaaataccaaaacgtgaggacttccagatacccagatctggtgccgttagatgctgcaacctggagaaattcaagccttcttctgccactggtgttgggggagaagcttgttagtaaaagatgtgccaggaatatgtagcaggaagtgtgattgtagtttctgccttccttgtatctctggtagatgacaatacatacaatattttgtaatttcctttttaaaacttgatatgagccttattaagctagaaactccctgatgaaggtagagcagcagcatatcaacttggtgtgctgaacttgtacttaattattatcataatagtccctcaacatcactgcacgttagcccataaggacaggaatggaaattttagcatattcagttacaatgtaaacccttgaataccactgtcgaaattcaccaagggccattctctgtttggtccccaacacacagcagggactgagtgaggtattacccaggtcacacaacctggatgtttgcaagcataatttacagcctcacccagaaaccgggcaggcattggaagaccataatagatacttttccccttggtaagtgaccagacatggttatttgccttgggtgaagagtagctctggccatcacttgactgaatcatcaaatattgatcctctctgcatctttcattgctggggaacgttgctggggaagtttcctcccgtcattggcggctgtggcttatgtccgtgtgaatttatgctcagtcagcacgaatctccaggcttgtcctcggatagtcgcggccattcactttagttggcgtggattaggcaccagcagagggcagggatatggcttacgggctaagtaggctcataccactctgcttcccacacgccggggcaaaaatcatgaggaaaacagggtgtaaatgaagggctcttttgccaccagtaggagctggggagaaaaattttaccaaacgagttaaagaaggaacgagctcctcacgcagcagctctggtgaggctgctttgatggccgctggctccggccccttgtttccttctgtgcgggtgtgtgggtttctggctgctgagcttccctgtggatgccctccctcactgcaaggccggagtggaagagggaaagcaggtgatttcatgaaagagcgcctttctgcttcatgaggtttttctcctggacagatgaaataaccttccacgtcctccttgcacttcgtaattcaacagcttgtaactcgcgcaaaacctgagaccggcgcaaatactgaagcggtcagtattgcttcttgctaccctcagtgtggtccaaagattggtatgttcagcatcacccagggggtattagaagtgcagaatttcaggccccaacccagatctacagaatccaagtctgcgtcttagtatgagccccaggtggttcacacacactttaatttggaaaggattgggacacgccattctgttgttgccagtagggtcctgcctcagtgccttgcccccaggcaagtggttatttatttatttattttaccttgtcttaagagaaaagtccaagggaaaatttcacaagttgctctggcaatttatgacttgacttcaagcacctttagaaaatatcgaattgaaatctccaatgatatggctggagcttatcattctttattctgcccttggcaatgagcgatagagaatagcaggtttctgaaatcagaacacactgagtggcgatgactaaacagttccctcagcctttgttctctgggtgaaatggtcctgttcttccatcctttagctcctctgaacggggaacttgcctgtctgttcactgctatagcccagtgcttggcatggcacctagtattgagtacctttggtgccaaataactacatttttcaaaagaatgaaagattttgaatgaatggacctttaaaacaaagggccagacagtaaatcttttcagttttgcgagccagactgtccgtcccaacaattcaattctgccattgtagcatgaaagcagccataggcaatagtcaaggaatgggcgtggctgtgttccaataaaactttatttacaaaaacagactgtgggctggatttggaccatggatgtagttggtccactcctgttttagattatggccacggtttctagaaggagtggggtgctctgtgtatgtcctgctactcatgtttacagccgcctgatgctattcatactcagcttatatttctgcaatgaatgtatacttttatttacaacatacctggtgaggttagggtttcttctttaatgcatgtagcataggcttgtttgtttcttcttgaattgtcctcagcctgaaaacattaggcaatgtctcttgcaaaggagagtttgaatgtgggaattgagaaatgtcctgtttctcttaaaagctcagggcactgcttcatggcattgtagagagggcagggctagtcccagtgatacactctgtgttctcctgtctagtggggatggctgagccaatggcatgtgtccttgttgagaccaggtgggttaaaggattggggtgtcacagaagataggctgaaactgcctgcatctttaggcgtgcagtgctttgaatgaagcctgtatgttgctggatgcaacagagtccccctagaatagtgaccgatgggagggcacagatgctatttgtccatgtttaagtatttacatgacagcacgagaaaactggagaggctctctttcatctttgctgccacaatttacctacagtttatgatggatgcgagaggtagacatttatcacaaaagtgtaagaaatgttgactcttcatgaattgattacttagaatgtattttattaaagattctaggtggcatgtgataaactgaacctctgctggtttgcagcttaatgattcatgcatctgtggtggtgataaggaaatcaaagattcggtttgccttttcagagaaagaatatggattattattaaatctggaatgggcctcttgagaatccttccttagggagcgtacatatcaatactttcttctcgatgtgagaattctaatgcttcacttatggaaacataaattccacagcaagtggctgcgggttccttccttccctctggttccttacatcctttgtgcgtcgaggatgcgtttttattccttagttagtacctggcattcatcgttctttagtctccatggttttgtgtttctattgataacttttaatgctaagagctctgttgaggtctatgttttgcagcagctgagatgctggtagagaccaggatggtgtatttgcctgtcatcccattggcttgaaatttcctaacagattgggttaagtcttggaaaagactaagagtaactattagatctcagatttccaacggaagtgaggtcagctcacatgggatgtagaatgttaccctgaaccaattcatgcagaagccaacaaggccgccaagcacatctagtgagttgcatctggaccaaggacagcagatcagaatgccccgtttcactaggctttgcggatggtggaggtggaggcattcctgttctcaaataacagagtcagggagggctttgctgaaggcatccggcatgtggcgccccagccatcacctcaggacagaggatgcaggcggagctcccaggtaacattcaatgatgaataacaagcccacaggcttacagtgacattaacgaggtgttggcgttgtctgatagcttgagtttcaaaatactgtgtgacttctttttctttcaaaaatatcagacagaggttaaatactgtaatcttttccataggagactgtgggaaaataaattgggaaaccccaagactccttgttttcccccagattccttacccgtctacatgctgtgcagcagaagcaacgcttaatccttttatatgatgtggtgccctcacactggtattttacttaaacccttcattttgttggatgcttttatacatggaattagacctaattgtcaacataatgccatattaagtttagtttcccaaaagagtaaacactgaactgctcggcaattatttcttacacacagaatctgcttggccttccatggactgatcagtccatgaacaagtgagttttgctgctgactgctcattctttcatcactgtgacatagttcaaagagtcttaaatgggccgggcgcggtggctcacgtctgtaatcccagcactttgggaggccgaggcgggcggatcacctgaggtcaggagttcaagaccagcctagccaacatggtgaaaccccgtctctactaaaaatataaaaattagccgggcgtggtggcgcaagcctgtaatcccagctactcaggaggctgaggcaggaaaattgctagaacccaggaagcagaggttgcagtgagccgagatcacgctgttgcactgaagcctgggggacaagagcagaactccacctcaaaaaaaagtcttaaattatagcttccacctaaaaggtgggcagaacgaggctgccttgatcattgctttacagctggtggggttgctctgttctcatcaaactcatttcccctttgcaggaaactcctaggacaccccttcaagggacaccagcctgggcgatgccatttcttgttgttgcccaggttgcttctgtcacaccagcacctagcacagtaaggcttggtgtgtgtttcctgaatgactgaatgcacgtctgagagctgctgctgcagcacttctggtgtctgatgaagggtggttgcttcctcccagtgactgagcagatgcgtgtgttgacattggcagagaggtcgggtgccagcagcctccttccaggtgcagaaccgatcacacttgccttttcctggaaggcggttggttaagtaaaccttattgaagtagctcccctcccagattaatgaatactttcagacatgatatgaaatgtttggaaacgagatgcgacacggtattttggccgcattttttttttccctttcataacacctggcaacaagattctcaggctaaataccagacaagtgtgcgcttcattatgtatagtaacttcgtctataactttttttaagccctccagatggaagcatggtataaatgtggagaggctgagaaggggaaatggaaataaatgcactaagaaataaagaatctgttttttatactttcttttgcaaatagtgtttgccgtgacatattgtgaatggactgaattataacaaaaccagaaatgaaacagagctcgggggtagggagagcaattgttacacttactttaactgatataatgcaaagcaacgctttttacactcaattagtttgtacattgtgttggacacaaaccagaatgcagaacatttttgggttttgtttttacatgattaagggagatgagatgaaataaattcagtgaattatcctccgtttcttttaggtctgagatgtttttgttctgttgttcctcacccctggtattgagtgcataaccctttttcccgggtgtaaggagctagagagcccaatatttgaaagcccagagatctatgggctttcagtagagttccttcttccactttagggccatctttggctacataaacaaggacacgaatcagagctatttacatctggcattttaccatattctgtgcttagaatatcagaagaggctagcaagcatgatcgaagccaacagatgttagtgagcatttaggcagcaaaagtatttccaaggctgtatatttcaagatccttgcttaattcattttgcttaattatactttcttgaatttttaatgctcctaatatgataatattaagaattgcagtgtgtggttatggattgctcatttcaatatatgttagatatgaggggatgtgtgggttaatgctgagagccaggaacagatgaacttgggggtcagctcagtgtctttcctgtgcacagctctagttgtctcctctgggaggggcccaggaagggcctggatgctcctgcaaaggacgcttctgcaaaggatgcagaaaagcattcctcaaactttcatgtgcagacaggtgccctggggattctgattcagttggtctgggtggggcctgagatgctgcattgatagcaagtccctggtgcagctgatgctgctggtgccacggatcctactttgtgttgtggaagtgaagtcagttgtattctacaaaggctgctgatcaacaagtaccacacacaatggaagagaacaagtgcctgccgatggaagccatgcctgtgatacctggcacatgcagtttccttctggcgcaggagttgtggtcaaggaccttggtcagactcttgtcttttaaaaagatcatccctgctttcatgtgtgcaaaaggaaagccacgtgtgtagagcactcggtgattctgtgttttgtattcaaaaccacaaacactaataagaaaacaataggagaaacctgttaggtataatatccaattataattatttttactccaaaaagcacatcaaataaataatgcagtttatgttacttctagaaaatgcggcagcgttagttaatttacataaattatacaactcattatctttgtttataaaaagacttagcaatattttggcttatggatctgaaaggggaaaaaatatcgcagacttcagttcagtgtaattttcctttcctgcacggccacctttttatttatttacagaaagagcatctgtttgacagatccccttaggagtactgccctttccttttgatgaatagaatgccttaagtttgacttttgtttataaaaagccaaataaatacaagtgaattaatccaagcagcaagagaatgctctgagtagcagtcgcggcttccttggctgacaccagggcctgcaggggtggggagggagcctcaggggccagggagccgggtttttctggcctcgtgcttgtcttttctgctgcagaacttctcaggcagcctcgagttagatgtgccagtgccacccactcagggtcagctcctgagcaggtgaactgttcctgcgctgtcccagccagcagccatgagccacatgtggtggtgagtcctggaaatgtggctcatccaagtgccatgagtgtgagacccacacagcttttcaaagacctagcatgaaaagaagccactttttattattttagctttttaatttttttttttatttgagacagagtctcatctcactctgtctccgaggttagaatgtagtagcactatctcagctcactgcaacctctgcttcccgggttcaagtgattctcctgcctcagcctcttaagtaactgggattacaggcacctgccactatgcctggctaatttttgtatttttagtaaagacagggtttcgccatgttggccaggctggtctcgaactcctgacctcaagtgatctgcccaccttggcctcctaaagtgctgggattacaggtgtgagccactgcacctggccaaaaagaagccactttaaataacccattaatatttttgtggattacatgttgaaataatagataaaatatattattaaaattcatttttcctgtttccattttacttctctactgttgctactagcaaagtttaaacatggctttattatatttccactggacagccctgggcctgccctagactaacagagaggctggagacctagattactcttaatcacacccattaccaagactctgattcttccactggtcctgcgtcaggctctgactcataatgagaaacaggatacggctcagtgacaagggtagggcttgtttgatggtttgcttggagacttgaaaggcacctgggagaacaacatagtgtaagaaagtggagctctcttcccttgacagtacttggctgttgcttctagcttaaatattaaagtctctgctggtggatggaggagcccagctcccaggttgtttcaaagtggaaactggtgaagcctaaatttgccttcattgcttatgcagatccagtagattggcaagagaacaagcctgccccgaggcaggtctgcagagcgggggcgtgcttggcagaggagggaacaaggaacatggttcagttgcggccagacctaggcctggccatgtgccagggtgcctggactttggacaccggtgtgttcagagtgtgatctgatactagcaggacttctggctgggagcgccactgtgggtccaccacagggacggcctgggaccccagagccctttccctcataagacttgggagttagagacaaagggatgtctgccatttatcagttgatggttaataatttaattcttccctgcatccatttattgaagaaacataagtccacgatgtgccacactttgctaggcactggggatacagtaatgcacaaaacagataggttcttcaccctctcgaagctcccaacttgtgggagcggggaagaaacagacaggacagaggagtgcaagaagtcccttaggagccctgagagaaggactagaggacagtgtgcaatgcatatgcctagatgacaagtagtggccaggcactggcccttggtgacggaggaggcaggaacatttggcctgtgactaagggaggaaaggccattgctgcaaagagctgggcagggctttcttggggacaggacagtggatgccctaaggctggaaggaccttggttgctctactgccagaaagggatctgtgggcctggagagcagtggacaaggagggggcgcggtggaggggccaggacccaggtggcacagcaggatcagctgtggtatagatcttggattctgttctaagtgtcatgagaagccactgatgggatcgtagcaggggtctggaaggcagtgggggaggttctggacaggtaactttgctttatgctgagtgatgctggatatgtcccttagaccctctggctgttggcttcttcatctatggagtggaaaggctaagagagtggaagagaggtgggccagaatgttctccgaggttccttcctatttaaaagtgccatgatttggagagatcccagtttttttcccttcttggagtagagttacctttatggcttctgggatggattttagatggcttcacagtgccagcatttctgtgaagtcatcaattcatatccatgagttctttggcttcataagataaaagaagacagaatgcacaggactgtgttggaattgccatggagtgcctaggttttcactcagcagttccatggtgagacctgtgcattggtaaagttttaggagctttctgggtcaatgattctgcacatcagcaggattgatcccctggagtttgtgcctctattaggggactaagagggcccctgtagccagaggctccagaggctctctgtagcagtgtgccagatgcctgtgacatactccatatttaactgttcagacctaccagcaggccaagggttttagttcagagattctgagcacctcactttgcagctggggaatctgatggagctcacagaataaacaaatctgtggtaggctgaggggccctgtgatgggcttttgtcacatgctgatgagtcatttgctgagatggcaaagggattggttgtcatgagggctgctagtgaacattgggatcttggggccctgacacagctggtgagcaacattctgatgcatgttcccctgcccctctcagtgaggaagccagctgagcatctgcacaaagcttaagaacccaaggggtagagctaagtgctaatctgactccctcttggacacctataaaaatgtccagaggcttccaatggccatggcaaagtaactggtagtgaacttatcatcccacccaaaccaactagaacactggacacaatataggaaacaactattgttggataatggacagcaggcaggaaggactgtaatatctaagaggaggaaataaacaagctctggctttctggctggaggcattttccagacagtgcatgggggtgagtggcaaccaggcagagtacagcagtgtagcaaagttgaggaggtgacaactagagtttggggaggctgagacaaatggaatccatagggtagagtgctgaagagtacagaggagaagggggggtcagcagagaaagaggtccagaaatctggatagaagatgtccttgattctttggctaaatactaagctgtgtatgcatcatgaaactgtatgaggttggtcaaaagacaaccactgtgggccagaagctaaaacttctcagggttcacacagaactgggaaccactgtgagccagaagctaagacttctcagagctcacccagaactggcagatgttcaagttcaaactagtcggtgtgaagagatgctaatgaacacctgggtattccacagagaccccagaatgatcacatcttaataatggagctaaactctccctggagtgaagacaactccagacctaccctaacaaagcgtataaacaaatcaaaatgagcaagctgatctgcaaataatgcaagtgcctaacaaagctaaatccaaaattctttaaagtaagacaacgaaatccacactcaacagtatatcattcacaatgccctgcattcattactaaacatataaggaaacaggaaaatatgacctatatccaggagagaaatcagccagtagaaagaggacccaaaataacatagatatggaattaaaagacaagagcttcaaataatctattataaatatcctcagccatttaaaggaaaagaagaacagagtgaggtgagaaccataatatataagaagaaccaaagagaattctttgaattggacaatacaatatctaaagtgaaaatgtcaccagatgagttatctattgatatgtaacaaataaccacaaatgtatcagcttaaaacaacacacatttatgatctcacagtttctgagggtcaggaatccagacatggcttgactgagtcctctgcatcagggcctctcacaaggctgaaatcaaggtgtgagccagggctgaggtctcatctgaaggcttgactgaggaggacctgctgctaagcattcttgattgttttacaaaatcagttccttgacagatgttggatcaagggcttcagttcttagctgactgttgggcacaggccacctttgttaccttgctatatggacctccaatatggcaggttgcttcatcaaagagtgcaagccagaaagataatagagaaagtttgctagcaatatagaagtcacagttttttgtaaccttattacagaagtgacatctcatcatctttgatgtatcccatgagttggaagccagttatcaatatgcccagaatcaacaggttgagattacacaagggattgaataccaggcagtagatttcatttggggtcattttagagtctggttatcgcaatgggattaataccagattagacacagtggaaacaaaagataagtgaacctgaagataaagcaacaggaactgcttaaactgaagcactcagagaagaaaggtagggggaaaaataatagagtgtggtagagtatcagagaactagagagcaacatcaaatgatctaacagacatataattggaggcccagaccatgaggagtgggtggcagaaaaatagttgaagaacaggtggtcaagacttttccaaatgtgatgaaactaaagagtcacagatcctagaagcaggagaaatacaaagaagagaacatcaagaaatataatcaagtttgctaaaaaccagcaacaaagaggaaatcttttaattaggcagagaaaaacacattacaaagataagaattaccactgatttctcattacaaacattgcaagctggaagacaatgcaacatctttaaattgctaaaaggaaaaacctagaattctatattcagtgtgcatattcttcaagagtgaaggtaaaataaagacatttttagaccaaaaaaagtgttgctagcagatccatactacaagatatatttgctagcagatctatactacaggatttatatatatacacatatatatacatatatacatatatatacacatatatacatacacacacacacacacacacacacacacacatatatatatatatatatttttttttttttttcttgtgagatggagtttcactcttgttacccaggttggaatgcaatggtgtgatctcggctcactgcaacctctgcctcccaggttcaagcgattctcctgcctcaccctcccgagtagctgggattacaggcacccaccaccacgcctggctaattttttgtatttttagtagagagggggtttcatcaagttggccaggctagtctcaaactcctgacctcaggtgatccgcctgccttggcctcccaaagtactgggattataggcatgagccactgtgcctggcctacaagatatattaaaggaagttcttcaggctgatagaaaatgttacaggatgaaaattcctatttacataaaggaacgaggagcactagaaatggtaaatatggctggacacagttatgtgctcttgtaatcacagatacttgggaggctgagggaggaggattgtttgagtccaaaagtgtgaggacagcctgaacaacatagtaagaccctgtctcaaaaacaatggtaaatgtgtaagtaaatataagatacttttattcttggtttaaaaacactttcttgaaaatataattggccaaacacttatgggaaagttatagctcttaatgcctatatcaaagaagaacacagatcttaaacaataacctaactttatatgcaagaagttagaaaaagaaaatgaaacccaaaatcatccaggggaaagtattatggactggatgtttgcatatccccccaatttttacatgctgaatacataagccccagtgtggctgtgtttggagatggggcctctaaggaagtaattatggttaaatgaggtcatagggatgtacccttgatccaatatgattagtattcatttaagaagagacaccagagagctcactctctctgtgagcacagaccgaggaaagaggaaaggccatgtgaggatgtaacaagaagctcgccacctacaagccgggaagaaaactctcatcagaaacaaatttgctggcatcttgatcatggactcctagactccagaactatgataaaataaacttgtgttgcttaaggcatgcaagatgtggcattatgttatagcgtcctgagcagacaactatagaaggaagtagtaaagattcgagtggaaataaatgaaattgagaatggaaaacaatagagaaaatcaatgaaaccagaagttgatactctcaaatatcaacaaaactggtaaactgttaattacactgagaaaagagatagatagatagatagatagatagatagatagatagatagatagatacaatacccccaaaactgagaaaagagcttaaaaaaaagatcagtagatagataatatgagaccccaaaaagggagaaaagagctaaaaaagagatcaatagatagacagatagatggatagacagacaaataaaagacccaggtgactaaaatcaggaatgaaagggagaacatcactactgaccttctagaataaaaggattataaaaagaatactatgaacagcagtatgccatcaaattagataacttagatgaacaaaatcctagaaagatgaaatgactgcagtttactcaagaagaaacagagaatccgaatagaccaaaaacagagatattaaatttaaaattttctgacaaagaaaaaccaagggtcatatgaattccctggtgaattctaccaaacatttaaagaataataacacaaaatattccagaaaatagaagaggagggaacatttcaattatatctatatacatgagcaataaacaatttgaaaatcaaattaagaaaacaattgcagttataaataatagcatcaagaagaatataatatttagggatacatttttaaaatgaagtttaagacttgtaaatggaaaactacagaaatattcttgaaagaagttaaagaagatctaaataaatgaaaagacatctcatgttgttggatcacaacacttaatattgttcagatggcagtactccccaaattgatctacagattcaacgtaatctttatcaaactatcatctggctttttaaaagaaattgacaagctgaacctaaaatttatatggaaatacaagggacctggaatagttaaaatctttaacagaagaacaaagttggagaactaaaaattctcaatttcaaaacttactgtaaagctatggtaatcaagtcagtgaggtattggcataagaatagacgtataaatcaatggaataaaattgagagtccaggagtaagtcttagcatttatggtcaattgattttcaacaaaggaccaagacaatttaatcatgatagaatagtcttttcagaaaggttctggggcaactggataaacacatgcaaaaaaaaaaaaaaaaaaaaaaaagaaaagaaaagaaaagaaattggacccctgcctcataccatacagaaaaaataattcaaagtagattatagacctaaatgttaagagctgaaactataaaagtcttagaagataacatgggaataaatctagtgactttaggttgagaaatgatttcaatgtttaacattctgaggaattcttagaacttaacaattaaaagaaaaataatagaaatggacacataatttgaatagatatttccccaaagaagatatatgaatagccaattaacacacgaaaatatatttaacagcatcattaatcatcagagaagtgaaaaccacaacaagataccacttcttacccactaggatggctataacaaaaaaagagagataatagtaagtgttcacacacgtggagaaattggaaccctcacacactgctgatggtgatccaaaatgctggtgctgctgtggaaaacattctggcagttcctcagaatgttaaacattgagttaccagaagacccagcaatttcactcatagatatgtacccaagagaaataaaagcatattcacagaaaaacttataccattattaatcatagcaacaagtcaaaacaactcaaatgtccaccgactaataaacaaaatgtagtctatccatacaatgaaatattacttggcaataaaaaggaatgaggcactgataacatgccacaacgtggatgaacttctaaacgttattctaagtgaaagaggccagtcacaaaagaccatatattatgtgataccctttatatgaaatgcccagaatagggcaacctatagagacagaaagcagattaataattgcctaaggctggaggtgtgtgtgtcaggtagggatgaggggtgactgctaatgagtattaggtttctttttggggtgatgaaaatgctccaaaattagcttatggtgacagtttcacaaggctgtaaaatactaaaagcattgaagtacacttcaaagaagtgacgtttatggtgtataaattatagctcaaaaatatgtttaaaataagataattgattgtctaaaacataagtaataacattatatagaagcaaagtgtgtgacaacaatgatacaaaggaaagcagagggaagtggaagtatattgttgaaagattcttacatttttggtgaagtgctctaatatttgttgaaggtagaatactatgattgaagatatatattgcaaatcctagagcaaactactaaaaatgaagagatataggaataagccaatagtggatataaaatgaaagactcaaaaatattcaaattaatgaagtcaggaaagaggaatatgaaacaggacaagtagaaaacagtgttagatggtagagataaacccagccatatacataattgcatcaactgtaaatggcttaagcattccaattaaaagctagagagtatcagactggacaaaaaaaccataatactcaatgacatgctttctacaagaaacactttaataataaaggcacaaatgggttagaagtaaaaagatgggaaaaaatagagtgtgcaaatactaaccataagaaaactaaagtgaatatatgatcaagcagagtagacttcaggacaagaactattactcaagataaagagagatattttataatgataagagggtcagtccgttaggaaaacatgaccgtcctgtctatgcacctaattacacagcttcaaaatacatgccaaagtgacagaattgaaaggaagaatggataaatttcacaattgtagtgggagattcttttctcagtgatgcataggagacaggaaatcagtaaggacattgaaaacttggataacactatcaaacaactcgatctaattgacatttttgaaataaatacccaacagtggcagaatatacattcttttcttacacatagaacatttattaatataaactatatactgtgtcataaaacaaatctcattacatttaaaaagattactgcttctctgacagtaactgaattaatttaggattcaatagcagaataaatatctgaaaaattcccaaatatgtggaaattacacaacatactgcttaaggtaaaagaagaaatattataaaggaaactagaaaatattggctgagcgtggtggctcatggatgtaatctcagcactttgggaggccaaagcgggcaaatcacttgaggtcaggagttcgagaccagcctggccaacatggtgaaaccccatctctactaagaatacaaagattagctgggcatggtggtgggtgcctgtaatcccagctacttgtgaggctgagacaggagaattgctcgaacccaggaggcggaggttgcagtgagccgagatcgcaacactgcactcctgcctgggcagggagacagagtgagattccatctcaaaaaaaaaaaaaaaaagaagaaagaaaatattttgaaatgaatgaaaattaaaaccccacatagaaaatgtatggagtacagggaaagcagatattagaaggaaatttatagtttgaagtgcttacactatatttacattaaaatcagtaaatgtaattgatattaacaaaggtttaaaatgtgacctaaacttttacatgtagaagctagagaaagaagaaccaattaaaaccaaaataagtaaggaaaaaggtaatattaaaataagaataaaataaatgaaatagtaagtagacaaacaatagaaaacattaataaaacaaaaagctatctctcttcaaagatcaataagttgaaaaattatagctagcttgattaagaaacagagaaatatacaaattattaatatgagtaaaaaggatgcatcactacagatgctatacacattaaaggtaacctaagaggtgtcagaaaaggatatcatgaaaattttatggaaataaatttggcaacttcaatgaaatggacaaatttcttaaaagataaaaattcttaaaactgacacaaaatggaaaatctgagtagctctatatttattaaattaagtttgtaatttaaaatctttccccaaaaagaaacctccttcatggtgaatttgatttaaaaaaatttaaggcaagaataatgttaggcttaccaaacattttcagaaaatataggatgatagaacacttgtcaggtcattttatgacaccaggatatctgataccaaaaccaggtaaagacgttacaagaaaactacagaccaatatctctcatgaacatagatgtaaaaatccataacaagatattagcaaatggaatgcagctataagtaaaaaggataatacaccacgattaattatgttgattgaaggtgtgcaaagttggtttaacatgtgctaatcaatgtaattaattgtattaacagaacaaagaatattgaccatataatcatctcaacagatgaagaaaaagatataattccatacccattcatgattaaaaaaaaaaacctttcagcaaactagatataggagagaatttcctcaatccaataaaggaaatctacagaaagcctacacctgatcatatatatatatatatatatatatattttttttttttttttttctttttgagacagaatcttgctctgtcacccaggctggagtgcaatggtgtgacgtcgcctcactgcaacctccgcctcctgggttcaagcaattctcctgcctctagcctcttgagtagctgtgactacaggcgcccgccaccatgcctggctaatttttgtatttttagtagaggaaggatttcaccatgttagccaggatggtctcaatctcctgacctcgtgatccgcttgcctcggcctcccaaagtgctgggattacaggtgtgagtcaccgtgcccaggcacctgatcatatttaatagcatattcttgtacttccttctaagactgggaaatcatcaatgtgtccactttcactgcttctattcaatattctaccggaggtcctaggaagttgaataaggccaggaaaagaaataaaaggcatacagatggaaaagaaaggagtgaaattctttttatttgcagacaacatgatcatgtgcatagaaagtgttaaagaatctaataaaaattactggaactagtagatgaatttaggaaggccaaaggaacaaggccaatatttttttgaagtatattttcacatatttgcaatgaacaattggaaaacaaagataaagaaaaatacagtgtaaaataacataaaatattccttgaaatattttaggatcaaattaacaaaatatgtaagacctgtacccttaaaactataacacattgctgacagaaattaaagaagacttaaataaatggagtgatataccatgttcatggattggaagactcagtgttgttaagatggcagttctctccaagttgatctatagcttcaatgctatccctgtcaaaatctcatcagacttttttgtagaaactggcaagctatttttaaaatttacatatagcataagaatgaccaagaatagctaaaaggatttataaaaatcaaagtaaagttaaaagaattgccctacttaatttcaatacttaatctaaagctacagtaatcaagatgatgtgatactggtatcactgagttgatattccaaagaggtagatttcagggttcagtttctgaactttctgaggagccaaactagagaactaaattaatctttccaagcaatggtgtgtgtgtgtgtgtgtgtgtgtgtgtgtgtgtgtaagagagagagactcattctcattctcattctcatttttgaattaacttacagataaactgagtttcccaagaaggccctccatggcagactatatatcatctcctctctatctcccccttctcagaataaaagcagttttttcttctttatggtttgaaaatgaatttatatttattgtagaagacttcagatagtagataaagacaaggaagacattgatataatggcctatgatgtccatctttctgaatgcttttcacatacacacacatacacacactttttttttttactaaaataaggggttatatcatatatgctattttgtatttttttacttgactccatgttaagtgatttacatatttttaaatgactctgtgtgatatcatatacttaacctgttcactgacattagacattgagactattactactatttgccattagaaatcacaccgtgagaaagatccttgtatctttatttatagtaagccctcaacaaatatttatttgaggagttactaggtaccaggcttttcatacctgaacaattgttttctggagaatattcctagaaatgaaatagtagtgctgggttaaacgatataactgcctaaaaattagctccatatggctacatcatccttcagaaaggctgtgttaatttacaactgctctagggatgtttgagaagtcctgctgattaacaaacatgccccaccccacaggacttggcgcagggtgggggccacacctggtgcctagtgttattgacttagtgatgggtgaaaccttttgttcagcaaaagtcatttgtaccacatcaccatggggatgtgtgtaaagcattcatctagctcatggaggggaactgtacagctcactctagtgtcttctcagagttctgtagtaagttttccaacttgccattctgccatttattaactacaacaataaaaaaatggaagctaccctttactacaataagtgcttttcaggcattatctgaattttacaacaactctgcaatgtttcatcgatgagaaactgaggctcagaaagtttaaataatttccaaggtcacttagctcgtcacagatccgtggatcaaatgccagggtccagctctttctctaagtccaatcctgagtttttgacttgaacttgtcagtcttcgttttctaatcatcctgattctggggttcatttactctagaaatatttattgagcaccttccacaggccaggaaggggaatagtggagagctgcgttgacaaggtcttggccctcacgtagcttccagtccggtagaggagatacaatttaatcatccaattgtatgaaaaaactgtgattactgccatagaggaaaagtgcaggaactctaagatctgagagcaggaggatatgatctaatctggggatcagagagagaagctctgaagaagtgatgtttcactgaggttgccagttaatggggctggggagggccatgaggagaaggggaaggcatttggtgggggaaagggatatgcaaaggccctgggggcctgaggaagtgtgtgctggaggaaatgaagggtgggcagttcaggtacttagagcgcagagcctgagggggctggtgagcaggtgggcactgaaccccgcagtgcacctatgtgaaagtgtttggaatgtaacctgagaacgatggggcccatgaaagcttgtaagcagggcagtgtcatcctctgattattgtaaaaacattgcccacgcttctgccaggcacatccactggggtgggaggcagattcacatgggagggatgacttattggttaaaataggtggtcccagttctgtttctcttctccttatttttcttttctggtgagtttcttctccctgtgctaacattctgggcctcaggcttaagtaagaggcagatggcccgggtcttggagcagggaagccaggggaccggcagccccaaaagctgtcaatgtcataagtcatccttgcagagccgcagccaccttctcggcagaatgtcaagcagctcggtacggggagcagctgctctgcatggctctgagcattgtcagaacaccataaacaaaatggtcaggtttctgcagagataacctcctggcctccgaccccatgcggcaccgtgccgagggccaagctctctcttcggcatctgtttttggtacttccaaagcccacagtgtggggctttgggacgttttcagcctgaatgctaaaatgcctggaatcaaggcaagaggaggactttgagagttggcttccctgtgtctgttccctggaatgagaagaagcctgagctacagcctcaggttactgctggtggtccctctagaccaaaaaaaaagaacttgccaagagagacccttagtatccagagtcccctcctctcctggggttggaagggagagcaggaagagggagtggcctctatgccagccaggtccagagcgggagggagtgaattgcaccagggaaggagcctgctcgttgctggtagaacttgcagcatccagacagacctctcagccctctttggatgcctttatccttgcaaatgtcagagatgctggctttgcaaaaaccaaaaaccaaaacccagtaaccagtcttcccagcctgatgtgtgtctgtgccctttgcccacctgggcactgaggcaccaaggcacctggcctcacactcatttcctttgccccatctggctcgccagtcagcgagaagccctctggttttctgaattgcgcccaccagggaaggaacactgaagatttcatctagtcagctttcccttggctcatttgaggaagtgctagaatgcttcccaagctccctgcttatagggtaagaccctcctgtcccaagtatgacatccctggggttagtaaaagtctatgaccttaagaagaggtttctgcagaagcagcttggctctggctgtgcactgctgagtgtaatggtggcaggatgctaagggtgggcccagggtgccacgtggatgtcagaaagagcaaccaagggcaagcccttcttggagaggcagcattataattgccatgtggcaccggtttgcagtcactgttcaggtaattgctttgtaattgactgcatcaccttcttcctgtttaataaatagcacaaatgaaaccaacccgccagtggtgggattgtaattcaaattccattgactatagttgcgcatttttcatttagcatgtaaaggcagtttctatgtaaattatttcaaaaggttctccatggactaatgacattagcgtctggaaggataggaattgtcatagtaattgataggacaatggcgtggtgcatcatggagaaagaaattggcgctgtaacttgtacactttttaaaaataaagccaaattaggagagaactgctgaaaaacaaaaacacatatttcataaacaagaatccaaaatgtgacacatttgttttgacttaaagagccaaattatttacaaacacagaattaattattccattgatgaactttctgcagaaaaattatgagcactggcaaatatggacatattctctttttattcacccaaccagccactttacctaaacaaagggtacctctatgtctagttcccctactggcagcagaaattatattaaagacattcgttcagtttgaaaaacacagacttgtaactttttttctttataactggcagaatattaattctgcaaaccaattcaagaatctctttgaaatgtggccttttgggtttcaaggttgtaggtatatatttaataaattgagttgctttacagttaatatgtcaaaggcctggtctgccacatggagaaaataaaagttgtagaaacaagagtaaaaccttattaccaggtaggtagatgtcctgaaaaattggatttcatccccttgaatttgaatctcttgtaaattaaatattcagggaaagagaagtcaaagcagcaaagtaggaaaacaatcaaaacttgaaaacgagcatgttcttaaatgaaagaattaatcatgctaaattagaaaaagtattaaaatagttttagattaatgcagactgtgagtatcaatataattgcagcagcttaatttggcataaaaagcatctaatgaaatattttaatatcactgtccattcaatttaccagcttgaatttcacggggtattaagtggtttttaaattatcattgcaaaattttccaaatccatgtggattttttttgttgttgtttatggaaggggaaagaaattgtgtgtgtgtgtgtgtgtgtgtgtgtgtgtgtgtgtgtgtgtgtatgattaatgagtctaaatccaaatttctactttgtggaacgggtagaaaccaaccccctgttctttcccattgtgccagaaatccatgttcctccgcttcttggacctcggccacccagggccagggctttctgtgtcatcctgaagaatgcacagctgctcccaaggagagtcaaagagcagagaggagccttagcagctatttagttcagccctttattttgcaatgagggagatgatcactccaccttcttatagaaagagagctttagggagcctcatttcttctggattttctgactcatagactatattaaaaatacctcagtacactagagaggaactccaaatggcaattgtcgaagcacgcttgcccagggatcctgcaggcccaaccacctgtgtcgcctgacatggcatttttctggttttccagtagctccaagactgggttcttccatgcaccccatctgctcttgcccctctgcccaagtccagccttctctctcctccaaaagtctctttctcattgcctgtagctctcacctctctgataactgcccccagatctggaagagcagaatcaccaggccagcagggaccagcgactgccagtttactcaactggacgggtggtttctattcttcatctcagctgaatttctgggtagcatttgatgacagttcatttcagcctctttcctgaaactccttttctaggcttccttgacctagaaatctgagtcttggtgacctctctggccactccttctggatctaaagctctagaaggactccacgtgaaggctgagtaaagaaggatatgccagaaaggagagttggggctgccctccctcagggagcctgcagtgagggagggaaatagattgggcagggggtggcagtgggatagaggtgactgtatttacacaacactgggggacagagggatatgggtttgttgcctatggccatcaggaacaatgatagttttcaaacaggaaagctgcagtcctaacacccttgtgtctcgtgacatagcctttttctggttttccagtagcaccaagacagggagctccaagacaaggacaatatgacaaaatgtccgcaagattcatgtaggatgatgctcattacagcagtattgataatagtgggaatttggaacaacctaactcttcaatgataaggaacaagttaaataaatcatggtactctgcaaacatttgttgaataaataattatataaaagagcataaagaagagtaaatacgaaaaaaaatctctaacctcaccgctgcaggcaaggattttgtgtattctcacccttctccaacctccaccaagatgcactttacacactgccaccccaactacaggagacaccccacctgtgcttttccacataatattatgttgtgcatggtttctcatgtccttgcatatgctttgtgatcccatctttgaatggatgtatattgttctgtggtcagccctcctcaagttttgggcaaaactgtcttcctttcccgctctctactttctccgaggttccagctcatccatacctacagctccagtggtacttgcacacaggtgactcacactgctctatttctgtcccagtcctcttctctgggctccagataggagagtcaaccacccatcccatggtggatgtcaaatgttcactacttgacgtctccccttagactctttggactcccctaagtccaaaccccaagtcatgatcttcatcttcaaatatcttcatttcatgaaaggaagcaccattcattcagttgtgcaagtcataaggctggtagtatttcctgataccttcttagccctctatcacccccttgtccaaataaactccattcccttttcctctgggagctgtaaaatccaaccttttcctctatccatctccttggtcatcatagcagcccaagctaccaccaccaggacatcatctttctacatggactgcttgccccagcctgttctccatgctgcagctgaggggtctttccacagtgcagaccccatcagtccctgctccgttcttagggtgagatttgtggctctctggttaggaactaggcatctggagccacttatccaagttgagtcccagttcctcttcctctccctacctgtggggcttgcccctgtgctcccgttttctcatctatgaggattagtgagtcaatcacagccactgtccttagatcagccctgccacatagaaatgctgtttcggtatttgctgctgttcttcttcttcttcttcttcttcttcttcttcttcttcttcttcttcttcttattattattattattattattattattattattattatttctgagaaggagtcttgctctgtcacccaggctggagtgcagtggcgtaatcttggctcactgcaacctttgcctcccgggttcaagcaattctcctgcctcagcctccccagtagctgagactacaggcccgtgccaccaggcccagctaatttttgtatttttagtagagatggggtttcgccatgttagccaggctggtcttgaactcctgacctcgtgatctgcccgccttggcctcccaaagtgctgggattacaggcgtgagccaccacgtccaggcttgctgcttttattttgctattgttatctgtaaaatagagactgtagtgagaaacacatgggttaatatgggcagaatgctcacaagtgtgctaactgcagagtaagtccttcatgcgacgtttgctgtggctcctggcattccagcctctcctgggccgtgggcttcttccttccctgtgcttaactggatctgcagttcttgtgctcgccacatgcccacccaccacaaggcctttgcacgtgttctgctcctgcctggaacactttcctcgctttacctccttcttgcactcttcaggtcgtaactcaacaacttcctgacctcactgatggggccacttctccctggtggggccacttctccctggtgtctggtactccttcctagagaatccacagaactcgtgcaaggaaggatagcccagtggagggagccctccgctttccagctccatatgtggggacaagacacaactcaagcagccctctgggaaacccattggtttccaagaccctcccacagggtgcttggtggcctctggtggctggccctccaaggctccttttggtccggcggccccagtggccatgcgtcctagagagagatgttcagcctgatgggagagagggatccaaggatagattgtttacaggcagctcacttccatgcacccctgcccctatcaccactgatgatgagaaaatgagtcagtgagagcccatttcctgttctttgttttcttttaatttgagagaagatggagagaatccttgtcaggtaattacaccccagactggaaggtattggagcagctttccagccaagtctgggactcgcactgcatttcatggtgggtggcgctgatgcaccttcgggaagttctgcgacgtgcaagctgaccctggccatggggctgcctctatgggaacattgtagcccatggcactattcacttgggcctacggatgatcagtggttctcgccaaactatctgaagggagttcccagtgcctcgcctgtctcatggcagctcctctgaacagatgctcaaaagctgcctttttttctttctgaaatacagaccacagattctatggtctttaaagagctgagctattttaaagatgttggtacaacagaaccctctaacctaaacatcacataaggggaactcggcgcacaggtgaaccagctccaagatctagcctatctctttattctaaaccagagattcacatgggcctgcttttggggtgaaagtagggcccctgagcccataacgacacctgtgtacctggcagccactatgattaggtgtcacctgtttggagccccactgatggctgaaatccccacctcaaaaactagaaccaacaggaggctcatgataggggtgaccatgtacatttctaaatctgctacaaattcccaggccacatgtgtcctcttttcacagtgtagaggccaggaaagagacctgcccgctagcatgctttctctaaatcagctgtttcagatgtacccaccaccgggccaatggagcctgctgtgtgccaagcaccatgccagattctgaagactcagggaccagcgccacatggtctctgttcttgaggtgtgcacagcctgcgtgctgaggggatgagtgagcctgctggtggggggcagagaggaaagacctcacagggagattggcatgtgattgggccctgaagggtgaggaggagcaggtcaggcagagatgggcatctggtggagttgatggcacaggtggaggggcggaggcgccagggtgtgccacgtgcttttagagctgccccagcaacgattcttgatttgaggtctatgggtggtcctggaagatcgtcatgggggtcttcagctattggtggcattttgaaggtccaaacagagatcttccatgacaggtgcatctgtggccgtggcatccaatctcttctctttgggctggaatcatgaacgttcagggtcgtcaccctcaccctgctgtcatcctctgaggctggggagatgtacctgtggctgacgttaatgcacagaatcattgtagtatcaatgcaggattttggcagcaatgcgtttctataagaagtggagatatttggagctgctgggctagagtacaggtgtcgtatctcagagcatgttaggctaagattgtaaagggtcttaaatgaccccaaatatccctgcctaacagtcaacaagttagagatttggggagctattgaggctgagtggaaagagtgaaaatcccagctctacacttctgagtagtaagatatcaggcaagttatttaactttcctaagcctcagtttcctcctctgaaaatgaggacagaggtgctctgaggactccagattgttatggagagtttagctcagtgccttccatcgacttgacactcagtaaacagaagctggagctactcttacctctatcactgtaagtgtcaaaattgtgatggtcactctgagacttactccatcagtaagtaaattaactcatctgatttgatctagcagagatcagctgcctggagcaactgcaactttttttggaagatcagagaatgaggaaaagctaagttatttttatcaggaaacactcggcaaggagaacaggcttggggtagagagagaggtgctaccgagagggatttcagcaggcggggcagtgtgacctcagtgagcagccagggggagacagggcccaagggcgcccctgtgttctgcagaatgcatggcagtgtgattcagggagaatatggccatcattgtgaatttgttttaggtctcaaatcggatgtcatctccctgtgatggtgtggacatggggcgatagtcatctgagagggaagacctctgagcatcacattctcatgagatttgtaactgctcttgggactgagttgagctattctaaccaagttcctctacctttctccctttccttcttctccttcatcatcatcaccactgatatttttacacgttgtattggtcaggctaggttaggccatgtgctggtaataaacaagccctttccttcttcttcttcttcttcatcatcatcaccactgatatttttacatgttgtattggtcaggctaggttaggccacgtgctggtaataaacaagccctggaatgccagtggcttaacaagttcaagtttatttctcactcacattgcaactcttgtgaggcaaatgctgcatcagagtggttcccctccaggtggtgactcagggatcctggctccttctattgtgtggctccaccatcctagagtccttgtttctcatccctgaggacagggaagagagtgaaggtgttgtagcagccaggcctggaagtggcatacatcaattttaccttcatttcattggccagaactcagtcccatggccagtctaactacagaggaggctgggaaatacagtctttctttgtccaggaagagaaaattatccagttagtttggtgactagttagtttctgcatgtgtgtattatctcacttaattttctagagaaccccatggaccaggtgctattattatccgtattacgtatggataacttgaagtacagagaggccacctgaccttccctgataagcagtggagccgggattcaggaataagactgtgtgactctgaagcccacactcgtagcgctctgcgtgctgggcaccgtgggggtatgagaatacacggcacagttcattcccacacaaagagcttataatctagagtgctttcctaacaggaaggggttgctttttgtctccagagcactttatctctattttactttgcattgtggttatttaattgatctcctcaactagacttgaagtttcagaattaatgtcagacgttcatctctgcattgtccatagcccaaaggatacttagtgaacactggttgaatgttcaaccaccagttcaaccacactggttgagtgtgggccgttcagtcaatagagagtttggggttgtgggcatggaagaggagaggcaggcaggaaaagactcaggacagggcagtgtgctggatgcaggaaaaccaagggtgaatcaaaagttgagaaggaagagttggtgaattgtgctatgagcaacagaagcatactggggaagaggactgaaagagagcagtaaccgtgagatccctggtgcccatgcaaagcccaagaagtgatgagcagaagccagaaagctagggctggagcagagagcagtgagaggtggctgcagccagcacaggcggctctcgtgaagcatttggtattagcgggagagttggggaaggaggatcaaagtcaggatgagtctattagtctgttcttgtattactacagagaaatgcctgagattgggtaatttataaagaaaagaagtttaattggctcctggttccacaggctgcacaggaagcatgattctggtatcttcttggcttctggggaggcctcagaaaacttacaatcatggtgtaaggcaaaaaggaatctagcccttcacatggccagagcaggaggaagagaggggagggaggtgccacacgtttaaacaatcagatctcatgagaactcactcgctgtcatgagaacagcaccgaggaggaaatccgcccccatgatccaatcacctcccaccagaccccacctccaacactggggattacaattcaacatgagattgggcagggacacagatccaaaccatatcagtgagggtgggagttttccagcctcttgtgtctgagcaaagggaaatgagcaggaggggtgagaatgaaaaatagagggagaaggtgtggtttcaagatccagtcccagacgacaaaggaagacaagaggatgagataacaggagaaggactgtccttggagaggaaggggcaccctgtcctcggaggcaggtgagaaagaggaacaggggctccatttcctcatctataaaatgagatgccccggtttgcactctcaccttcgtgtgtttgtgggcatcctgggttgaatagtatcctcccaaaaggcatgtccaccctgaacctcagaatgtgaccttctttggaaataaaggctttgcagatctaattaatcatattaagtgaggtcatgctagatttgagtgggcccttatctaatgactggtgtccttagaagaacagggacctttggataggacacacagactcagggcaggcatggagagactgcgtgaagacagagatagagactggagggatgtgtcttcaagctgagaaacacccagaattgacacaagactggaagctggaagagacaaggaaggctcctccccagagccttcagagagggcgtggtcttaccaacaccttaatcttgaccaagccttcagagagggtgtggtctttaccaacaccttaatctctgccaaggcttcagagaggatgtggtcttaccaacaccttgatcttagacttctggcatccagaactctgagacaataaattgctcttgctttaacccacccagtttgtaagcaataggttatggaagccctgagagactgatatagtggggaacatgtgaggtgcattggaaaatactgggaattgtacaattgccatgaaaatgtgcagcatttccatcagaatgattatcaagtccatcgtgtggacatggcctggcagagggaagggatggggtgaggaaactcggttctgcctttgacagtgccttcctttggcctggagctttttcctgcatcatattcagtccctctggatttaggtgatgaaaacaccatgttctctttccttacgggttgcccctcacctcagcagaagcagtgcatgtccctgagttttagatttggaaagagagatatatgtggagtagtggatgttactatatgtcacccagctttccacctgggcaggggacacctgccttcagtgagagtaactcggggcctgggatgttcactagaaagttccatacctctgggtctctgttgggccattttgcatttccaaattatgtgttgcaaccaccccccccatgcacgtattgcttttatcttcctgcgtgtattgacacacatttttagtgctttctccgcatataaactgactgctatctttagctttacttgctgcgacgtaaattattctcattttattattattaccatcatcattttcattatcacatgatgccagcaagtgctgtggctctcggggactctccgacagatgacagtcatagaatgaaactcccaatgaatagaaaacccctaacatttattccatcgatacttttaccaacaagtctgaggttccttttaactttactgtcctaaaatgtccctcattttgcaaatgaggaaatgggggctcctgggggggtgaagtgactctcacaggatcactcagctctcagtggcagaatgggaactgacccctggtttccccctgcagagtgcagtgtcttttgtgtgggatgaaacatgctcccaatcccattgccacattcctcttctgagtctgccgggactgctgtggaaggtgctcagtgaagcactggtgggtgggctgccatatctgggttccttgcagtgcacctactgaaagcctagaaggaccttcactccatgacagacacagtacccagaggctgggaaagttagggacgaagacgggcagagacaaagggggtgctggactctggcaggatcatccatcgtgctggagtggggaatctccctagagtgtatctcgggagagtgccatgttgttagggagaacctaggctatggagtcagcctgacccagttctgcgctggagtagttacgtgaaaacagtgggcctcagtctcgtcatctgaaatggaatttcagtgcacaactcctaggagttgttcagagatgaatgttaagtgcctggcccagagcctgttcccagttggctgagctttcctctgtgtgcacgcccctcatcacaccagcaaatggtcagcttgtcttctgggccctagcgatgaattaagcgctgctgggagatcccctctgggtgttgcttcagctgcctgacctcaggaggctgatatcacagcaacagcactcactgggctttaagccttcacatttcttttactggcagaactggaagggcagagagcctagcccaggagtgggtggccagtgagaactgggcagccagcctggctccactccattggcggcattgcccttggacagttttggttgtcacccacatttggcttcttagctgaaactctagaggtacattcctccttccaacaactgtctggaaacaggaagtggtgcagggaagaaaaccagatgccagcttcccccgctgttttgactgggctctgtaaatggaaacagctgagaatactatccaagggtgcgtgtgcccatcttaaagctggtgtgtgcattgcagggaggatgctgggtgcaaacatactctgacgtttatattgaatattttagtttgcagaaattcgcaattaaatctactttccacctacactttgaaaaatccatttatagaaaccaaatcaaattggagatctaaggactggtggccagaaatgaaatatttttaaaataaaatatatggagattgaattgctgaagcgctggcttgttctgcggcttcctgggatgtgagctagagggaaggcttattggacagagccttctctggggatcaattatgaactactcttacgtcctggcagtttcaaaagggaaaaaaaaagttctttgaaagaacttatttagcaggcagagccaatattctgtgttttcttgaagccaccttgtatttcagcttcggtgaatatgtgtgtctcctgtggatctttatgggaattgcttgaacactccggagaggctggatgtggcattaaaaccacctaacctttgctcccccagcctcgccattcatcctgaagacttaattatttctcgaaagatgatccatacgggtactgcctttttcttaggaatgtgagcccagatgctgaattccccactctccgtactcaggagagagaagctcagactcagctctggcttaaatttctgaattgatccctgattgaattcctcctttgaaaattatcaagagctgcttagttttttcccagttcctatgagggatgccaaatccttgcatgcgtttctgcactcctctgcacccacggaccactcagagaaaatgcaaccattttgttcaagtgagttcttattgcccttcatgggctcagttccctttgagaagacaactgatcccatgccacgtgtttcctgcagcctcgcttccgcctttaggaagcaggcagaggaattcctacagagcactaggccaccccagcgccacctcccatgtcacaccaggcagaggttgggtgggatctctgggaaggcatgtcctccctgcctcctgggaatcctggggaagaaccaccctaggaagtggcaagctccggcggggtgtcctactccctgctgggtcactggagcttccagagcccaggcttcgttgcttttctgctgtattcctgccccctttctactgctttccagtggacagggacggggtggggctgccttcctgggaagggattgcgctgcagaagctggggctggtaaaggctggggagcaaatgcagaccttgtctgggtgatgagagaccgccactcgtctccaggagctcccgccagaggcctgctgtgacaagggataacgtgctggcaggccacttgtccaagagaatcattccttcctgcacctggacactgtttcagggctggcatttctctggcactcggtgtgagcaaagcccatttggtcgtttgtcagtgaagacagaagagtcacaatgagccgatttatagagtacatggggtgttgtggggcagaggcccggatggctccatgatccatgtgcatgtgttcccggttttgtttgtcatttgctttcttgccatccactgggaaatgtatttatcactacagtttgtataatttggtggtctgttttcatcttttacaagcaaaatgcttggtatttcaataagattgaaggggggtggaaatagattgcatcccacttaggactctcagtgggggagtctaaacatgaattatcccagcttaatgcttcaagttattggggttcccctggggagcatcttcttggttcttgtaatgttgctgcctcccgatggctgcccagggtttccagctctcccgtgcccctcgcttttctctgaaaactcggcatgccccggggggcctctttggagcctgttggaggagattttgtagtaatgagcatttggcttttgtaatcctttttctgcttcgtgctagcagcctcgcacttcccacctgttaaagcttgcaaagatatcatcggcaggcattttcccaggggaagcacagttgtgtccaaagcccagaataatccaggctttcctcatttctatgcagagggcgttagttgatcctggtgccctcaagagaaggtccctccagaacaagctcaccctccatcacaagcactgatgatgggggtgctcaagctggggcagggagaggctgagaggggataacccaaggtggcaggaggctccctcggtggtttgtggtggggctgttctgttcagccaggatgtggccctttcaggggtttacgctgtttaacactggctgagtgtcaggactggggggctatggatggtgagcttctccctggagctggctggtagggaagttcagcagctctctggatgttatgaaaccacggagaggcacagtcaccttaaaaggacagcagctctcactggctgctagactgcctctgatggaaggtgtctgcaagacaaaggagaggctgcgggcagcagtgtgcgggggacaggtgatcttggccagcatcctgcttgctcatattcctcggtgagaccagctctgcagagaaagggctgcttcagccctattcacccaaaacctcaatgtagaaaccacccactttgctctcgttcagcttccagagggaatgctgtcagtgacacagcattctggtccctggagtagtgggttcttgacattaacgaatgggcattgtgattttatccttgtgccttatgaacttggttaaagatttgacagtcactgtcagaggctgcaagtcatgcaggggcttctgagcctgcaggtgaggaccagcccagaccagggtgaagtctcagagagactctccgtggacccttcaccaaatggcctccaaggcaaggcccttgatcacaagtgtgtccctggttctccctggtcctctcgcatctgccccgtgactcccgactcccctctgcacttggtctggtctccaagatcgttctgatgtggactttcctccttgtctatgctggcagacctcaggaggaatccaccacctccgctttgctgccaggccaatcactgatagcatcaagcacactggcttgaagtcagacttcaggtgttcaaatactgactccaccttcacttacatctgactcgggcagttatgtaaccttctggctttggggttttttttgttgtaaacagggaccctaatggcatctgcctccctggagttggaagctggaacggggcaacacatggacaatgctgggaacagtgcctcacacatgcccgtactcaatgctgtcatgggacccattccggccctgtctcctacattgcatctccatctgtgatctttcactcagtgccccggggttgagaactaaacccctctactcattctcacaagcaggccttttcctcttcaaccagattgtaactccctgaggggagggcttgttgtgtgtttcctttggatctgcacagtggtacttagcagcgttctaggcacctggtaagggtttgagtaaaacagactgattggatagttagtgatgctgggaatctggagtgtgaattaagcagtatattccaaattacttccaggcgttcatcatttcagtatcacacggccacatgggaaaatgcccactgtgtgaaatttattcatcagttcaacaaatatttatcgagtactttccatggcatggttttggttcctgaagattcaaaaatgaacagacagaaaatatccacgcccttgtcacttacctgcagcagactgacagtggtcagatacaatctcaagaggtgatcagtgccacagagaaaatagagcagggtgtattggttatctatctctgtgtaacaaattatccccaaacatagcagtttaaaacaatgcatatttattatctgaccatttctgtgggctggggccaggcatagctctgctgatcctcccactcagggctccttacaaggctaccgaaaaggtgctggccagggccgtggtcattgcaaggttcaactgagtcaaaatccacttctaaactcgatcatggggttgttgggaggatacagtttctcatgagctgttgaactaagagctcaggttccagctgtttggtgaatgccatgtgggcctctccatggaacacaacaggaaagcttgcttcatcagagtgagcaagtgagaagagccagagagagtgaacacgccagggaccttgagtcaccatcttcccagtaaagtaagtgccattaggaaccccactttacagacgaaaatggaggcccagagagttaagtattttggccaaggttacataactatgtaactagtgagtggcagggccgaggtttgatcccaacctgtttggctccagtacttgtgctcctaactaccacagtggaccattgctctgccttttagttgcacacactgtctgctgcagtcttcttgacaagagaagatgatgactcaggaacttcagcagtagtggggatgggaagaagtgggttgactgggaatacattttgaagagattgttgctagaacttcttgataatttgggtgtgggaataaggtgaaagaaagatgttaacaatgatcccaaagttgggtgcctaagaaactgagtgaatgacggtgctattcctcaagatagaagatgatggtagtggagcaggtctagggggagaataaagagttctgttttggccacgtcaagggtgatgttcagatgtagatgtcaagtggcccattgaatacatatgtctggagctcaggggagcagtcagaccagagatacagacttttgtagtcattaatcacggatgaccaccgagagaaagagtataaaggagagaaaatgactaaagacttagacccctgacacctaaaacatttagctgcctggacaaaaagggagagccagcaaaggaaatggagacacagggggcaagaaaaccaggaaagcatggtgacctggaagccaggtgaagaggggcttccaagaaggaggaaatggttagctgtgccaaatgcttggtgagaggggatggaggaccaaatggaaaaagaaagctacaaaactgtattttcagaaatgtcctaattttgcaaaaataatttctccctgcccaaaaagagtaaaaagctctttgagtttgttaaatctgtagtccaattttaatccatgaacatggtatatctctattctagatattttagaagatatgtggtaggggagtgtgggttatgttgttttctataaaaggtgttgaattttgttctggcaggtcagttaattactggcagatcctcttggtctggtcaggcttggtttgaatctttattagagttggtccatttttattttgcccttattcctaggctttggcctttcctgtagggtatagtccttgttcctaaggcctggccttttggggaacaaatgcccaaggtactcagcaagggttctctcgtctggcttggccagaattcaaagctctgccagctctgcatgacttctagtatctctgcttagctttcagtcttataacagctatggagttttgccctgcatgtgggcagttctgccctcaaccaagtactcacagggtacctccaggcagacttctagggcctactttctgcacaagattcttctctccagagcccagacctgtaagttctagctgctttagcagccccaaactcttgatttttgccttctcctataatctaggctgctgtgccccatcgtcctgcataatgggccaaaaggctgggcaaacatggggcttatcttgtgtgttttttttctggcagaaccacagtcctgaactgcctgttgtacaatccctacaaagagtagcctcagatatttttgtctagtttcatgattgtttacagcaggagggcaaatccaatcctagtcacttcattgtggcaggaatcaatatctatttggtttaatgtttaccattccttcccattccctataccagctcatcacccttgtcagcggcagttctatatatgtttgtagtcctttcagttgaaataaaattgagtcaaacaatttataatctgaaatgaacaaagaccatgtaaattcttttcagttgcctttttaggctggtatctgtctgtagaggactcccagggaaggattctcaaggaagactcaatgggaagcctttggatggcaagctacagggctgagtacgagggtggccttcctgtgcggggtgtaggattagcatcagagaaacaaatcaggaatccctgggtataacagtaggggctgcattgtcattttagccttctccagagatgcatgatccaccccccaccccgcaggtcttttcctctctatgaaagtcactgacaagttcctgtggatcccctggggtccccaggaatgtatttctactctgagggccagtgagtatctttttcttggccatgagccatgaatagaaacgggacccttaatactgcctgacctgccacatgcagccctctcttctgggactgtctacacaagtacatttccaccatctacaggggcggaattccggtcatttgctacaggggaaattctagatttttgtttctaaagggccccaggttaccaaggtctcttgtatattagaattttaccacttctctctgggggaattaggtatttatcaatacattttgtaatatatatttaccaaattgtttatccagcaaacttttattaagcaaatgccaggcattgtgttaggttctgaagctctcccagttccttatccagggccccaggaacgcactcagggaccatttcagacacgtgggtgagtcagtccctaatgggctcagaagagaatcaccaaaatgtttaagacagaacagtcccgagcagccaacatttcacccttccttcctctctcttcccttgccgaccagacccaagggttttggactcaactgtttccttttgtagcaatgagctaaggaggctatttgctttgactaaggggccaagatgatgaagtcagatgtcctgagtttgcatcttgcctctccactgacttgctgtgtgaccttaagcaagtaccttcccctctctaggtctgcttcctgaaaattcaaagtctctgaaaattctgttttaaaatatgtgctggaggtggggagacctgattccctgcctagtgcttccttcgttttcatggattctttattaagcagatattacttcttcataataaaatcgtatatgaaacaatgacttgatttctttatatgaaacatactttgtacatctaaaaatgttgttgaaatcatctgagcctctgagcaagagcttcgcctttgactctgaagccagtgctgtcagcagtttctcccccttaatgtaatgctgtatgtgactcaatatgaactaagcagggggtgggaggtacagaccaccccagtaatccaggctttctctggaattctcccacttgtttatagtctgggcaatttgcctcctgctgctgcatgactcagactcggagagcttccaacctcgcaatgagccagcggctccccggagtcagacgctggcccttgtgtctcaggctcctggaaccttccgattaagcctccacttccatctcctccctggccacattcaggcagcaatgccccaaccccacacagagacacacgcccaatcagtgccctgtacaagcagggactgtgggtgagagggtacaaggaggtgttccaacccctcactgagacaggatttctagcccctctctttggtttgtgtcattttgctttgaaatgtaagttgacttctgatcagggcagatctcagttttataggaccttgtgtaagaataagcaatacaaaataaggaacacaaaatgagacctagagtcttagaaggggcccgtgcaaccagaggtgccccgaaagcttaagtgtcattgacttcctagcaaccctgactgtggtctgattcctttaagatccagaacaactgctccctgtaccttaagtaattatcatttagaataaagtcagaaaattgcttgctgtctgtttattttagaatcaagcagcttctgtataatttgaatttgagatagcattcttaaaaaaaaattcccttcgcaataaagcaccagattgaatgtccgatgagtcacaaatgcccttctgaaaacagctgcattagagggactcactcagaaaacatgattttccttcctccaagggtctcccctagaccctggcacagaatcaccctggtccccactctggtcctcccttccaggctcattcctggtgcagcagatcacttccacatttactgcatcacatccagcatcaatgtttttaactccatgaattgtttagaaaattgtatagaggccaggcgcagtggctcacgcctgtaatccccatactttgggaggccaaggcaggcggatcacctgaggtcaggagttcgagaccagcctggccaacatggtgaaaccccgtctctactaaaaatacaaaaattagtcaggcctggtggtaggcatctgtaaccccagctattcgggaggctgaggtaggagaatcacttgaacccgggaggcagaggttgcagtgagccaagatggtgccactgcactccagcctggacaacaaagagcaaaactctgtctcaaaaaaaaaaaaattgtatagatattgattaaagcagaaccctgaaagatggtgaatgattggcaggcaatgagaggaagtgtcgtgttgtccgttggtgacatttgcaaactctcctggtttaaagtgattccagagcaactttatttccatagtctgtgttgcactcaaagtaaatattaattccattatgccataaacttttatttatcatgacagcaagtcataaagttctcttactagaatatagcttctaaattgcatatcatagatgagatacaacacacacattggattctagcagcaattacccaccatcctttatgcaagtcggtattaaatgcactttctaaatatgagtcacagtctgagcttatgcagaaaatcttccatggctattacccaggagcccagaaatatgacgtgagggtgacagaggagccacagccagcaggggccagacacaaggatcaaagtgcacctagtcacccggcagtaattcatctgaagcattctttgcatattatgggtctgactttttaaattacgtaaattgctcattagaagtgccttgtaattgccttcacctgcggtattgcgagaggtgtagattttaattattcttttttgatttgtaatgtggtttgactttttcagggtgatagtttggaaaaatacagatctgctctaattgttgtaccaagtgaaaatagatggctctgttgatcaacttccttgactttgtggtggagcgtacaaaggagtcttatagtttcccagcccttgttgatgactgaggggctttgcccgtggggcccggggaggatccctgtgagcctgtagtgctggtgccttgggctcagccagcccctcagatgacttgtgtggagccaggcagtgtgttcatgttggatgtaaccagatctcgggggagtctgctcacctcttccccacagcatggataggacagaaaaagccaaggcccattcatcatctttgaagactgggacagacatgatgagtgctgggggcgcccaggtccggggtgctcctgggatgcctgctgcagagatgcttttctctctagcccacttctcgagggcagcctggcctcctgctacccagcaagtgctctcacttcctgcagcacagaggcctccacctgtccagcccaccctgagccaagctgctctgggctctggaacgggctgcaggctttctcgggcccctgggcctggccccctgtcatccagcacacggaattgatgagttgtgagaccagagctgtggcttcgggggtaaacttccaggactcgttctggctcatctgcagccatggatgaataaaaactcgatcaggacgctggtctttgaaaggcagctattttaggactcacttttggaaaggcagggggattgtttttccaagacaaaattatgcatttgtcaatacagcaaaagcatcgactgctttctctttggtgggggtggggggtctcttgccttaatcattctccatcagaaagctttgctctttgaagcctggctggcattgggcttctgtgcatctgcccacagagagatgctcctcaatcccctcccgcacctggccccactctccctttttggagcagctcacctctcaccgacaataacagggagaacctttgtgagtctaggaacggttttgtcataaagcccccagcccatttcctgtcttttcatcccctgttttatgcatgtggcattctgttccaggccagattgctgtgacatgagaaatacccgaaatatgggctgccacggtggctgtcattaaccaaccactagttgtgcctttataaatttttacacaccgctaaattataaatatgcaatgctgcgagtaatgaaatatgcacctctaataactgcagttagaagatttgtaattctgcctgcatgtgccataaactgggaggagttggggggcttcatctgtttcccatttggagcccctattgtgcttctccccatcccagagtccctcatgagggtcttgcgtctcaaggggaccctttgggggagcctctctcaggtattgggcttccccgcttgatgccttttcttttgttggtcacatggattcaataaacgtggttcactagcacccaccatgtttcagacctgtgcgaggctggcaatctgcagcagaattaatcttccaaatcgtcattttggggagatgaacaaattaccaggcaatgacagtgcagtgtgatgagggcccaaggggaagggtacccaggtgctgtgggaggctagggtgaccctgaacaaattctgtaatctctctgtgtctgtgtcctcattcatgactgaggacagtaccaccgccttcctcttggtgctgctgggagcattatatgagttacgacatgtaaagcatttatttagagtggtgcctggcatacattaagcactcactaaacattaactagtataagcaccgttattattacttgacttcttcctgtcttctgcctcgtagttgagatggtgcctagagcactctcttccttcttaaagagcatggcttcagcaccacaagctttgaattaaagaaacattgaatttttgtccaatacagaaatatcttgtctttatattgatatcaaaaacaatctgttataaaaatgcaaacagtataaaactgtataaaaagtcccccctaaatccaatgtatacatacacacatgcacaaatatgtttatgaagctgagctatactctatgtctcgtttttagccacaactatatagtggacataatttatgtcatacaaattagtacattttaccagcgtaggtgttattttcttacccttttgttggatgattacatcgtttccattgtttcattgatcccacaagtattactgagcagctgctagaacccagtgttctaggtgctggagctgtcctagcccttgttgacacagtctagagacaagggatgagcagacaataagaactagaatatgtagcatgccagatggtcatgagagacacagggaaaaacaaagcagagaaaaggcatgggacgtggctgcaactttaaatccagtggtcagggcaggccttactgaggtgactggagaggaaagagctgaaggggtcaggagccctattgaaatctggggagaggctttccaattacaacagcaagcgaaagcctttgagatcacagaacaacctggacaagtcctaaaagctttgtactaaggcaaagaggccagacacaaaaggacacacactgcattctgtggttctgcttctctgagatctcagaataggtaaattcagagagacagggattagagtagaagttctcaagggctgggggaggggagggagatgaagagttattgcttaaaggaggcagagtttctgtttgggatgatgaaaagtttaggaaaaggagagtggcaatgattgcacaacaatgcgaacgtcctcaatgccattgaatggtgcacttgaaaacggtcaaaatgggaaatttcatgttatgtactttctaccactattttttaaaaagacctcgagatgggagttggtattggatagaacgaatgcacaatgtttaaattaatgaacattctgttaatgaatagttgtttctagtcttttgttgttacaagcaatattttaataatatctgacaattattttatacacatatgtcattttacacttatgtgactatgtaaaataaattatagaagaggacagtttagacgatggactgtgtgactttttattttcacagatattgacaaattgtcctccatagatggtaaattaaattacattccagctaacagtatgtgaaatcatttgtttcctcaagcccttatcaaaacattgtgttatcaaagcttttttttttttttaggtctgacatataaaatggctcttacagttttactttaaatttatcttattaatgaagttgaacatacttcttttctattcagaaatttgcaaatctttgtattagattgttggttttttttcttatcggttagaagatgctctttatatattacagaaattaacttttctatgatatatagtaaataatttctcagctcataacttgattttgctttttaatattttttctagacatttaaaaaagtgtaagtagccaaatttatctcttttctttcatgatctctaaaatgtatgacatagagaggccatttcttgttccaaaattacaaaaaaatgtttttggtattttaatatttttatttttttcttaatttaaatctctgaatgatttagaatgtattatggtagaagggacagtgtcaatatattatacaactttatttttcttctccagatagctgctcaagtgttgccaaactatttattgaatcatctacctttttttcttgctggtaggcatgtgccttctctgttatatactaaattctgaattgtatttggatctatttttggactatctattctgtttcaatgaattgtctgtttatccacatttgattgccacactcttaattattgtagttttctaatacattttcatattcatgaaggaagtccacctttattcctctttttcagaatgttcttggctacttctgcttgtatttctctaatactctttggaattagactgatctaaaacaaaacaaagcaaaaaaccccccactaaaccccagctggtatttttactggagtcacgcccttaccttaccctgaaacctattaccactgatctgttcaccaacaccataggttttgtctttttgaaaatgtcttataaatggaattatactatatggaaacttttgagaccagtactttcattctgctcaacgttgccattcattactttttcattgccgagtaatactccattgtattcatgtaccaatttgtttatctgcttcctggatatataagtttgggatgatcatgaatagatgttctacaaatatttatatataggttttcatgtaaacagttttcatttctccaagggaaacactcagatgtggaatggttgcgttagatagtaagtgtatgtttaacattgtaagaaattgtcaacacatttttattattttgattttgtgtgtattttgttttttggctattttaataggcgtgtactggtatctcattgtggttttaatggtttgcatttctctaatggttaacgatgttgaacaactttgcatgggcttattttccatttctgtatcctcttaagtgaagtatctgtccaaatttttgtccattatttattgggttgtttgtttgcttgctgttgagtcagatatgtgatttgccaatatttttaactagtctgtaacttgtctgttcattatctgaaaagtgtctcctagaagaaaagttttacaatttcgttgaagtcctatttagcgattgtttcttttatggattctgtttttggttttatgtctagcaaatatttgcttaactccaggtcacagatattttctcctatgttcgcttttaaaaagtgtatgattttacatattgcacttagagctaggatccattctgagctaacttttgtctaatgtgtgaggcttaggttgagggttctctgtttttttgtttttgtttgcatttagatgtcttattgttctaataccacttattgaaaaaaaaatcttctccattgaatttgcctttgcacctttgtcaaaaatcaattgtctgtatttgtggagtttatttctattatgtctcttgtgttctattcatttttgtgcctatcacatcaccaataccacattgttttcattactgtaggtctatataggtcttcaaattggttagtcaaatttcccaaaatttagttttcttttaagaaattgttttggctatactaattactttgcctttcagtatacatttttgaatcagtatgtctatagttacaaaaagaatcctgctgaaatttttattgatatagtgttacatctatagatcactttgggggaaactggaaacctttcctatgctgagttttccaatatgtgaccgcagtacaatcagctctccatatctcagattctacgttggtggattgaaccaacagtggatcaaaaatattcagaaaaaataacaacaataacaataatacaagtaaaaaatacagtataacaattatttatatagcatctacattaggtattaggtattataagcaatctagagatgatttaaagtatatgggagggtaagcataggttatatgcaaatactataccattttatataaggagcttgaggatctgtggatttttatatccacaggggttcctggaactaatcctctgcagatgccaagggacaaccatatatctctccatttatttaagtctttaaaaaaattcttgttagtattttgtaattttcagcatatagatgctctatatattttttattaggtttttacctaagtatttccatttttgagctattttaaatggcattttttaagaactggttttcactaattcattgctagtatataaaaatacaactgagttttgtgtgttcatcttgtatcttgtgaccttgctaaactcacttgagttctaggatttttttttttctgtaaatttcttagaattttttgtgtgggcaatcatgctatctgaaaataggggcagcttttcttcttgctttccaatttacaggcttttatttctttttcttgccttattgcactggctagggtttccctacaaagcttatgtgagaatggacagttttgccatgttcctgatattagagggaaaacattcaagtctttcaccattaagtataaagttagttgtagggtttttttggtagatgcccttcatctggttgagaatataataatgttttttcttctttagattcttaacatggtaaattacagtgattgatttctggatattgaagcatctttgcattctcaggataaattccatttggccatagtatattcttcttttatatgttgctcaattttattttctaatattctgttggtgatttttgcatttctgtttctgagggatattggtttatagttttcttttgtggtactgtctttggttttggtatcaagatgttactgatctcataaaatgagttgggaaatattcctgactcttctgttttctggaagagtttgtgtaaaattgatactatttcttctttaaacatttagtaaaatttgtcagggaaaccatctaggcctagagaattttttttttcagaaagttttaaactactaattcaatttatttaatagttacaggactattccagggttgttgttgtttttttttaaatctgggtgcattttggtagtttgtggttttcaaagattggtttatttcatctaagttgtagaatttatctatgtgaagttgttcactgttttcccttatcttttttatgtctgtggagtctaatatctagtctctcatttctgatattggtaggttttgtcttctttctttttcctttgttagtcttgtggagaagtttattaatcttatttatcttttcagcaaactagcttttgctttcattgattttctctatttttttcattttcaattccatttgtaattcattcttattttactatctccttttggcctgctttgagcttaatttgctgttatttttctagtttcttaagaaggatgctatattattgattgaaacctttcttcttttctaatgtgaacatttaataagatgaattttcctctaaacactgctttggctgtatcccacagattttgatacattatatttttattgtttgatcagttaaaaatattttctaatttttttgacctatgggctatttagagagttttcaattttcaaatatttggagattttcctgttatctttctgttattgatttctaaattaatttaatcatcagggaacatattttgtagatttcaattcttttagttattttaaggtttgttttatgactcaagacatgatcatggtgaatattccatgtataattaaaaagaatgtgtattctgctgatgttgggtagcgtactctcaactatcagttggagttggttgatggtgctattgagttgttctatgactgatttctgtctactcattctattactgactgagagagaagtactgaagcttccagctatagttgtgggttcgtttagttttcccttcagttctttcagtttttgcttcatatatttgaaagttgttattatgtatgtacatgtttaggatcattatgtctcttttattattaagcagtgtctctttttatcatggtaattttctttgctctgtagtctaccttgtctgatattaatatagccactcaaactttattttccacagcatttgcatggcatatctttttccatccttttacttttagcctactcatatcattatatctgaaatgcattttttgggaacaacacatcgttgggtcatggttctttgctattcattctgacaatctctgtcttttcattattgcagttagaaaattttttttttttttttttttttttttttttgagacggagtctcgctctgtcgcccaggctggagtgcagtgacacgatctcagctcactgcaacttccgcctcctgggttcaagcaattctcgtgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccgccgcgcccggcctgaaaacttttattcctttgtttttgttcctttgtttcctctttcctgccgccttttatgttatttgaacaatttttagtattgtattttacatattgtgtttttttactatatctctttgtatagttttttaatggttgctctatgggttacaatacattctttttgcaatctacttagaatcaacatttaccacttcaagtggaacatagcaagcttaacatcatacagattcctttactccctcaccccttatattttagttgttttatatatcatatatatatatataaaaccccagtaaggaatgttataatttttgctttcaaccatcaaaaatattttaaactacttgagaataattgtctattatatttacccagatctttattagttctgttgttcttccttctttcttgatgttccaaacttacttctggtatctaattttccttccatctgaagaacttcttttagaaatttcttagagcaattctagagaattacttgtctgctggcaactaattctcttagttttccttcacatgatattgtcctaattttactttcattcctgaaggatatttttgccgaatctagaatcctgagttgactgacagttctttctttcatcacttaaaaaatgtttcacttctttctggcccctgtaatttcagaggagaaatcttcagccattcaaatcattgttcccctatggggtcaataacttttttctgtaaagggccaaatggcaagtatttttgtctttgcaagccatacagtctatatcacaactacctaactgtgccattgtctcactaacacagtcatagatactgcataacagaatagttatggttatgttccaataaaactttatttacaaaacaggcagtgagccaaatttggcccaaggaccatagtttgctgacctctgcctggaaagtaatgtgtcgtttttctctggctgctttcaagatttttctttttcttttcttttcttttctttctttctttctttctttctttctttctttctttctttcttttttctttctttctttctttctttcctttctttctctctctctctctctctctctctttctttctttctttctttctttctttctttctttctttcttttttttaagacagtcttgctctgttgcccaggctggagtgcagtgacacgatctcagctcactgcaacttccgcctcctgggttcaagcaattctcgtgcctcagcttcccaagtagctgggactacaggtgcatgctaccatgcccgactaatttttgtatttttagtagagatggggttttgccatgttggccaggctgatctcaaactcctgggctcaagtgatccacgggcctaagcctcccaaactgctgggattacaggcatgagccattgtgcccagccaacaagattgtttttctttgtctttagttttcagtttgattctgatgtatctgattatggattgcttagatttatcttgtttggagttcactgagcattcagatctgtaggtttacgtcttgtgccaaatttttgaagtttttgatgattatttactcaaatattttatctgtatcacaatccttttcatcttcttctaatattccaataacacagatattaggccttttggtatcatctcatagttccctaggctctgctcattttttaaaatcttttttattctctcttattcagattggataatttttattcaagctcactttttcctgtaatcaccatttggctctgtagcccactcagtgagttttctgtttgggttatggtaattttcagttctaaaatttccatttggttctttatattctctacttattttctgaaacatttcatttttccatttgtttttagagtgtttacccttacttcttggaacatttctataatagctgcttttaagtctttgccagataattctaccatctatgtatctatttctatgaaagttgagttttttttttctagttgttattatgccagccaattttggattttattctgtgcattttgaatattatgtgatgagactctaggtcatgttgagatctaaaggagaatgttgacatttttgttctcataggtaatccagccaggtgggttcaggctgcaggtttcagcctgaacttttgtggactgtgctttcaaggttagttctgttttcaaagcctttgttgtcctgtgtgtgggacctaggggctgtcctgtgtgtgcaccatacagtggccagtctggggtgtgggtgtaggttatcccgtagttcagttctcaaagtctttggcatgctgttagcatcagatccatgcatatgctgcttgaggttgagcccaggagtttataaacaattttgtgagattttccctctccaccatctccttgggcctctctttttcagtcatctggccataaagctgggattttagttaccttggtcagttgtacagatgccatgactgcacccacatctgggaccacagcagtaggttagagagaggaaagaaagcaacatgagttctccttacctccttgggatcaaaggtctaactattgtgagagagtttcccttctttcatggttttaggcacctgtgggcctcactgttgctgccatcaccacccaggattgcctgggggctgcagtgcaagtgaatggataaaagaaaaaaaaaacaaaaaacgggatttcttctgctctctttgagtgtccagagcctgttttcttgctccttgagctgcaaccagagcttaccgtggctctctttctacagtccaattcccagtttcaggctgcctggagtccagactcagggatgaaggaggaataggaagctcgtggctctttcaggggtgtttctaattctggtcttcctccttaatttgcctgctcctatgtacctttcaatgtcctcagatttgctgcttcaacatcagtccaggttttatagctgcattcaggatgctcactccatcttgcctggaaccagaactgcttccatatacttttgctcactttccaggtgctgtcctctctgtccctaactgactttcagcagggtttgttctcctttgggctgcttccaaaagggccttcttttctttgatggctttatttatttattttttccacttccttcctgagctctgccaattcatgttttattcccctttgatgtgattttgtgcctttcctgagcttttgtgtctctgctttgagtttttgttttaaagaagcacttgttcattattgtttgaagttgtggtagtgtttggtcaactatttttaatggctccatgacattttcttggtgagtatcctacatttatttatttctatctcgttactcctttttttctgtgtgtttatactaattggattatggttcctttcttgtgattcctgtctttcgataaagtggatcccactctcccaccccccagaactactatgaaggaatttcttacgggttgtgatctagggtagggcctctggctaacatgaatttcctctgaatcataaaggtccttagacacagagctgtgtctgtatttgtgaacctttccctatctccagccaacagaaatcagcagctgcagagacaatactaccaattcaatttctcttctctaccatctcctctttccctctcccatatccagttccctggaccagcctatgagtcctggcggtactctgctgccagtctatgaatcctgttttcatttttctgaacagaagcttgttggttttgtgcctcggggcatgtgctcactgttttgatgaactgcactccacggctttgcctgagagctgcagcggtagacgtcctcgttagggatcttcctgtaaccctgttagacctttattgcattggtcggcccttctccagacactgttaaaagagattagagataatttctggacatcaaacctagaattggtatttttctttttctccttagcattggggcaggggtaatttcctggaggaaaaaggagtaacatcatatttactccactatatgaaagtcagagtttgggtatatttatttttaaaatatgatacatattatcaaattgccctcaataatcttagatgtccttataattttctttataaatttaacctgatttactaggaaagaagtacgtagggagacagacagtgcctgtgaaaaggctggaaggcaggtttggaaggtgggctacttagctgcagccatcggtcatccttggaaggcagcgagaaagcagtgcggagagggcacatcagagctctcagaggcacagaagggccactgaatccagggattacatgttttgaagacagttttgcatcaggaatctagattcccacccacagcaggccaggcaaccaaccctaaaattcttaagagacgattatttgcaaaggcagaaagttcatcccccgggagggatccattcctaggctgaacaactcagttaccagcaagttctcacacaaatgtgaagtctatataccagttattttggtcacttggtgctgttcttccatccagagcacccctggaatctgttcctctctacacatagggcaaccgtttgagtactgaagcagggtcctccagcagatgaccttccccaaagccagctctgcagaggacagcagttctgggtgagcacaccctgtattatctgggtcaaaggccacagctcccagtgtgggacatggaaggggtccagggagggccttgcaatgggagccccagggtttgggattttggatgctctcaaatgtatccttgtgggtggagacagtccatttgcattccatgtagattcatgccctgtgtatcatggtgctgtttgtggttcccaactgccatctccagtccaggcattattaactcttttttatcatggaacctgagtgtcttaaatgatggttcccaataattctaaaccaagtgagcaaataggctgtgatggaagagacagagggagctgtgaaaaagaacaagagcagagcttttaaatcaccatgtgacaaatggaatcgtgacttaggtttcacaattgaggtggctgatttcatgtgctattgacaaatctttcacatttctgacagttacagagttccccctctggaacataaagtctacattcatggaggtcagcttcaggtacaccacccctaaggcctgacagtactttgctgtgcatctgagatctggcagaaacagcctctgaccaccagaaaacctaacttttcttccaagtcccaaagagattacaaaagttttaatcatcctgggactgtctctggctgaaggatagatatgaccttgagacattgacaagaagaatgattagattcagtgaaaaagagagcagggatgaggatgttgaaggggttttgactcaagggtcagtgaagggtgcagagaagacaaagagtgaatgagaacatgtctggaggctcaatttcattgccccttctcctggaaagcaattggcagctgctgacttgcagagcatcacttggaccagggttcatgttgaatctacccacgcaccttaggactttgtgcagctggagagagggttgttcggggcttggagctgcagaaacattattcctgttgtcagctgaagaaaattgtctggatataaaggataggccttggcctgactctatttgtcggggaggcagaacttcacttggcattttcttttctatgcaaaggatttgagacctaagagagggaagagatgagggaagaccttttcgccttctccatttctttccctgaatgtagactggttcagcagctcagggtgaagcctgggaaacaggcctggcttttaccgtggtgaatcacttattggctgggtcaacatggacaactctttaaactttcctgagcctcaaatgccagatgtggggattctgttctgtaggaccttgtttttgtgtcctgaggctgccttaacaaaggattgcaaactgggtagccagaaacaacagaaattattgtcttatagttctggagtccaaaaatacaaaatcaaagcgtgggcagggcaggctccctcgtagcctttaggggtggatctttcctggcctctcccagcttccagtggctgcagtgatccttagtgttcttggcttatagatgcgtcactgcactctggtgttctccctgtgcatttctgccttcatgccatctcctcctctgtcttcatccattctcatgctgctgtaaagacactacctgagactgggtaatttatagaggaaagaggtttaattgactcacggttccatatggctggggaggcctcaggaaacttaacaatcatggcggaaggctaaggagaagcaagcttggaccttctcacatggtggcaggagagagaagtgtggagcaatgggagaagagccccttataaaaccgtcaaatctcatgagaactcactcactatcctgagaacagcacgggggaaacaacctgcggtgatccaattacctcccactgcgttcctcccatgacacacagggattatggggattaacaatccaagatgagatttgggaggggacacagccaaaccatgtcatcctccctgggtcttcacatggcctcttctattgacaccaggcattggatttaatgcttaccctaatctgatatgacctcttcttaactaattacatcttcagggcctctatttccaaataaggtctcttttgaggttctgggtgaacatagattttggaaggactctattcacttggtatggatcctttaaagattaaaagagataacacaagtgaagtagtcagcagaatgcttgacgcacggtaagtactcaataagtggtatttattgctgttgctgatgttattgttgcttgtaccattcatagaatcctttccaggtggctgtactattaacatctagtgttcgtaacaattctgttcgttcatttagtcgcagatgtttatatgcccagcaatctgctagactgggggatgcagaaatgaaaggcctggccttttgttttcagggagttcacaatctggggaggaggcagacacacacgaacagcctgtgctgagatcctcaggaggggagggtggccgtgcccagataggatgggaggaagatgctctgggggaggcctcctggacagatcaggaggattctcagaggcttttgagctgaaacttgagggtgagttaggattccccccatacaaatggggtacagcagtgtatgggagagcggcagagagtaagagagcacctatttgttcactcagtggccatgtggggcctcaacttcgaagcaaattccgtcctgtctgccaggggtgaggaggtggtgcagaaacaaactatcaagatgtggaccctgttcttggaactggatggacaggaacctgctgtagggagcacagcccctctggagaccaacactgtgaagggaagttgctcccttgccgggggtacagggaaggaaggcctaggatggggaagggaccacagcaggcctgcgggagtaggaaggaggccagggcgaatccccaggaggcgtgtggtcctgggacagcccacctgactctgatcttccccatcacttagtctgggacctggaagctggcagcagcttaggttagttagctgttagctgtggctgttgaaaggatgacaactctgtgatccacctgtgtgacactgaagaagtcactcaacctctctgtggctccctgtcctcatctgcaaaatggaaatgatgatagaatcactgtgagggttcagtgaattaatacgtgtctagcccatagaacagtgcttgccacagtaaacactgcttacaagtttgctcgtgttgttatctaagcaaaattcccaatcaaagggctttgaaaatgagctggcaatgactctttgtcggtgctctctcagttgtacttgatgcctttagacacaggaggcagagaagatggcacaggcctggaagcggttgagctggatgacatccacacgcaggtgtcctgtctgagcctgtgccctgtgtcggtgaccagtcaactggcatatcctgaatggaacacagccctgggcaacttaacaaggggctagagggcataagtttcaaaactctttttggggatatttataagagacacttgcattggttaaaaaaaataataattgtaaagtgaccagagctacaaattattgatcttctctgttcctttcctgcctagggcacatttcttgatcctttttaagccaaggggagatgtacttgctttgcctattgaggcccttcctaccacccaggctctgatggctcaggtgccttccctatggatggcctggggaaatgggcaggtatgtggagctagcatgcttgaaagaaagggggtgggggaagatgacggcaaggctgacgtcagggcccagtgtgccagtgcagaagcagggaggccccatccctggctggaaatttactgcagctcagagaacaggcctgtgttcctccaaataaggcagaaattttcctgcattgctagttgtacaaacacagggaggcactgagcagtggcaggtggcacttggagattttctgaatttcaggcattgggtcagcccgtaaaggcttccctggggtatggtggacttggtcagtgactggttggctggaagtctctctcctgggtggttacctggtatataatgaataaaatatagcactggacaacttaacagggaatgggaggcgaaggccagtgagtttcacagccattttcaggggatatttacaagggacccttaccttggttaaagaaaaatgtaatgtgaccagagctacgtatttctgatttttcgcctccatcttggtatccaatgaatcacagctaatatgagctctgactgtatgaaaggggttttcttagttgaccactcagctgagagagctaccaaatcagaattccacaggagaggatggttgggttcctcagctattttggaggatgacataaaatgttgcagagggagaacccttctctgcaatcagacgagattttcctcattgttctgcagggcctcacatgttaccaatgaaagccagctccctggtgccacgcgttttactcattgctggatccctagggcctagcacagtgcctggaacatgcacgtgcctctgggcatattcagtgaatgaatgaacaagggaatggaggtgggtgaaggtggactgctagggaaaccgggaacatatgaaggcagcacgaaatcgtgtgtgttggggtgaaaatggacgactggagtctcagcttattgaattgtgggtaatgttcattcaactagtcagtcaaaggatattttgggaaacttcttataccagatacatttcttgccttcatggagtcctcagtctaggggaggggggaaggcagacactgaatgaccagctacatgattaattacttatgtacatttgtggtgggcacttcagaggaaaggtgcaggggtgagaaagtggcatttacatggagatctgaaggaaggttgagggtgagatagtgatatggtttggatctgtgtccccgcccaaatcacatgttcagttgtaatccccagtgttggagagggggcctggtgggaggtgatttgatcatgggggcagattcccccttggtgctattttcgtgatagtgagtgagttctcatgagatctggttgtttataagtatgtgacatctccaccccgcttcctcctgccccggccatgtgaaatgcctgttcctgctgtgccttctgccatgattgtaagttccctgaggcctccccaaaagctgatgctgccatgcttcctgtacagcctgtggaaccgtgagccaattaaacctcttttctctatgaattacccagtctcagctattttttatggcagtgcaagaatggactaatatggctagtaaggaggaaacacatactgggcatcaggatataatcattcattcattcactcattcagcaaataattactgagcagctaccatctgtcagccgcattccaagtcctgagaagattcaacaatgagcaaaataaagtccttgctctcaatgagcttaaaacaaagcgtaaagtttgtgcgtcttttgttagatttattcccaaagagtggatgtttttgatgctatactaaatcattttttttttccttggcatactaaaaattttgttatttattctatggctgccaatacggagaaatgcaattcttttgtgtgtgtgggccttgtacccagcatccttgctaaatttatttacccagtctaatagcttatctgcagtactctgggtattttctacatatacaatcatgccatctgcaaataatgaaagttttattcagtcctttctgatctttatgctttgatttctttttcttgctttattacactgagtaggctctcccacccagtatcaagtagacgtggtaaggtgattgtaggcattcttgtcttgctcttgatctcaaaaggaaaactttcaataattcacctttaattacgatacttgctgtaaagttttagtatgtattctttatcagattgaggaagttctcttctatccagcttttctcagagtttttgttttttattgcaaatgaagattgttatctgttccgtatgaatgaaaatgttttctgattgaaatagaagagatcacagtcatcgaatcagttggccatatgctatgtatctgaggctgtaataatccactctaggaaagacatctggctggtgggtgtgattgatcagggttgctactcagttgaacttaccatagtcgataggcatctttcaggatccatctggtttctgcagggtctacgttggtgaattaaagacatgatgaggaccactcccctgcttcctttagatccttaagggtggctgtcatctccactatccccctgggctgtgctgtgtgtgtttttttttttttttttttttttttgctatcttagccagcatggtgagagggataatttcagagacttttgcttgccttttccctcatgtacctcacagaccaagggcccaatgtggggctgtaccaactgtcaagaaggctaatcccagttacacattcaagaagaggaaatgaccatcagttgggcccatgggctcagtggatccattgtaatgagactttgggcaggactccatttatgatcaggctcctaatccaacagggggcctacaatgacacctggggtctctgagtctcagatcaacttggactctgtgccaaaccatcctcaaaatacttgggtctttcccaatgcatagttacccaaataaatggcagtaagccccttggtgaaggaatgggggaatgagctcattgcatgtacttgctgcggaattgcagggtcctttctcttgggcacctgcccatctctttttccaacaagttgcaggtctaaaaactgacttgggtccagagattggtaagggattgtgaatttttatggaagtgactgtcatcagcctcccaggcatccaactttgatttcttctactcaacaaggccgttggctgccactctgaccttgctgctcattttggtagttgtggctcctgacttctgatggttaagcactagcctttaccgttttggggtcctattgcaccattgctatcagcaagtcaggttctctgtcagcctctccttctgtcagccctccatccctggccagcagaggggagccactgctgaacttctcagtgatgcttggccctctcactggcacaatccttatgaccctggagaacagtgtgctgtttggtctttcctgtggaacatgctcatccccaggtattctgggcatacatggtagatccattgtagcatgcccaagctcctaggccctttaatcccttcttctgcaagctgtcagggcttttctgacatttcagcatctctttttgcatattttaggagccatcccagtagagagttcacaccatccccagggatccctaccatggtgttggacatcaggagagtacctcttctctatccaattttttggtcaggcccacttgaccaggcttcctcagagtccatccccctttatcctccctccttcctggtagcacatgttggctagaacttgcacctccttctcctttcttatcaggcccagcacctcccctgctgggttacaccaccacgtaaccctaggcccaatagttagtagggaaattgggaacatatcttgagtcgaggcaccagttaccttgcaggagagagacctctgcactgttttctagagcaggggtttgctagctctagtaggggaggggtggatgcttctgcaggcctggaagatttggaagagtctgaagaagtcaaattatttgggggcatttgcacagatgtccctatcccctgtgtgggggttatcaattttttgagcccggtgtctgactctggcataacaaacctgcgttggttgcctgtctaacctgctttgcatctctgctacttgatcggttagatcctaggcttggtcttgggctttgtcggccccacaatcgaaggctccctggctttctcatttggtttccaattgcacattaattgggctgtttctgatctttctgtaaagcggaggtcagtgaacattttctcaaagggagagatggtaaatgttttaggcttactagccatatgatctctgttgcagctactctgtctttgtagaaggcagccagaaatggtatgtaaatgaatgcgtgtggctatgttctaataaaactttatttataaaaacagatggccactatgggcaactgtggcaatagccatccaatcccatcatcccaacaagaattctcagacactgctggtggggatgtaaaatgctcaagccactttctgtttctttttgagtcacacttggttgtttgcatttttctaataatttgtccatttctcctaagttttcaaatgagttggcataaagatgtttataacattgccttatcttcttagtctctgtttcatctgtacttatgtgtctgttttgttactaatattgtttaattgtacctttcttcttcttcccttaataagaattaccagagatttgtcaatatcagacttttcaaagaatcagctttgacttcattgatcccttctcttgtatgcttgttttccatgtcataaatttcagctcctctcctttcctttcctttcctccctcttctctttctttccctcccctcccctccccttcctccgttcctccctttccccttcccttttcccttccccttcccttccctccctccctccttctttccttctactttttgtgtgttgattcaatttttcccatgtgtctattgttttattttgttctatttcttaagttattgttttttactcctttttttaaaaaattaaccttaaagtatataacttttttcctcaaagtactactttagatgcatctagaagtttgggtcagtagcaccactgtcacttaattcaatatattttccaatttttacttttatttcttctaagatttatggctttcttgaagtatttcaaagtttccaaatatatggggaggaggagatttccattatatcctgtttagaaaaatcttcctccagatatccatgtggcttgctcccccatggccttcaggtctttgctccgagtttaccttctcaggaaggaaatccaaaccacccaatttaaaattgtaaaattgtgcttccttagtactccctacccctagcctgggatgattctatttcctttattcttctttttttttttttttttttttttttatctttttgagatgaagtctcactctactacccaggctggagtgtagtggcacgatctccgctcactgcagcctccacttcccaggttcaaacaattctcctgcctcagcctcctgagtcggtgggatcctattttctgtttgttatttcccctgctactaaaacactagaacgacctctctagaacatacattcctttgaaggcagagatgattgtcttcttttgttcaccgttgtagccttaatgcacaaagcactgtctggcacttagtagatcttgaataagtaactgttgaatgaaggaaggacacatttattaaaaatttccatccaattgccctgtggtcgtgctttgtgaaatatagtttctctcaaatttgatgagacttgatttatggtccaaaatgtgttccatgtatgcttgaaaaggatgtatgttctgtggtgcaatgccctatatgtttggtcagatttattaattgtgttattcaaatcttttctattcttctccttttgtctatttgatctaccaagcactaagacatgtatattaaaattttcccattatgatgatgtatctgcccatttcttcttgaatttctgcttctgctctatgttgctttaaagattttaaggctatattgttgggtgtacacaagttcagagttgtaacttcctcttgaatatttcatcaatatggtgatcctctttatctctagtaatgcttttggccttgaaatctattttatctgctttcttttgcttagtatttgatctctctctttccattgttttattttaaacatttcatttccttgtgttttcactattccaggtttaaatagcatatataaagattcttaaaaaaaatccaggctagtaatcttctattttgagaattgaatgtatgtactttggctgtaattattgatttgtttgaatttattttttccatatagcactttccatttgttgtgtttttgtttgttttgcatgtgatcttttttctttccttctttcgccatgttttcaattgagttttgtgtttttcccttttccattttaaaatgtctgtgctcatcctggccaacatggtgaaaccccatctctactaaaaatacaaaaattagccaggcgtggtggcaggtgcctataatcccagctactaggaggctgaggcaggagaatcacttgaacctgggaggtggaggttgcagtgacccgagatcgcgccactgcactccagcctgggtgacagagggagactccatctcaaaaaaaaaaaaaaaagtctgtgcttagaagatatcctttatttctatttttcaatggttaccttagaaattccaacatagatatggtaccttaacagggcctaaggttaatctacagtttgaccatccttttgaacaatccatgaccaacccccacccaggccttcctcactctactaatgtgttctttctgtgaagacgttgattatatcttgattttctatacccctccaaaatagacatcattatcattatcattttacacaattaatatttccattcttcccttcaacagatacttattcaacattaaattccacgcactgttctaggaacataggaaacacaaggaacagagaaggcacaggtccccaccctcatggacttgacattctagctggggtgacagattctaaacaataaacatccacgaggaaatgatagaagatatcagaaggggtcatgactgggagaaaaaggtagaacaagatagggaggctgggaatgcaaatggcagttttctgtggagtgctcaggggcggccttgaatggaggctggagggtgccaggaagaagccatgtctgcctgggaggggaaacactgaggtggagggacagccagtacagagttttaaactggagcatgctgagcacgttcaaagacagcaaggaagccagcgtggcagggccagctaggatgctaatgtagtaacccagaagagaggtggtgatgacttgctccagggtgtagccaggtggatggggagaaaggggtcttggacttggcacagatttcctaatggaacagagatggggtagagtcaagcttttttctgcatgtttttgtcttgagcacctagaagaatagagtgggcagtaactgagatgaggaagctataagagaagcagttttggaggaagcatgggagatctgctgtggacatactgcatttgagatgcctcaaaaattcagaggggccactggacccccaagtctggcatttcaagggcagatccaggtttggtttgttgttggtgggtttttttgtttgtttgtttgtttgttttatgaggcagagtctcgctctgttgcccaggctggagggcagtggtgtaatcttggctcattgcaaccgctgcctcccaggttcaagtgattctcatgcctcagcctcccaagtagctgggactacaggcgtgcgccaccatgcctggctaatttttgtatttttagtagagacagtgtttcatcacgttggccagactggtcttgaactcatgagctcaagtgatccgcctgcctcagcctcccaaactgttgggattacagacgtgagccactgcacctggccgacagatccaggttttgtggaccttaagcttatacaattttgagagccttctttaaggaacaaaacataaaattacataaaaaccaaatacaagggagggccagaaactttagctccactagctctgcagagagctgccttacagcagttgaggagaaaagcaaagctggagagataaatgtgtacgtcatcagcagggaagtggtacttctagttgagagattgaattctgtccccctcaaaagacatatgcaagtcctaagtcccagcacctgtgaatgtgacctcatttaaaaataaggtctttgtagatataatcaagttaaagtgaggtcagactaaagtgagctgtaaatccagtatgactggtatccttaaaggaagagggaaatttggacacagatacacagaggaaaaaacgtgaagtgatgaaggcagagagtggaatgatgcaactcaagccaaggaatgccaagtgttgccagcaagcacctgaaacgagataagaaaagattctccctcacagccttcagagagaacatggccctgccagcaccttgatttcagacttaagacttccagaactgtgagagaatatgtttctgttgctgtcatcacccaagtttgtggcactttgttatggcagccccaagaaactaatacaatgagggagtgagtaggaaagaacatcagaatcagccctgaggcttgtcagggacataggaggtccaggaaagcaggtagagaagatatgaccatgaggtaggaaggacccctcaggagaagtgcactgtgacagccaagcgaacaaaaaaggatgaagaaggaggaggtgatatgctgtcttcaggtcacattcaaagagccctgagaactggccattgattcagcaatgaggaggtttttgacaaaagtagttaagtggataggcgggggggaaagtctgttggagttgatttaaaagagaccaggaggaggccgggcgcagtggctcacgcttgtaatcccagcactttgggaggccgaggcaggcggatcacgaggtcaggagatcgagaccacggtgaaaccctgtctctactaaaaatacaaaaaaaattagccaggcttggtggtgggcgcctgtagtcccagctacttggagaggctgaggcaggagaatggcatgaacccgggagacggagcttgcagtgagccgagatcacgccactgcactccagcctgggcaacagagtgagactccatctcaaaaaaaaaaaaaaaaaaagaaaaaagaccaggaggaaagaaatgggagacaagtaagtaaagatgtctgtttttagggataactgcaaggaaagcaaaggaataaggtggtagtgttggagacatgaggagaaggtttttttaagattgaagaaatagcagcatgtttccctgcaggttggaatgatctggtagggagtggaatattgataatattaggatacagcaggcaggaatactgctggaggaatgtccttgattaggtaagaaggagcacagctcatgcatgggaggagggactgtttatgttttctctccattccaccactttatttctcatcattttttcttacatctcagaccttccttctgggatcatttttcttctccctgaagtatattcttgagaagcttcctttctggagtcttgttgaaagtgaactctcaggttttgttttgttattgaaaatatcttcattttattctcattatttcaagattgttttgctgaatatacagtttcaggttgacagttctgtttgtttgtttttttttccctcccagcacttgaaaatattagtccagtgtctcttgagacttattgttacaattgagaaatcagtcgtcattctaattgtcatttctctttgactcctgttgaggttgtctctctagctttgtgttccacattttcactgtgatgtactaggtgagggtttgtttttgcttttcctgactgggattcactgggcttccttctcgaatttggtggctggctgtctttcagaagctctaaaaattctcagacaggtcgggatgatggctcacacctgtaatcccagcactttgggaggctgaggcaggcggattgagctcaggagtttgagaccagcctgggaaacatggcaaaatgccttcttacaagcaaaaaaaaattcttttgctcctgtagtggttatgctcctgtagtcccagctacttgggaggctgaagtgggaggatggcttgagcccaggaggcagaagttgcagtgagctgagatcctgtcactgcactccagcctgggagacagagccagaccctgtctcaataaataaataaataataaaaaatagaaattatcagacaaactcagttatcaccactgccctgtttttctctccttcttgaagtcagatcatttgtattgtactctgctttctgcatctttacctctattttatatgtttcaacattttctctctgtattggcttccttagtaatatctttttatttgtcttttaactcatcaattctctctttgactatctagtattttctttacactgagttttaaattttagttattgtattttttatctctagaagttctatttaccttttccccccaaatctgccttgttggtttggagattctcttgttcccttatcatactttcattttcctcctttcttgctttaaacagattaaacaaactaattttatattatgtttttgataattccaatatctgagtcttggcagatctgattcttaacttttcttctttgtgctggttctcacatatggagaattgagtcctcatgtgcttggttatttttaccttatgaccttgcactccaaaagctgcaccagagacaaaatcaaaatgccttaactccacttaatgcatcttcatccttcctaaatctgcccttaaaaatccaaagagtgtgattatcttcactttactgtaggtcatagaagtgttaagtcaaagaagttgaagtaacatcttgaaaaaaaaaatcccaagctctaaattaataacttaatgtaacttctaattatgttggagttacaaaatttctttccctggatgaacacaaactatgactaaatgttttctaaacaattaaatttaatattttgaccaattaagatgttgcaggtgtgttcaaaattaattattatttttcttaatttaagacgtttttcattagtggaaagaaattccaaaatttgacaccaagcttagaaccaagagattctaaaattcttttaaaattttgccaatttatgtcaaattgtctcacctatgaccaaaaatgctttgctctcaggctttgtttttctgaaaactcttttttatgtttctcccgtggctaatctctctagaatctgagacctgacagctgaagggacttagaggtccatttctccctgaaagctgaccacagaccattcagaaaaagtgatttccaataaataccctacgtgtgtgatggtattgagatgagggaggtagattgttcaattacagaagcgataccccatctcttctatgtgtaaccccaaattcattgctactgaggttctataatgctaaggcttgcaaaactatcacttttacagataatgaaatgaaatcccatttaatgatgattatcccaacacaaagagggtttttccttttttattattatgaaaatacgcaactggcaaaaatacacatgatacaaaaagatatgcagtaagaaggctctctctcccacagaccctccaggcccatgctcatgggtaacaacggccacagatagatttccaggctgttcttggggcacctcagccctctgcttctttcttccccaacactttctctcgggcttctaggcaggcagcagacatggagataggactggtggtcgtgatgcttaaccttgagccattactaccaggaagggagggagagaaacttgggtgtactgagtgccaactgttaccaggctgaaatccaggctctgcacgtgagatctctactccacagagcaacttacagaggtgggaatatagtatggtgaaataacagagggtccaagacaccagatggccagcccccagcacaggcttgtaatagtcgcaggacccggattcagcccgctcttgtttggaccacgcggcaggaagaggcctgacggtgcagctgctgctggggaagagacacgtttgtcgtgcctttcctacccggagctcccctagcatcctcctccttggctgggaaatggagtgtacgcccccttctgaggattcttctggacccaaatgtgagttgaggccagagatgaggaaccaggagcacccacatgtaccatgggtgaaccccaacaggattggggcatttcacctcattgaatcaaatcattcattgcacatttgagttgaccccagtctcggatatctgaattctagataaagacattacccaggacatgtgaacatgtactggaaaatatcaggcaatggttcaatcacaactgtttatactaactggctgttaagttataagagaaaaaagtattaaatgccaacatggttttctgtgttgattctctctttgatgcagggaatggatatgacagtgaagcctggcccgcaggagctgtgtgcatcctatcagccagatactgggggaagcaggcagggctggcctcatagtcacaccaccagagtcaggctgcggccacatcgtagggctttgggaggctggggctgtgtttggttcatggggttagagtcgggtacagtggctcatgcctgtaatcagcactttgggaggccgaggcgggtggatcacctgaggtcaggagttcaagagcagcctggccaacatggcaaaaccccgtctctactaaaaatacaaaaattagctgggagtgatggcaggcacctgtaatcccagctactcggaggctgaggtaggagaattgcttgaacctgagaggcagaggttgtggtgagccaagatcatgccattgcactccagtctgggcaacaaagcgagactccaccaaaaaacaaaacaaaacaaaacacctcagtgaggtcccccatgccagactttcagaggagagcgagcctatggggccatcatcggtttggccaggtacccctgagggcagcagcagccctcatgcgggtctcaggacccctttatacgcttaaaaatgaatgaggatctcacaaagctccatccttattgcattcttttgattatgtgggttacatctcctaatattcactgtatttgcattaaaactgaggaaaattaaaacaagagaatacacaagcactgcacattccatgagctgccagaccatcagcatcatcacatccagtggcgtctggaaaatgctgcagcacacacaaggcacatcacatgctagcattattatgagcagggtctagaaccccctggccatgctttgagaacctctgcccttggcaccccctagagagctgaccgtggtcagaaccatgtgctcagcaagacaggtaacctcatgcctgggtcagcagttcctcttggttttctacctctttgaccttctcaactgcaatggatggggacatggggaaggtggccattgagggctgctgactctgggtaacttacatgtccctcgtccttcttattctgctttggatgatcccacagagctcttttgaggtctttgtattttgacagcaggaggcccatgacaaactatttgggattcaagacttagacgcctctccccaacccgtttgtgcagaaagattggcttcccccacaacataaatgtccacactgaaaccctgtaactccatccttattacacggttccagggagactctgggatcatgcttcacagttgatgtttgtgcaccaaatggaaatgcagcaagagtgcaccaggtctggagaggggctgctggtgtggggcctctgagggggccccgatctgccagtcactctgagttccctgtcaggagactcataaagaaggccagcgaggactgggaacacatgtttattttatgaatgacttcggggaaagaggagaaaaaaaatcctccagaatgtcatccaggaggctgtgttctttttattatgttttgtcggtaaacaaaaaaaatggccacatttaatacttataccagtcctgtgggatttctctgactaatgtaaaatgacagttgtcacaacattctatataaatacaagtctgtttgcaggagccttttctatttttaatgtaaaccacacctaactcgctctgaagaattgtacccttggaatttagagtcctgtctgttgtctattcacgggactgtattgtcttaggagcagcccggaagaaaccaaagacatccagaactttttagtttaacgtgagaattattcacctaattttcccgcagccattgtgttacttaatttattgttgtgtggagctgtatggtgatgtcgctaatgagcgacacagtgtacttggtgagccaatccataatttaggaggctgctgatgatctttgtgctgtctgcaggctgagcaaagcaggcagtaaaaataaagaatatacttacagtttatagaaatgagcacacacccgcagatacacacacacacacacaatacccattactaggcttgcaacccccatggttgcacgaagcgtgagcttgtgtgctgagaggtgcagggaaagctgaccgtaggcttgataagttcacagtggactcatggccactctgttgtggactgtcacactatggagagttggtggaagaagttggcttccatgagagggggcaagtgtgaagccctttatggtctgtttccttgcattcctcagccatttattgctgcacccactccagcgggcatgagcaacagaatcctctttagtcctagtggcaggtcacccagtgactggcattcaggagctaaactgattgatggtaaacttgatgatgtcgcccttctctgcagtttttggacagggatagcaaacatgtcagaggatgactctcaggtgattatgagcttccctgtcgaggttgggctctgcaagctttggcaattgacatgagttgaacctagttgtcattcctgccggtgagggagagacccgcaggggagtcggatctgacacgggaccccacgctgcagagtgatgatcgcataggcacgccttcctgcaaggtcacaggtggaacaggtggagagaacacaccgttctctctgctgtgaaattccctttgcactgggagatttcccggcagaggtcctacatttcggcagtgagaaatgtcaggggctcctgccatgcgcagccaaggcattggatcttcatattggatccaggaagacaactttgtgaaaggaaaaggctgaggggcttaaatgctgctgtcgtcccagcttctagggaggctggggttacagcctccgccatgttgcagattctccaataagcatcccggtgatctgtgtgccttgcaggggcgtggagcctggtgtatttacataccacggactaggtttaaaaatcaactttagatttgctttgccgtttgcagtctcttgaataaagcatttttgtagcctcctcaaaatcctctctctgtgtttacattttaatgggcattccagtgaaatggaggaatttttttttattacttacatttatcaaggaaagaggtggggttggaaactgccaagcagcagggccgcctctctttagactcctggggctctctgctctccagcctgatgtgggcaaattgtgtcacgtagccaggcaagtgggaaggagaggaaaggccattttaatctggcttttaaatatacatccctgagaatttacagaattttaaaatagtactttagatctcaaacatcgctgaaagaaatgaacacgtgtaagaagaatattaaattgcactggtctacgtggaaagtaaagtctgtcacatgtaatgaggtatcattccagaattgtccttttggaaaagaaagggggaaaaaaatcactctccctgccagggcagaggagcccttgactagttcttcatcacaaatactcttggaaggagggtcctaaggtgacctctccattccttggcaacattttcgggacagttttggtttctgtggctgcgtaaggggaaacccctcttggatcttgggcacagaagccacctcctggaggcagtcagttcttttggatgcggaaacggaatttctgcttaccctagcatgtagctaatattaagatcttcttgtgcaaagggctcccctatcacagttgaacatacagtgtcataaaactgggccaaggcagcttccggggctttgcatgtgtggaactgccagtgttttcatctcccccgggggatgtctctcttgttcctcccctgacattcccaggagatccctaattaaagctacagatacggtttaaaaatatactcaccagatgttagtttaaaatgacctataactggcagcagagatggaagaggctgacggtgtctgaggccttccggtcgccttttcctaggctgtcattcggtatgcaaatgaagcccagcagaatctgagagccagctctgccaagccataaaaccaactgttttgaaagcaatgcatcagtaattcttatcacctggcatctggagtgcgggaaagctcccttcctaactagaacatgtcatagcatgacttaggaggaagctctcattttgcactccgcggacaatttaaactgatgaatctgcttgctgaagctcatacagatccctttaggacaaaccattttttaaaccaaatccaggctctgagacacccctgctatgactttactggacctatatactacggagaagagggcttgtttggcagcacagcttttgtgtgtgtgtgtgtggggggggggggggggggtgggggtggggggtgtcagaccccgaggctacccttctggggttttgtttagattcttctgtgcaagttcccaccaagttttcagtgagttagactttcagggtaatcccggtttgccttgcaaagctgaggaaatgaggaatgtcatgggtatcaatatctttcctgagaactgaaatttaccagtagcacattcctatcgggcatttatcaaaacaaacatataggtcaaatgaccgtttactcagcagccacctgtcagtgccttgggacgtcagcagtcccggggatgcccgtcaaagcagctgagtgatctcggccctgaacattgccaacttcccgcctgatgccctggagctgaggctccagcttgaggcttcccagtgctttggataaaaagatgggtctgcacctgagagccatatacatctcgctctggggagaaaacccaggcagggctttcacacagaggaagagtgaggccaggatttatactcagagaggatgggcaaatagcattcacgcgtgtgtcctccagggtggaatctgccaggctgacttacagtgcaggaattttgccagtcagtggaggtagatgtgtttatagataacgttaaaaaaaaaaaaaaaggcaaaaaccaagacctctgcaaccttggtatttgaaacacagaacacgggtttgtgtactaagtaaaatgtggttaaataagattaatctattgatggtggggaagagagcctgtaaggcagattgggtgtctcagaggcataattatttatcaaactaattaaaatgtaaccaccggctcatcgactctggaaaccggctttcctgcccaagaagcagccctctcctgagcacctgtgattttatttttcattcattatcccactgaaacacaaaacaaagacccaaattggccacctggagtggccgctctcaccctctgcctggccatggcctgcctggactgggtgttggggagggatgcatggggacagtgttgttcacagtgtgggtgagtgagtgagcccacctggtcccccatgaagccctgagatgccaggagctctactggctgtggcctggggctgtgtgatggagagcacgtgtgttcatcagcgcccagaggcctgggctattcagttgggccatctctgcagcccagagctgcctggtagggctttgccatggattcctggcttggaggagtcatgattagcatgaacttgcaaacccagaccaggcgaattgacttgggggtgatgagatgcaccagctggtggaagcagcttctctctggccatccttccagaacggagcaagtttcctggcccatagtccctgcttccatgaccaccctggcctctcaggagcatgtacgtgtgattgcaggggtgggcagggagaggacacttagcagagggaagaggcacagggcttgttacataaatgacttgggactgttgagcaggtgcagagaggtctgttgagaaatgaaaggcagagagcctagcccagcaaggccagggcgaggaacctggcaggaggccttgactccttgatcgcatttctctgtttcacgtcccgaggtgggcagggggctgggaacctcccctgcagagctaaccactgggcctccttcacagagctctctcggggccagcaacagggagaaggccatggcccttctatcttcctcactcctgtcctttggagtccccacatgtgtgccaaggaactcaaggccagcggccccctccctatcttcctctggatcatagctcctaggtcccatccaggaagaaagaaaatgaggtggcaggtccagaagcctttttgcttttctgttgatttatgtccctgaggcctctgagcaataactaatacatgacttgaatacgatccctagtgatctgacctctctgggggagttgcttaggcagattacggcagatgattgagcagaatgttggtgagtccgtagtggcctggtggttctaggaggcctggcttagagccagtccatcaatacctatcaccttgtgagggggacggggactaaggacctgtgtccacccgactgccacatcgtcctcttcctttgaggggaggtaagcaccccttgcgaggttaggagagggcgtgtctgataggcattgcagtggttcatttcatctgtcaatttgacccggccgtggtacccagatgtcggtcaaacaccagtcccgatgtctctgtgaaggtattttgtaaatgtgatgaacatttaaatcagcagactttgagggaagtggttgaccctccgtaatgtgcatggtgggcctcatccaatcacagtgtgggccgtgggctcatccaatcacagtgtgggccgtgggctgcatccaatcacagtgtgggcagtgggcctcatccaatcacagtgtgggcagtgggcctcatccaatcacaatgtgggcggtgggcctcatccaatcacaatgtgggcggtgggcctcatccaatcacaatgtgggcggtgggcctcatccagtcacaatgtgggtgatgggcctcatccaatcagggaaaggccttgagagcagaccgaggtttccctaagaaaaaggagttctgcctccaggctgcaacctagaagcgctgcctgagtttccagcctgttgcctagtggaatttggactcaagattacagcatcaactcttacccgaatttccagcccgcttgtccgcccaacaaatttgggatttgtcagtccccacaatagatcgtgtgagccaattccttagaaataaacatgtatatatatatgtattatatgtgtatatatactatatatagctacataacatatatacatatatacatatatgtacatatatattatatacacacaataggactacatatatattgtcctattggttcttttttgctggggaaccctgactcttacagagatggaggtgccacttcctcctccagattttggggcttctgctcttgacacctcagtctccctcctgctttggtactcacccagcacccagtcccgttaggtcccagaaagaaggatgcagaagaagagagtgcacccccttccacagaaacaagtgtacaccaatgacaatgccacctatagagtcatgccaggtaacaagggatgaaggctactcatgtagggccgggacacggctggcacaaagggattggcctagttctggagggtttggagccgtctgcctttgagtacagactgtgcaccaggagcatcgctgagcttttccataaagcccaccatgtacgcaggaatggactccttgtgtcaatgcatcatcaattcatgtattcaaatattgattgagcacctgccatgtccctgatgctcttccaagtgttggagatagtgaacaagacaaagccctgccctcatggagtgcacatgggaaaggcattcagtcaagaactgaaacatcagcgattttcaagttggtgtgtgtgccacgagaaagaaaaaaagtaggataaggtgatgaaactacagtggggaaggtgcctgtgcagcgtagatggacttaacgccaccaaaacatgcacttaacggtggttaaaatggtgaattttatgtgatgtctattggactagtccgttctcacactgctataaagaaatacctgaaactgggtaatctataacgaaaagaggtttaattggctcacagttccgcaggctgtacaggaagcatggctggagaggcctcaggaaacttttaattatggtggaagaggaagcaggtatgtcttacatgcctggagcaggaggatgagagagaacagggaggcgctacacacttttaaacaactggatgtggtgagaactcactcctatgacgagaccagcgagggggaactccgccccctcccaccaggcccctcttccaacattggggattacaatttgacatgagatttgttcagggacacagacccaaaccatactgtgtatttcaaaaagtaagtttacaatgttctgaaatgtatcatggtggtgattgtgcaactccgtgaatatactaaagccactccattgtatgctccaaatggaagaattgtacggaatgtgaactccatctcaataaagctgtttaaagaacaaaagacaaagctaggtgagtgtggagtatttcagatacagcagtcagggaagccctctccaaggagggacatttggtcagaattattgtcatcatttttcagatgagtgtcagagaggatgagtgacttgcccagagtggcaggtctaagacgcacacccaggcatgtctccttctaagcccttcctgccctgcttggccattctgagtttttttcctctcttctcaaagcacgttcatgctgatctcactctgttttgtttgtttgtttgttggttgtttttttgtttttgtttttgtttttgagaaagagttcttgctgtgtcacccaggctggagtgcagtggcgcaatctcagctcacctccacctcccaggttcaagcaattctcctgcctcagcctcccaagtagctgggattacaggtgtgcaccaccatgcccggctaatttttgtaattttagtagagacagggttttgttatgttggccaggctggtctcaaactcctgacctcaagtgattcacccacctcagcctctctgagtgctgggattacaggcataaaccactgcacccagctgatcatctcactctcttctaggcatcttgattttctatcttgtctccagcagacatagtgggaaacagacattcagaacctgacccagggtcccatagccaatgatagggccccaaacaacactctatcccaggaatcagcaaatttttttctgtaaagaaccagccagtaaatatcttgggctttgccagccatatggtctgtgttgcatcaactcaactttgctgttatggaacaaaagcacccatagacgatatgtaaacaaatggatgtggctgtgtgcccataaaactttatttgcaaatacaggcagcaggctgaatttggcccacagttatagtgtgccaattgttgttgtagcttgtcattttctcttctctggaaaaatgccctggagaaggtaagactggagggaggcttaattcttcctgcccccactagcctacccccgacttatgcttgtgtccaggaaaaggcatgtgaagtgcttcatgcagccagattccccagaggagcaatacgaagcaggacccctgtcagatgcagacatgtctctatggagagaccaagactaggggagggcccaggaagtagccctttcccaaatggttgctttctcctatgagcagctaatgtgctgcctgcctgcctgcctgcctccctccctcccttccttccttccatccttccatccttcctggcttccatccgtcacctatccatttatgcattaatttatctctctgaagatagatgaatccatctattcatgcattctttgcttcttccatccatctagccatgtatccttccacctgtgcatccatccatccatccatccatccatccatccatccatccatccatccatccatacactgtctcattcaaaaacatgacttcagagcctactctgcaccaaacaatgaattagaccacaagaattcagtggaggacaggacacagtttctgttctcaaggagttcacaccatgaacaaacccatacgtagtccacaaaccaaaggagtgaacgccatgataaaaatatggtattcataagcctaggctgtatatttatggaaggaagtagcctgggctggccagggtgcttttcatgatacaagaccttccttcttaggccatgccaagacacagccttgatggcactccatcacactgcctcaagacaccagctctctgaccacaaagggtctccgaggtggaacatttcctaaagggctgtgggcagcctgcaccctgagctctggctcatgtttgctgggcgtggagctgcctttcagctgtgcaaggcctccagcttccccatggctggaataggaaagagctccttcccaggcatgtggggaccatgctgaggagtgtctggtggttggcaggtgggggctgccatgaggaagagaagtggagccactgttctcttcccacccacagaagcaggtgaccagcctgtgcagcctgagaagaatgagacacccgccaggaggtggggcacagctgtcatcctgtccagtgaaacgaaaatatttccattctgtttgatatctaagagcaaacaaagtaggtgcgagattgtctctggtaaggaagaatatgccaagctctcttgttggggctctgaattgagctgtcacccagcctggagctggctcccctgcaaatgacgacgaaagcagccccagctggcatttgcccagccatggggtggtggtgaccccagccagcccgggcttcccatggctgccaccagcctaatgcctgcatgattgttctgccgtaaacatcatctgtgtgtgcgttatcttcagacagtctgggctcagcatcttggccagggtccagtgctttctctctccacagaactcaaaatcgtgactgtcttagtctccataggataaatgagaattaagtttcagaaggggctccaggagctggcctcctggggaggagggcaggccaggctgctcttcttcctcgcctcctcccccaccagggcccatcatgctggagggcagataacagtgaggagaatccttctgagtgtaagcacaccatggagtggggcctgctctggcctaggagctgtttgtgtgcaatacctcagggagtcttcatactgaccgtagaaggtaggtgccattatcactgtattttacaaatgcagaaactgaggcacacagcagtttcctcattgaaaataaatgggcatggtctcttttaagtctgcctcttgagggcaatatctgggagcggtcccaggtctcagatggcctagggtggagggcagggtgctgcacccacatgacctcagaagagctccaggctccacgacctgtccagaggcagcaaggtggatgcagagcccgggggtcccctgggcttcctggattgagaggcagtccccctccacccttttagcactgactcagctggcgattcctctcatggttccaggattgccctgatgagccatcatgggggcacagcagcaggattccagtcctttccctgctaaatggtttcctgtgtgggaattgaggctcaggttgtgcctggaggagtgagactgggactgaagcagggctagaggacccaggggtctgggatgggaagaaaccacccccatcatcatggcagggtgcccatggtggcccttgaagagtggtccccacatcttaaaatcctacaacacttagaatcctagaacatagggctggagccatgttagagagcaagtaatttgaccctaatattggaaataaggggagaatagggaagaaggaaatagaacagaagaccttgtctaagagacccaggaggtcattggagagctgtgaccagaaactcaggtagctgaagatggagccatcttgaggccgagggcctgagcactcccaggtctggctggccagtgggcaaactattcacctccccaactgttttctgcaacttcatgcctggccttcaagaggcattttccactttccctgggaccatcaatcagacacggaactccttgctcctattaaggcctgagacaagtgccctctgcaatcagtgggcaccagtcctacagagcatcacacagcgccagccctctctccttttctctgaccctacgcatggctaaaatattgtcctgtggataggaaatgaaaagggtacaaccttacttcttcaaagatcgcccagtctagcccagaggtataataaaaccccaaactttcctttcaggactcatctttcatgagtaatatctttccgtgttaagtggtaggcacacaatggtgaaataaaacacagggctcagcgactccgatggcttggggtgtgggaggggaaggttgcctttatggtgtgagtttcctgtgcctcagctctcctggattgtggggctcatggcacacgggtgattgatgacaacatcactctccatcattcaattcgggagatccctaccaggggcatcttggccacctccgaggccatattgggctggaacctccattatctgtgtagtcaggtgtttgcatttaaaacaaaggaggaattagagtaattagatgaattataatcttcagttcatgacacactattgttgttgtttactttagagtgtttgtttaaacattctaacaaggaatgcccatgacctgctggtcaatccaagaactaggacattaccaattaactgtgtctgccacgggctcttctctgtccctccccgaccttcccacctcccaaaggtcatcacaaccctgaatttgtgcttacatctccctcctattatttcagtcttatgacttataagtgcatccttaaatactaccttgtttactttttgcctgtttttgaactgtataaaaaatgttttgtcccttctgtggtcttctggggttggcttttgaaatttaacattgtgtctctaaatctcatttatgtggttgatgtgtagctagagttcatcaattttcgcagctgtgtaatattcccccgtgggtctctaccaccattcaccgaactcttctgcctttgggcattcagtggtttctagttttgtgttagaaacagcattgcccagaatagtcatctttgtgtctgtctcctaggagacagtgcttgctgggtggtccagttatctactgctgtgaaacaaaccatcccacacaaccacatcatgggtgttgctgtcgggctcagaggggtaactctgatttgttccaccacactcgggacctgagatgagatgattgagggctggacccttggagccggcctgaaggggcctgggcctctttctccctgtggaggctaagacctttgcatgtggtcttttcacctggtcttccctggcatagcagctcagggctcccagagtgagctttccagacacccagtggaagttacaggcttcttagagccaacccagaagctcagaatgtcagtcctaccacattctattgatgaagcaagtgaccaaggctggctggattagaaggcaggggaactggatttcacctctcagtaagaggcatagcaaatgtagttgtctttactggattccatgagactcatgaatattcatttttacaagttaactcaagttgttttccaaagtgatggccaatttatggacccatcagccatgcataagtgatttccagggtctccaccctctgcgcatgaggtcagacttcttaattgttgccagttgagtgaggatgaaagggtgtctgaccctggccctcaccagcatttccctgttcacgggtgagcagggcccctcttcctgcaattattggccatgtgtttctcctctttcctgctcaagtctttttttttttttctttgaggcagagtctcgctctgttgcccaggctggagtgcagtggcgtgatcttggctcactgcaagctctgcctcctgggttcatcccattctcctactcagcctccccagtagctgggaccacaggcgcctgccaccatgcccgcctaattttttttgtattttttttagtagagacggggtttcaccgtgttagccaggatggtctccatctcctgacctcgtgatcctcctgcctcggcctcccaaagtgctgggattacaggtgtgagccaccgcgcccagcctcctgctcaagtcttttgtccatttttctgtcaagttgtctctttcttcttgtaagaattctttatattttcttgataagaatccttcatcccttttatatgttgcaaatatcttgtatttttcagtttgtagcttttcagcttctttaagatgtcttgttgaatagttcttacttttaatacagtcagtgttctcaatatttcacagttagcacttcttagtcttgtttcagaaatccttccctatctcaaagtcaggaggatattcagcattattttcctaaaagctttaaagttttgatgttgacatttgaaatctggatctatctggagttgatttcatctgttgttgttaacccctttggggataaccagtgctgccaactcctttcccatgatcgcctgctgtctctgacacatcagccatggtgggcccatcctgatagcctttttgtttgtactttgaagactttcagagtgacttaggtgagatgatgttgtatccataggaagcttgtttgtaaaccccggggctcactttccacttctctgattctttggggtgccagtcctgggaataacaggctgctagagcccaaactcatgccagagtttgagtgcttacacccccatgccaggtggctgggaagattatgccccagttaacgacatcagggctgggcatgcagtcagggcttcatgcctgagagtcagcaggctgactttttaagaaatggccatagtcacttgggctaagctgctgccactgacctacctgcctttctgctcctaaatacatgagaagaatcccaccgcatctgtggaaatacagcaggagggagagctccaggactctgagaaatgtcaggactgctgaatctgaggaggtgttttggggtacagggaaaccctctgtaggagcctttctttggtattagccacagtaaatccctaaataccagagaagtccagggaccagcccagctggcagttgcatttgggaattaagctaaagaaaggctggttgcatcagttgggctcacttttagtgaagtcaatgtgtttatatggtttgaaagctcctggggtgagttagtccatcttaccaaggcctacagcatatcttcctggaagctatgaactgagaagagaaaaggacactggaatcatggattctggtccagaatccatgctgccttgctgtgtgaccttggacaggtttctctccctctctgatcctcaggttacttctctctagaatggaaggggtaatcagtgcctaggcagttcctcagattctcctctttctgattgtctctggatctgtgacgaaggcattcgatgactctgagctgcctcctgctgaggacgggggaactacagcaagaaaaggcccagaattagcctaaaatgtaaacagctgagagctttcttcttaactgggtgaaattttaaagatcataatacacctctacactggcctgcaagctcagcccataagacttccccccttagggatggtgtccatcattgagtcctgttttgaaaatcaaaagtatttttaaaatggaatttgcggggaagagggtagaagttaagtttgcgcctccagaagcagggtaggcttaatctaaggggactgtcattctcccagctccatggggcctggcaggaggcggccctctcagtgctctcggccctgaaggaggctgtttggttctgcccctcctcctgggtctgagggcaggtggcacccccagcagagaccagccccatttaccccaggaggttgggctccttccccctagtttcttgggtgccctcaggggccaggccttgcagctgagagcagagagtcccagctacactcaactgtcacagactgaagggcaaagtgcatctggcagccagcacggatgtgttgtcctctgactctgtagggtgacctgtcccatatgcctcagccgtttggggacagcctctgaaagagccaaatgttcctctccaaactccgtagcaatagatggtgaagagattctgagctatttatggtcaggagagatccggctgcctcatcccggtggcagcgtctgagtaacattcctcggtggggagagcggcggatggttctcagaaagaatcgaggctttgggcacacatcactggcctgtccccacttcgtctttccacaatgaggcccggactgttccatcgggaaggggcttctggactcatccctcattttctcaaaggagagccaagctccggagagggagtggcccaaggtcacagagtggtccggtgcccaggcagctccagagcccagccagtcgggcctctgccgtcacaccagccccagggtcacgggctttggctttgatttgtaaagatgttctctttcacaccagcccccaggtcacagcctttggttttgatttttgaagacgttctcctcgcttgcagggagctaagccttccttgggtcacttgtattggtttccatagcaaattaccacaaactgggtggcttaaaagcactgaaatgttttcttttcagttctagaggccagaagtctgaaatgaagatgtgggcaggtgggttccttctggaagctctaaggcagaatctgtcccgacccctcttcagctcctggtggctgccagcaatccaggacccccccggcttgcagctgcgtccctgcatcctccccagcctctgcctccatcctcacttggcagtgttcttccccgtggctctgtgtgcccttttccgcctctcctaaggaagctgccattggagtcaggcacgaccctaatgcactatatcatctccatccttaattccacccacaaagactgtatttccaaatcaggtcccattcataggctctgaggttaggatgtggacgtatgttttggggtgccataatttattcagcttaggaggacagtggtttgatacaccgtgtagaggactggacctcacagcaaggccgtgggacagaggcagctctggcgagggactgaccaggggctgtgctcactcgcagggcctctggtgtctctgcctccactctgcatgcctacctctctgtcttctcactgccccccagctttgtgttccctctggtgtcccctttctcttcgtcttgtggcctctggttctcacgccttgcctcaattcctcctggcccagcttcagcgttctggccttggtctcgacgacttcttggctgcagtttctgctgctgactgcctcattcccatgcccatgctgtttcccagttgggttcctgagcaaggaggtcgtgccagtcatgcctgtcttctcacatgggcacagatgacaccccgccaggccaaccttggattgatggtcctgggggtcgtggggcccactcgtggtccagacagcaggatggggctgtggtacgaagcataaccacctccacctggcccttggaaggtgcaggaacatggcagaaacagggtaaaggttcggccgcctacaaaggcgactgcgtggtccctgcaggagaacttccagggcgaggatccaactaagtggaattgtcaaattgtcagttaactgaagtatttccagtttgagaggagagagcaagagataataggaacctggagaaaaagcagccacagggggtgttcggcttcaatccaggtccgttcaccccttacgttcaaaacagcaaatttcaggaatgccacagtccgttaagcatcaaagagagatggggccacccacgttcactgtattacgaccctcattagacagaaaaggacgtctgtgattgaggaaagattttccaacgacatccctcagttgcccatcaaagttgcctacttctcatttcctcaccttctgggtcttcttcgggctctcctggagtcctgtgtgttattactctgctgttttcaactcagccacagtgaatcatttcttcttaccaagttgtgtaatcccgtcatttgtctgtaagagattccatcccagggcatattgtgtccccgtgctatgggcttaagacggcaaatccgagctgtgatataaatgtaaaagtcattcccgttctcctcgagcgcatgttaacgacagcacagaatagtgataattagatgaagcatcatttcacaccatcaccagcgtgctttacatttatttatcgccattcttttctccagcatcagcaaaacagagacttgtacgatatcccagagcatccaatggggcaccgtcctgccactgttaattaccaccttatgagcgcacagagcccagcactcacctctagccgctttctgggggcctaaaggggaaactcactccctgcacatctctgtccctccatatcccagacctgtctgtcattgacatgtgtcctctgtccagctgcctagggctgatcccatgccatgtgtgtactctggctgccatgacaaggcaccgcacacggggcgacgtacgcagcagccttgattttcttgcagtcctggagaagcgaagtctgagatcgaggtgcgggcagggcaggttcctcctgaggcctctgtccttggttctctcagggtcttccctctgcctgtgtctgtgtcctcatctcctcttatataaggtgaccggtcagactggatcagggcctgccctcctgacctcactttaactttatcatctgcgaagactcgctttccaaaaaggtcacattcataggttctggggcttagaactttgacaccttttcacagggacacaattcactccataacagtcctgaagcaagatgaatctgaacctcatgttcaaagtaagccctggtgagccctgggccttgggggcctcctggcttcactcctgtataagccccggtgagaacaggagggaacttctggcagaagggaagagggatggggtctcagcttgggctcacactgggctctctgtgtgagtatctttgtctaaaggtgccctgtgtgggcaactttacaagtatctcacctatggatcctcaactgggctggggaccttggcaagaccctgccccagcctcccgagaggggtgctcactcctgtgggctccccaggcacctgctcttgttctcccccactatcccagcacccatcccctgcctcccacctgtgtcccccacactgagcacccctcattggcaggaacagtggatgccggattctctctgtgtcctagagccccaggagggtccccaggagcaggagccacagagagatgttgttttgcagagagtcctcctgcccctatacccgccaggtcccctgagaccctctatgtccctgaacccctgggtgcacagtcacatagttgcaggtttggatgagacctggtgttaccttttattttgttaatcttaccctctcttattccagaaagaactcaaggtggaaaagtgtagcctctccgtttctgcgatatcactgctagaagccagccgtgtggcctttgaaaagctcctgtgaggagccacttgtttagcctgttcctttaccgggaagttccaactgttagaaaatttcatttttttttcttttcactgagtcacaatctgtctgccaggacttctaacttcatattgaactgttagtacagaatggtcaggtatttttaataaaaggaagtcatatggtgtgtgtgtgtgtgtatgtgtgtgtatgagcatctgggtacctgtgtatatgcacaacacatatgcaccatgctttgtacaaaagagagcacttcttggatttgggtctctgtccctccacattctgccaggatccttttaactcccgtaggggatgagaagggagttgctgctgtttaaagatcaaatctgctttgtagcctgtgttccttacacgtggcccaagcttccagggcttcccggtagggcacttctctgccccagcagctgcccatgggtcctctaggcccatcacgggtggggcgcattcctgctttggcactctgaggtccctcctgagcattttggtggtggcagacctcagcgtcgtaggaaacctaggaattgtggggactaggcagcgtgacccccaggacttgacagagacagggccatctgccaaagtgagcattttctcagggagagcatccatggcctcacgcttttcccaggcacgatcctgatgtctgaggaatgcctttcatccggggactgcgcagagctagtgaattgttctgccttcttagtgacgccacgcactcaggagctggaaatagccaggtaggaacttctagcaaaattatggcctgaatgccgccaggctcctgagccggcccacatgcagatcgggcaggtgaggctgctctgctagagagggccaaggtacctcccacgactcagtggtcactggccaaggagggagccagtcccaccatccaggaactgttctttcagcagaagcagcaggtcgggggacctctgcccagcgtggaggtcagtgactgagcacacacaggtcttcggccaaggctgcgctctgagtccagcttccatggaggcaggccattcggggtgatggacttggacatggagattggagaaacacattccattttctgtcgagggcatcgtcccctctcacctacctgtctggccggggtcggatcagtcagagggccttcaaggagccgtggtcatttggaaagtctaaaaggctctgcactcggagctgtgcataaatcccagcgttgcaggataagatatgattacagtatattatgtgggcttgacatttatggcaagtataaacagagcgttattactaccaaatcatgagcctccgaccaagaggaaggcagcgctgagagcacgcaagtgagaaggagtttttatacaaaagagaacaaagtgatatgctgccacttttaatatgcctgccatgaaacagaaaagcagagagcagaaaattgaaaccatcgggaaagcgccaggtccaggatggcccagacaaaagtcactgccgttgagataagtggcactggctcccccgccatggctgggccaggattccaggagagagggaaggaggaggagaaggaagcagggagaagaagagggaggagagaaggaggaagtgggcggggggaagaaggaaaagtgaggaggggagagagaaacggctcctgggtggtaactgcatcagcattgtttttccctccagttattgggaacctgggcttcctgggtcctttccaaaggggcgtcacttttgtcatctgggaggtgacaaaaatgcatctgagtgcaggtgtgccttggcaccccctagaaagggtaattgggaagattctgcaggttggatttcaccatgtgtttatgtcctggtgtctgcacaaaggcccgacatcttgtcgggttattaacggagacacagtggctgagctgatgactctgtcccagctccaggctgtgtgtggcgtgtgtctctgcaggtgtcctcactgatttcctctccagggcagactccttggccatccacccatgggcccctttccaggaaagggatttttaaagtaaatggtcatgagccacatgtcttctgggcctcctggcctcagcccagcaggctctgctcctgcataagcctctgtgagtgcagagggcctctggttgctgggaagtggggtgggctcaggttggggtttaatttgggggtggagacctttccaagtatctcacctagaggttacacctcctccctagctggacccatgactcttggcaaggcccggatcttgagggaagagccagggagctgggatgaaagctcttcccactccgtgtgagccagcctcatcgaggaacagagggacaggcctacggtgcctcctccttgggattaatgcagttaggatgagatgtccacgaagtccacagagcatctgtaggtcccaggctctgcatgagacactcagaggccatcgcccttgaccgcctggtgaaaggaatggagacagagaacccagcagttgggaacctcgggggtcagcctaggtcatgtgtgggcttggccacatccaatcacctaccctctcgaaggcacagtttcctcttctgtaacacagagatcataattgcacaataaaattacatgagggcagggttgcacctgctcttccctgttggcagcatagtgcctggcccatctcagccaccaaatgctgtctctatacagagaacccctcatttatatcttcaactctaacctctcacctgaaccccagactcctgcatctagccacctatgcagtgactcctctccagtagctaacaggcctcccaaacttaatacaaccaaatctgaactcttttttttttttctttctctctttttttttttgagacggagttttactcttgttgcccaggctggagtgcaatggcatgatcgtggctcactgcaacctccgcctcccaggatcaagcaatctcctgccttagcctcccgagtagctgggattacaggcacacaccaccacacccagctaattttgtatttttagtagagatggggtttcaccatgttggtcaggctggtcttgaactcctgacctcaggtgatccacctgccccagcctgctaaagtgctgggattacaggtgtgagccaccgtgctgggcctgaactcttttttaaattttattttatttttatttttcaacatttattttaggttcaggggtacatgtgcaggtttgttacatgggtaaattgtgtgtcactggggtttggggtacaaatgattttgtcacccaggtagtgagcatagtacctaataggtactttttcgatcctcaccttctgcccaccctccacctacaagtgggccccactgtctgttgttctcctctttgtgaccgtgtgtactcagtgtctggcccccatttataagcgagaacatgcagtattggttttctgttcaggcattaatttgcttaggattatggcctccagctgcatccacgttgctgcaaagaccatgatttcattcctcttttaaggctgcgtagtattccacggtgcatatgtaccacattttctttttctcttttttttttttttttgagacagagtcttgttctgtcgcccaggctggagtgcagtggcacgatcttggctcactgcaagctccacctcctgggttcacgccattctcctgcctcagcctcccaaatagctgggactacaggcgcctgccaccgcgcccggctaatttttttgtgtttttagtagagatggggtttcaccgtgttagccaggatggtcttgatctcccgacctcgtgatccgcccgcctcggcctcccaaagtgctgggattacaggcttgagccaccgcgcccgacctaccacattttctttatccaatccagtgttcatgggcacctaggttgattctgtacctttgctattttgcataatgctgcaatgaacatgtgtctttgcggtagaataatttatttacctttgagtatatactcagtaatgggactgctgagttgaatggtagttctgttttaagttcttgagaagtctccaaactgctttccacagtggctgcactaatttacattcccacctgcaatgtacaagcattcccttttctctgcaacctcaccagcatctgttatgttttgactttttaataatcgtccttctgacaggtgtgtgatggtgtctcattgtggttttgatgtgcgtttttctgatgatgagtgatggtgagcattttttcatatgcttgttggctatgtgtatgtcttctgaactctttctaaatctccatcggatgtatgccttccaaattgtcttcatctgggctgggttcagtggctcacacctgtaattccagcacttaggaaggctgaggggggtggattgattgcttgagctcagaagtttgagaccagcctggccaacatggtgaaaacctgtctctactaaaaatacaaaaattatccaggcatggtggtgggtgcctgtaatcccagccacttgggatgctaaggcaggagaatcgcttgaatctgggaggtggagtttgcagtgagccgagatcacaccactgcactccagcctgggtgacagagcaaaactccgtctcaaaaaaaaaaaaaaaaaagaaagaaaaaattagccaggcattgtggtgtgcacctgtagtcccagctactcgggaggctgaggtgggaagatggcttggcccggagggggtcaaggctgcagtgagttgtaatggtgccactgcactccagcctgggcaacagagcaagaccctgtctcaaaacaaaacaaaataaaacaaacagaaaaactcaaatcttcttctgtctacccatccattttctctaaaaaccaaggagtcagcctgaatttctgtctttccctctcttccttatttaatcactcagccaacccttacacccctacccccaaaatatagctcaagtccatctgcttcttcctaccttgactgcaaaagccctctgccaagtcttccgcaatccattctccactcagcggccagggccatcttttaaatacatgtatcaggtcttaatacctcctgtcttcagatgctccagtggcttctattgtggctggagtaaaatctaaacccctgccatggccttccacccctcccctctcaggtccacactctagcctcatctcccaccagcctccctcttgctcctcccttggctccggctcacaggccaccttgctggttcttggcgttgcacatctgttcccaccccagggcctttgcacatgcttttccctctgaatactcttaatccagattttcaatagctggatccactcatgaaaggactaagcacaaatgtcccttctttgctctcaggaagatctaggtatggcatcactgtgcatgacttgggaacagaaaggttcaccaaccatccagaaggctggagagagctcaggcagggactgttgaaataatggaatgtcaaggccactgtgggcaggatgattggacgggtttgggagggaggcatggaagcccgaggtgtccctggcttcagcaggcttgctgctttggctggggtgttcttacacacctagaggagccccaggctctgctgttccctgtcctggatgaacatgcctatgaagaggtgtgtgccctctgcaggcagttcctggggcctctgtggaggccttgggcagggctcaagtgcccttggccgacaggctgggatgctgaattgcaccacacctgtcacacgctgcaggatcttcctgcctggcgctgggcttttgctgatgctgttttagcaccatcctgaaattgaagccacaccaggtgatcttgagtgagacctgctttttgaaagatgtgtccccagagcctcagagcctcttcctcctggagatgcaggtggagcctacagatggttcagggaaatttggaagtgtgcatgagtgactgccaccgcctcctcctccagtctctgaatcccagtgaatggagatccctgaacctatggaccatcagcaggctgtctgtccccagggtccctctagcatgtcagggcttggctctgcaggtacccagcctgccccattcctggtggctgcttttatagggaaacagtagaatgttggttatgaacagggcctttggaatcatttagacacaagtttaaatcctgcctcttccatctactgaccaaccgaggacaaattacttaacttctctgagccttggttcccttctctgagattaggtgggcatagtacctgcttcctggggttgagaggatgtgacaggatatctataaagccttgggcccgtggaagctgtggttcatgtcagctgctgctgtgattgtccacactcagctcccttccccccttccctcccatcatgggcttttcaatccattcctagttgaagcagaggctccccggagtccattcattctggcatctccagctccaggtgaaggatatagctatgcacagaccctactggtgctctggtggatttctcggctcagggaatttcaggatgaaaccaagggccctgcgatgtcatccagtctcctggagcatcctacagggaggaaagaaggcatcgagggatgccccgccctcccattttttcattcatgtcttcctccctgaacactgcatggagccgctatagccaagagcccaggacccaacctccctgcccaagccttgccctttttggctcaggaggggccatctgggctcctggtgaggaggggggtgagctgatttagggggcagcgaggcagaggaactgagttgcccccttgccgggctctcaagtcctggcactgccccacctggctgcagaaccctgggcaactcacttacctctctgagcttccatttctttgtaaataggggtcacgatttccatctcacaggaatggtcattctttcatttaatacatgtgagaggggtagggatgaggcttggaggaagggtttgagctggcccctctaagctatccaaaaaatttcactctttatctaaagggccctggaaagccatagaagagtttctggtttgcttgcttttgtttttattattatttttatacagatgtcctcgtccatgtgtgtttttcgtccttagggtcttatgactcagtgcttctggacctttccatggggcctgctccttttgattcagggaaatccctggaaaggactccatgcagtgtctgggcagagtgccgggctgctggagcttggggtccctgctcccaggtccctgtccccacctggaatgagataggagaccaacagcatcttccctagaaggctgatctccctcagggactctttggatggtgacagacagggccctgtgttttctggactatgctaaagggctgcttgtgtgctggagggatctgggggctccttttcaaaatgaaggtccaagcccagatctttgtggagggggggaatggacacggagaacagcccatatttcccagttccttcaagttctatttgcaaataaagaggttaattggaaaggttgtagtcactggtcactggggctacaaaaagccccacgtcctcccttttttcctctggtaccgaggaggtgagcttttcggttgcttttctgaatctgtagctgaaaaccttgacttgataaatgagatgtaaccttgaagtaaatttgcctattatctagaagtcatggaagcagacactaaaaatggactccatttattttacgagaagtcagagcatgtcaagctgctcataattagtaataaactcatctctgcttgatgactttttacactgtttgtattttttattgatgtagtcacgcttaggtggccatcactggaggcgggcagtggtggggctgcttccggtgcggagcctcccttcctcctccagcgtccctgcatgccccgcgccacccctgccccgggcagccccggctgctccttcatcacagagcccagactcgcctcgtcagacttggctacctctgtgagcttgcaggaataaatctgaggtgctgaatatagatatattttcctttctcctccttggagagcagtgatttgcagccttttcttgtgtgagccagccaccctcatgtgacttgataggcacatggtcaggggaagttgctgtttccagacctaatgaggccttggagtcttgttaatggggctccttgctgtggaatgtgttgtttatggatggacagggtggccccggctttgtctcctcagccccatgccaaggagtggatctctgatgggcagcaagggttgagaaagaagcagaggagcctccagccctgggggccctggagcctggcagctttggctataaaatctcacccttcagcagcccatgtggcacactgggaggtaggagcctcccttctagaaagttctagaggctttccctgtctgcagagcctgggatggagcaggctcacgtgcataagaggggctctaggtgggacaggtggaagagtcctttgtggtctcatttgctcttgctctggcgataaagccctgttatcagtcatgggtaccaggtgacccttttccagtgagtctctggagacccaggggtcagtggggagccagcctttcctcatctctgccatgtgcagggaccatggagaagggcatgctgagtgggtcctaggcttcataaaagagctgggcacctggacagcaccattcccagtacagagaaggcaatcgctggcctcaccaaactgtgctctggtgaggctggagagcccctccccaccccctggttttctcttggcctctttggtgccctttacattgggccctgtgaacaggacgcagaggactcaggcagcccatcctcctagcaccacaatcctcctcatccctcaccccattcgacggcaccttttcttgaagcctttacttagaattcagctccctcttcctgctctccttctgcagtttgtgtttcactcttttgtagcaggaaatgttctggagcattgtcatttgcagacatgaggcagtctgcagatgggccagtggaccatacccagatgcaacagcttcctgagagctggcatgagggctccagcctgtgttcttggaatacaagctctgaaagggtacagggtgcggtgtttgcatgataagcagggaaggtgaaacttgtcccttctgaagtggggtctgcgtggggtttttcagagctagtgggttggtttgctagggctgccgtaccacaaacggcgtggcttaaacatgggaagtgcattgtctcatggttctgaagggtgaaagtctcagatcaaggtgtgggcagggctggtttcttctgaggctgggagggaggatctgtcttgagcctctcccctggctgctggcatgtgcttcagtgttccttggcttgtagaagcatcaccttgtcctctgccttcatcttcacgtggcattctccctgtgtgtgtgtccaacccccacctttttataagtaatcagtcatattggattagtgtccaccctaaggcctcattttaacttgattacctctttaaagactgtctccaaacaagggttcattctgagatactggaggttaggacttagcatgtaaatgttaggggactcaacccataacagctacaaaaagggaggtgcatcctgttcacatgggggctgggactcagccctggggcaggttctggaggtgattcccaccacagccatgccaggacaggacccctacactgatgcactggagtgtaaatccgaggagatggtctttgcactcttgtgaatcaggctcaaatctcaggtctaccattcaccagcaggtgaccttgatcaagtggcttaacttctccaaagcccagttccctgtttgcaaaatagggttaacactacctaccttggaggattgattgatctgggatcaaatgaggtcaaagatgacaagcctcggtgtgcccacattgtgccaggagcatgggaggtgctcatgccttttgtggctctctcaggactgtgtagtccctagagctgtttcttttcaccctgtccctcttagccttgtcccattctggcctggcagagtgagcaggctgtgctggcctgcacaggtgcaaggatttgcagcaagggaaggtgtgatgagaacaagaggccatccctctcctgccacgcctgccactttctccacgccggagttgcctgcaccaattggcagtcgggacacacagcagctgggatgaagggagtttactgctgaacttaatagggtcgttttctgcttcacataaatctgtctgtgctcagctgaggatcctgggtggctggtagagcagccattgttaatggacttgtccctggaaaacggggctgtgggtgttagagtgttgttctggatgtttcttccttgggaagggagaggatttagtaatagaagctcagtttggctcttccgttgctgccggcctgcctggccaatgggctgctttgggcaacaaaataggagtggcgccatattcatttggaatctgtgatcctgcatcatggcaagtcgtcatccttggatggaacaatagggtgggtcctcagttctctctgaacattcattgagtcgtttgctcaacagatatctgctgagctgtgagcttgggccagacctgtcatcaattctggtcaatgcgaacaggacagatttggtccccagtgtcatggaactaagagtcaaccagggaatcttcaggggagaagttggtggccaggaaaagctggggaggtgaccttctagctgacatttgttgggcgagtcaaagctggccagaccagaaggggaggctggagaagcctgggacacctcctggagccacatcctcttccttcagggacttctgagatcctccctgctagctgtgtagaaggaaccagaatatccaggtcctgtgtacccagccacctgagcaacttttccacagtgtgacttttttaaaagtcaagatgaatctcatttcatgcaataaatattaacctggaaggttgggggtacattaaacttttatgcatggcaataaatttcttatgcaagagaggactcactactagttaaagaaatttggggtgaaaactgccttggtggggattatcccgactcatctgtttagcaagtaacgtaaaccgagtttccttcaagctggattcctgtgtgttaatcatctttgagcctctgtttcctttcctctctttctgcacctgtcatttgattcctcaggccctggggctgccttccttctggggtcctctttgaagaagaatccttgatatctgccctctaggagtttaatatttcttgaatgcataggccataatccatacatatgtcttagaaaaccaaccctgaaaattttctctatacttggacagggccagaaggcctaatttcaaatggtcacacctacttgcaaatgatccagtgtcttcacaagggcttgacacatgtgccctgcctgcttcatgtcctggtcatgtgactttataactaatgtttatcctgtcttactagcatttctcttatgattggtgggcctgggtagaattgatgaacttgagcagagttggtggacttgggtagtgctggtaaacttggttagagttagtggacttgggtagagttagtgaacttgggtagaactggtggacttgaataggattattggacttgggtacaggtggtggacttggatagagttggtggacttgggtacagttagtagacttgggtagagttagtggacttggaaagagttagtagacttcaatagagttagtggacttgaatagagttagtggactggtggaatttaatagagttggtagacttgggtagaggtggtggacatgggtaccgatggtgaccttggatagagttggtggacttgggtagtggtggtggctttggatagagttggtggactttggtaggattggtggacttgaatagagtgagtgaacttgggtagaggtggtgaacttgggtaggactggtggactcgaatagagttggtggacttgggtagaggcagtgaacttggatagaggtggtgggcttgggtaggattggtggacttgaatagagttagtggacttgggtagagttagtagacttgaatagactgagtagacttctgtggaggtggtgaacttcggtaggactggtagacttgaatagagtgagtggatttgggtagaggtggtggctttggatagacttggtggactttggtagggttgatggacttgaatagagcgagtgaacttgggtagaggtggtggacttggatagacttgatgcgtgtggggcaaagacaattagtggaacataaccatttatgccaacccttctagctcgcagaggtgctctgtagaagaagaaagacattgcggaagtttttaaatagggacatgataccaagtttgaaacgtgagagagtgagtaggaactgtgcccttgtctgacccaagtgctaaatcaacaggaacatggtgcccacttgttacatcactcatggacatgagctgggctgtttttcttgcatccatttcactgggtgattaatatctcttttaatgttcagctgcagtgaattcttaacaaattattttgtaacacattgaaatcactttgtaagctctttgttaacacctttaagagggctctagctataaaatattactttatcatcttcccgttgcaggacatttgatgtaacactcgtgtctcggaggttgttaataaataatggatggaggaatgatctgggggtgaccttttgtagaacatcatctgtcagccgaacttcacttaatccttcctcttacgctgtcttctggctttcaggatatagcagtttgcaaatcaggtggtttggttcctgccagtgagtgacatttcacaggatgggtgacatcggaacgattggcctgtgtggttgcctctgggaccctcagaaggatttaagccccgtgattagcaggtctatttttggccaccaagtgcaggagggagggcatctggtgtgtgtctcatcttggctgtgatgaggcttggctgaccccagcaaggactctccatgagtggagtgtggcagcgctgtggttagctggccaggtgaggggtgtttctccaataagcatttgtagatctgccctctactaaacctgcttcaccctggtagcccccctcaaaggcatagcaagccagagtatcccagggaccgggaacacttgggaacagatgcctgatagagagtcacagaaccataaagtcacgggggctaaagccagagaaaccagagtccagccccatcagcttacagagagggactgaggtcagaaaagccgagagtgcctcttccagggtagctcatgggttagaacagatttttcacttgactcctgaaactgtggtccctttagccagtgccctgcctcacaggatgactctagagtcacttcattcattcataaacaatgcttatcgagtgctgactctatgcaggtggtgtgcaacatcctgaggacactgcaggcagcgagaccagcgaggtgtcttagtccatgcatggtgccagaacaacatactttagactgggtaactataaacaacatacatttaatgctcacagttctggaggctgggaagtccaagatcaagacaccagcagatttagtgtctggtaagaggctgttcctgatagatggcaccttctatgtgtcctcacatggtggaggagggggcacacaggttcccttgtgactcttttttttttttttctgagacaaggactttcttgctctgtcacccaggctgaagtgcagaggcacaatcctagctcactgctttcctgggtttcttgtacacagatcagacctatgagtgcatggtggtcattacagcttcaacctatgctagaaggcaggcgtgaaggaggctgcagctgcagatatgggatggtgggaggcttccctgaggaggggatgtcgaaggtgagaggtaggatgcgtgagatgctttctgggcagtgggagagggtatcccagtgtgctgtgggctctggggctgcagagatgcgtgtctgtggagtttggataagccccataaaaacactccacacagtgcttctagaatcagtcggagtccatggcacaaagcaagggctcagtatatactgagtgaatggatgaatgaatgaatgagtgaatgaatgaatgagccacctgtcaaactgctttctcagatcagtccagtcaggggaatggcggtggccatgggcttctgtagtggatgtccttaggctcggtgtggctggtgatgaaggactgagagtcatcccagagagtgcagaacacctcccatgaccttccccagagtccaagcccagggagcagttgtgacatccagccaagctcacacttggcctggaggccggaccccatgaggaccaacctgtggtcttcagaggttgtcgggagggaggccccagtggacgctgaattccagcctctgtctggaggcctttgagcagcaagcacctggtggctgcgctgtggatgggcttgatggtctgaacccataacacccattcaggcatcagaaaatcaccctcgaattatctctagagttttatttcctagaatcctgaatagatcacattttattgttgaatactgaaatctcattactttaggaagtgctattactgggctattactggaaaggaattcctctctcctgttctgattaaaacctcctgttcatatttaaaaaataatttcagacctttttttttaatgcttctaaaagtataaacgtgcagccaagcgtcttctttccctaggccccgcgcctgggtgtggacttccctgggcctgctggtggagagtgagcgcagctctgcagaagtagagacaccggagtctcctcctggacccccttcttggagaatgatccctttcttttcctctggctcagttgcttcctaagattctaatgacagttctggccaaaacaggcagcccccgttaccactggtttgagacttcagctctggcttttttcaccaggaactgattctgggatcttggggcatagggtccaagatatggcttctctgctgactgatggagtcaggggagctggttccacccagagcaatacgtggggatgggtggaaagcactcctccgggcagctcctgctcctctctggaggctgctccctccgcgcacagggtcatcagcttcctgcgtctgaatccccaacctgggggtgtcctctatggccctctgggctcacttggcactatcacatgccgagcccactgtgtcatgaatattacctggtgacttgctcctttctcctcctctgggactctgcccgttctctgtgaccccaatgtacttggcacagggactggcatggggcactcagaaaatatttgtcaaatggatggtggaattcaccagcacccagaaagcagtgtgatttggggagttttatcagcgagtggccatgtgactcccaggggcagaggggatgtcttcagcacatctccgtccctttgccaatcacaccctgctcagtagagcccaccttgcctgtcctcctcattgcctgccctgttcttgcctggccgcactgagctccacatgaggtatattccacatggacacaggggaggtgacccccttctctccagggctgctcctccaaggccgcgggttgccttggagaaagctcagaatagctgtgtggccccatgctgatgctgggtgagtgtgcatgtggctagaattcttttctggactcttggcaaatggaattatttacaaccaccagggccaatatttccctgctccgcagatgatttgcagcagatgaagtagatgctctctccttgcagagagctaatgataacattgagctcttcccaccccactgatgtgtctttgatggcacagctgtggatatttttatttgcccagtcaagtcggctcctcggtgcacatgtctgaagtgaaggcccttgggtctgcaagctgcagagggcactggcgccagccttgtgcgttgacaggagactgcaggaacccgccagcttggttgctggcttcctgagctctgtctgtgggttccctccctggaatggacaagggggagcagccgatttctgatacagctcatctgtctgggtcactggttccagaagttaattttggatggaacttcacaggcacctggcgtctggttatgcaaaacctgacctttggcttcactctggggccttcccttctcctcaccccagggctcctgctgcctccctctctgtgccattctttcctcttaaaaaaaaatatcctgctgacaggagctttctaacttgtcattttggagatcatcaacaaattctatagagaggtgacctccattatgagaaagagacggggagttggctgggacccaagccaaggagctggagcctcttttgactggcaaggtgacattgagtgtcatatcagcattcatggccagctctcttctcctcagagagtaattatttctttcagagcgaaaggtccaatttgctgtaaagaacagagccccaggtaaaacgaaagagctataagctcccctgacataaaggagaccagactgcccccgtccccagccctgctcactccacatcataatggccatttggccagatttattatgtttacttgtacttccttcctgtcataacacattagggtggttgcacattgcatgggtgaggccggctcagcaggtggagctgaacaccttgcagctgacactggctcttgtatccttggccagcacctggctctgggcagggattgagatggcacctttggagaaacactgggagagctgatgcctggcatttggggccaagctgagctctgggccctctgcactctcctggtatttcctctactcctgggacattacaagaataagtggcctaagtctgtggccttggatgccaataccacgatagatgtcattcactgagtgctcaccctgacccagatcatgagacactgggcactgatggttttatttagcacaggccctgggcactcatggtttcactgggcacaggccctgggcactcatggtttcactgggcacaggccctgggcactcatggtttcgttgggcacagacactgggcactcatggtttcgttgggcacagacactgggcacttatggtttcactgggtgcaggcactgggcatggatggtttcattgggtgcatgccctgagcactcatggtttcactgggcacaggccctgggcactcatggtttcactgggtgcaggccctgggcactcatggtttcattgggcgcagacattgggcactcatggtttcactgggcgcaggcactgggcacttatggtttcattgggtgcaggcgctgggcatggatggtttcattgggtgcaggccctgggcatggatggtttcattgggcacagacactgggcactcatggtttcattgggtgcaggcactgggcatggatggtttcattgggtgtatgccctgggcactcatggtttcactgggcacaggccctgggcactcatggtttcattgggcgcagacactgggcacttattgtttcattgggtgcagacactgggcatggatggtttcattgggtgcaggccctgggcactcatgctttcattgggcgcaggcactgggcactcatggtttcattgggcgcaggcactgggcactcatggtttcactgggtgcagatacctagcacacaaagcagtcctatttgcccatctatggctgagcagagtgagctcacagtcagtgaccccttcccaggccccacccccactagcacaggagttcccgctgtgtgcacccatggcgtggctctggggtggctctgggtggccctcatcacttggactgccttttcttcttttctcgtctgccctcccctaagctgtagctccatttctgtcttgcacgctgctgcagcttcagcacccaccgtggtacctggctcgctgtggtgttccgcacatgttgttaaatttaaattgttaaatgattggatgagcctgacgtgagatgaggacctgcccagagtcatccagctgctcatccacagagcctgggctgtcctgccacgaagcccttgccagtcactatgccttcttgacttcccatggcaccatgactgtcacactgcactgtggcacagtgtacctccaccttcctccttctgcttctgtttttgggagttcagtcaaagctgacatgttgcccaagactagaggggagagtttggaggccggagaggatggccaggtcctgggtgtggaggttgcttcctgcccctcctcctcccccaccacaggggcctggagaaggtagggtggtgtcctcagtgaggatggtctgaagggggcccaggagcagagggaggagtcatggttggttggaaattaggacaaccaatgcaggaagctctctgtcacagcttgcccattctgtaggtgagatccgtgaaggtcaggaagttgaataacctacctaagtttatctggctacttaggggaagaacagagttcagacttgaacttgaggtgccctaatgagtgtaagagtttgagggggtcattcacaagcataccctcgcttctgacactaagtgtaaattcagggcaggaccactctgtggttccataattcactgaaggactcacagaacttgctgaaatctgttatgcgtgtggttaaggcttatcagagtgaaaggacacagattaaaatcagctgagggaagagacacatggggtagggtgcagacaggttctgggtggggattccagccatcctctatgggtaagttgtgggaccactagcgtctccccacagcctgtgtgtcggtgtcgccaaccaggaagctcgctgggccttggtgcccagtctttactggggctcacacatagacctggttagctacccacatgtcttcagcctccagccctgcctaggacaagctgaggtcatgggaccccaaacacacccccttatcacattgttagactctcgagcatggcccaaagctccaaagacactctcacctgatcagtcccctcctaggagcccagggcacagcccagacctctctgtgggtaaggttaattcttgattgaatagagtactatgtaggagagtgtctaggaactaaattcgggcttattccctgatagactcttctcaccccgggtcaaggtacttcaggcccttgccatggcccactggtgacgtgggtccctgctgcggcgttcaggccccttgcttacatcacggcacttctctcttttccagactgacagcagcaatcacagtcacattccacagcctctccagcacccagccagctctccgcgggggcagcagggactggtccacccaacaacagcagccatgtcctcacctcttgctacagcagcaactttatttgatttgatgtatatgaagaaataaaactcagaagtcaattgacttaaacatggaacaatgcagcttggttattatggtgtatgctaaattttaatggcatttagaaagcgttttgtgtggtagaaaatagaagcaaacccatcaaaccccaactatgctctgtgttttatagtgcagaacgtttttctgctacaatccaaagactttaaaatgtaataaggtacatttgaacccaagggttttaaaatcgatgtaagaaacgtgcacatccagaaatggagtaaaataatccattactgtccgggtcgtattcgagggaagacacacattcctggaaaggcttttaacatttcatgttccacagactcttatttattgacacgtattagtgttcaaggattaatatatcgctaagtgagaaagaaaagtgtggttgggaggggttttgatagtcggcgttcttgggtttcttgctatttttgaatgcatttactcagatatatttaaaatcacatgccacataaatggatatatcaattgagaaataaggcaaattttccattcttacatttcattaaaaacacattccgactgtcacatgtctatatcccccttgtccttcccaccaaacatgatttttcagagcccgccattattgccctgggtcctgggatatggcactttctttttctttctttctttttttttttttttgagacggagtctcactctgtcgcccaggctggagtgcagtggcgcgatctcggctcactgcaagctccacctcccaggttcacaccattctcctgcctcagcctccagagtagctgggattacaggtgcccactaccacgcgcaggtaattttttgtatttttagtagagacagggtttcaccgtgttatccaggttggtctcgatctcctgaccttgtgatcctcctgcctcggcctcccaaaatgttgggattacaggcgtgagccaccgtgcctggcctggatgtggcactttctaatgctctgggttttgtttgtttgtttgtttgtttgtttgtttgtttcgagatggagtcctgctttgtcacccaggctggagtgcagtggcgtatctcggctcactgcaacctccacctcctgggttcaagtgattatcttgcctcagcctcctgagtagctgggattacaggcgcctgccaccccgcctggctaattttttttgcatttttagtagagatggggtttcatcatgttggccaggctgatctcaaactcctgacctcaggtgatctgcccgcctcggcctcccaaagtgccgggattacaggcatgagccaccatgcccagccacactccatgttttctatcgccctgtctgtatttcagagtttcctggccgtcctcatcaaaggtgctcaggagtttctatggctcaacacagtgtgagagttctcaggaatggcccggcctctgtgggtggtgcagcagctgcctgcagaaatctgcccacatccccgacattcatttgacagatgaacccgtttccatgatcttcagtttagggctgaagaaatcctgaaatcttctggttcagtggttctccactgaggatgattttgtccccccactccagggacatttttggttaccatgactaggaagtagagggtggccctctgggcatctgatgacatctgagatctaggaaggttctgcatcatctcagatcacacaactggccagtggctgagatggagcaaaactcctggagtccagacccagcctggggaagtcctgggctgagcgtgcacctctcttctttactgttgcacccctgccccacccgggctctgacctctccctgaagcttctacgccagtagtgtggcttgggctcacagtgtcaagaacagccaggtcttcctgggttgaggctgccaggcttagccgtcctcctatcctaaatccctccccaacctcccttaatctccagccaccgccagagcccatccttgcccttcagaagctgctctccttcgtgcaatatgggtgaggccattgcaggtcctttaggggacagcacagacctgcttgatgccaataagcacaaatctaggtaagactgaaaatgttggtgagatttttgtgagtatccttgctgtatgtgtttagttttttgtttgttgtttagttaaactagcatgcagtttctttttcaaaagctcaaaagtatccacatcctaccccaccgtctagtcgagctgcacgtctttcctgggctgggtctgttgcaggctgatcactgagcagctgcggacgtagtgggcccgtgattgggcatctcgcgttattacgtagccttgcccgtgaacacgtctctgtgtttctcaatcaacttcatcaccgtcagtgttaataattacaatcgccacagtgatggagccccgtgccagcgctgccatgagtgctttgtgtgtaggagctaatttgatacccacagcagccttggagccccatgtgctcttattaccctgtcgcacagaagtgatgcacagagagatgagacacgtggcttccggttgcagagctagtcggcaataggaccaggatctgaacccaaaacagccatctagagccgcccgcatagccaccatcctacaatgcttctccctttcaatggctgcaccctggtggagcaaaggggccaggccccattgaagtggccctgggccaaccaggtagtgcttccacagtgcctttactcagagctctgtcaccaacctggtgtcaccgtagaagctccacaggttcttgccagctccttccaccccaacatgtagcctgcaggaggcatgggaaccaggggaagaaatgaattggtgattctagtgcagagtctgtcaatcttggctctatcagccatggcactgggtcattcttggttgtggggggctgtcctgtgcattgtaggacatgcagcagcatccttggcctccacctcctggagtatttctacccagtagtaccccgtctctgccagtcgtgactgctaagcaagtctccagactttgctaaatgtcgctggagctgccaaagctccagcataagcaagggttttgctaaagcccaggatttgattcgctgtggatttcagttcccccagccccagggagccccgagttggctgcgactgaatgaagtgagacgtgggcctaggcactgtgcgcagatgggtgggagtgctccacctcagtccaccgcctctcccctactcgggggaagccttgtagggtggtggctacgtggcctccacactgcagcgggggaaggttgcactcagactcactctgagtcccacagagcagaggagccaagagacaacaggaaacccaaaacaatgatcacctgcttccagacaactttgcttttttgccttgtggggaaacttataaattatttggagagcaatattagtctttttgcttctgaaaaaggttctgcatctttgatagagcctggttttgaaacataactcacagagttgtacaaataccccatcaatagtgcagtggctcatttcattgttctcagtgcatggaatcttcattatttgcactgttgataaaaggcagcattttcagcagatctgcactactccatttagctgagaacaatgatttattcctccctcactattggacatcctcaatttccttgggtaataaagaatgctcccatggatgggatgaacaggagcgaccggctgctctgagcctggcaaagtcaggaagagcaagaaggatcctgactggtggctcctgcccagggagaaggacccagagcctgcctccccgcctcactggcaaccacagcctgtggtggaagtccggagttagtacacgtcattgacaaattgcccaggaagcagccgggcccctgatggaaaactgcccatctcagcacagacagtgcgcctggtcccaaacgctcctttctacgtggaggtgaaattcgaatagagcccttattcaataccacaactcagggatgggcaaagttgtgagcatgtatgcatgcctgctcttgttttctccgtattagaaaattcacagactgctgagagagggaaaataagagtaatagcttcaaactggaaatggaagaactttcacattcaacacaaaagggaattgttgcaatcctagggcaaacgagaaaagagcccagcctgctgcttagcagaggacgcaggcatggggagaggaggaggggccgccaacaatgacaaaaaattctgcctagcagtttgctccattgcagccttgcctgggtggaagggaagaagattggagacttccagcaccttggaacagattaatggctctagagatgccacacctattggtggatggcttctagccttacctttacaaggagccaaatataaggaagcaggcgtgcggcacccctgagcaatgggcatgcacgctcaccagataccaggacactggagagttgtgtgcgtggaagtgagggctcaaggaactctctgggcttcttaccagcctctaggccactcactattcatgctgttattacccccacgttgcaagggaatgaagctcagagatgagacacgtggcttctggtcgcagagctagtcggcagcgggaccaggatctgaagccaaaacaaccatctagagctgcccatatagccttcaccctacaatgcttctcgctttcaatggctgcaccctggtagagcagtggggctgggtcctgttaaagtagccctgggctaacctggtggatgcgataaccagcagatagccaccagcccagccaggtcagacccagagatgaaacactgtttcgtttcttccctgcatcccctggggttgtctgcagggtgcttgcagggctccttggtagagctactttttcctagaaggttctagaagcagaggatgaatgaatctgtggctgggtcctttgtgttggggcattaggagttgagatgagcttctgggagatagggcaccgtggggcacattttagagaggacgccagtgcatgcagggccattgtcctcagcttccaaccaaataacaaggattacccaacccagcccctgacccgaaaccaccattggccacaccctagagactccagtggggcccttgaatcacctcaccaggcaggagcaaaatcctgtttcaaagagtaattgttgctatggcaactggccttatgcactcacctggttgccactgggggactgaggcggacgcacatggtgtgttggcagagaaaggaaaaaatgccagccctgggaccaacacccgtggggacaggcaagggagttgaggtgttcagccatcaaaacccatcttcccgtctggagcagcaacaggccgggccttcccctgtgcaggctggcaccactgattaggggacctgtgtccccatggttacccaggctggaggatggcagtaaatactggggcctcgattccaggcaagagatgttagactcaggtttgtttgtgaatgtgagaattggatatttcctaccataaaggcctttccattaattaatgcaaacattaaagctttatagagctggcttcttctaagtcaccctttgtcaacagagacagggtggacagaagggggcagggagaggtaccctgtaggacaggaagcagcggactggggcaagggccactctgctcttcccaggtggggcccttcctatcaggaggcaggcctaccaaggggtctcccagctgcctcaccagctcgcttccctcagactaagagcccctgagtcctcagtttttaaaacactaatagggaggccaaataaatatttcaaggtcacctaagggctcccttgggtcttgtttatttatagcatcctggccacctccatctagaaatgtttcaaagtgcagaagtatgaatagtaagaaggcagctcttcatttatttatttggttatgaatgtatttattttcgctgtctctgccaactcgaagggcctgggcataactggccagcacatggccctgctctggcccttggcatctgcctgcttgctcagggagcatctaagtggaactctgcattgcatttagtcctcagctgcaaaaaggaagctagttagctccagggggctcgcgaggagactgtacctgccaccacacatacacgtgagccaaggtgtgctgtcatcctggagaccctggcccaattccctggagcatctatggagacagagtataagcagtgcctaatttagtgagtccagcagtgtggacgttccataccagtgaactcatgcagcagaaggggtcagtattagctgggcttcattgtcctccctctattcctggatgataccgccctcctaagaggtaagtgtcatcacacccatttcatactagagactggaagagatcaaaattgtagccccaggttgtgaacatggaggatggtggagctaggacttgaacctggctctgtccgacgtcttcccctgtctcaacactggtgtctcttttgccctggagatggaagccaatggtactgtctgcccaggattggttaacatttgtccccagcccttgcctatgtgagcaaaatgacctctcagataggctgctccctgggagctagtctgtcctcagcctgtgtccaaaggctctaatggatgagatcacagaccggatcacagattcggatctgtctggaagtgctggacccctgctgcatgtccattctgaaaagtgctctgcccaggcaagatggcactcaagctccactctacattaatttaattaatacaattaatttagaccaaatctagtctgtccaacccagtcccaacacatagggagcactcgcctgaccgagggctgaggggcccccttcacctctctaccccaggagagacctgaccacctcccagagttcattcattcaagcatttactagggacttaaaaagcgcaaggcactgggaatacagcagcaattaacaccgtcctcgctatggggagacagacaagtaataaatgtgtaagagcagcagtgaaaaggccaggtgtagaggggacctctggcatggctcaaccaagagtccggccctgtcctgcgattctttcaatgcctccctcctccttactgttctctattctcaggccgacttccctgtgttagtaaaatgactgtagtcatctcaggccccagatattctccactgtcctaaagaagagagaacctctcttttcccaaccattgggtaaaaagtccgaggtttcgctctggatctgtttaggtcctctgacctcctgaaccaatcactgcagctagtggatacaattcatttagactaaggattgacaaactatggcccatgaaccaaatccagtccaccatctgcttttaaaaataaaggtttttgaggaggccgaggcaggtgatcatttgaggtcaggagttcgagaccagcctggccaacatggtgaaaccctgtctctactaaaaatgcaaaaattagccgagtgatagtggtgtgcacctgtaatcccagctacaggggaggctgaggcaagggaatcgcttgaacccgggaggcagaggttgcaatgagctgagactgtaccactgcactccagtctgggtgacagagtgagagcctgtctcaaaaaaataataattaaaaaaataaagttttattggaacccctccatgcacatttgtttacatattgtgtggcttttccaagactatggcggaatcaagaaggcgccatagagacagtattgcctagaaagccaaaaagatgtacagaaaaggccttttacagaacaagttcgcaaacccctcactcagacacatctgagtctgtcctgggagatggtgttagaggaaattctcccaattgtagtgagctttacataagtgctggagggcagttgatctatgcactgtagcacctgctattcctgtagccattcagccaaagaagcctgacggccttgtatgtaactaactgtgtgctctgccagagagatcctagcttcagagagagagaggaagccgtgttacataatcagagtagccaaaagcaagaagcaacccaaaagtccctccacagaggaataaacaaaatgtgctctatccatacgatggaataatattcacccataaacaggaatgaagtatgaacccacgctaccaccaggatgaacctgaggacgtattgctgagtgaaagaagtcagtcgcagcaggccgcacatggtgtgtttcatttatgtgaacgtccaggcaaatccacagacacagaaagcgggtgggtggttgcctggggccgggggcagggaggagtggggaggggctgcttcaggagaatggggtttcctttcagggtgatgaaatgttttagaactagacagtggtgatggttacacagctgagaacatcctaacatccactgacctgtacactttaaaatggtgaattttatgatatgtgaattttacttcaattaaaaaaaaatcggagaccgagtcagaggccgcactaaactatggggctggtgggggatgaggcctgtgggcccagcaggtgcatttaaagtggggacccaggggccagggcttcctgggagggactttattccagcttttccttagctcatatcttgcaccggctcctcgaggcaccccatccccatccccactctgtctctgacttgcctgggtggcctgacagtggcctgtgcgcctcagggtggcacctgcaggcaccctcctccctggctttcttgagcacctgatggtgaaatgccaccatgcatgacagagtctataaatttgcctgcaggtctggcatttatgtttggcacctttgtaaaaatattatttcccattgctacccagtttttataatgtcaatatactaagatctacctctcagtattacaatttatacacaatgctgctttctttataccctagagcacatgtgtttttctaacttagctttcaaaaatagttgattttcaaagagatgtcgcaggagacttgctgttggcagtgaaataagtttttttattgtggtctggagcaaaatatgtgatggaatccttaattgaaattcacctttaacattcaagttatatttttattacaatttgaatccattgtgagggatcgttatctgcagagattcatttccttcgggaagtttcttctttggtgatgtaatttaaattcagggagccgggaaaaaacaccagcgtctcgtatttcaaaccgctggcagaaaaggctgctggtgtcagtgcccaggaaaccgtaaaacaaagcactttctctgtctatggattgtcttcctgttgcgtcctcatcggggcattctggggcttgtctgagcttcttaaccagcagaattccctagaaggcaagggcagtggccgtctgaactggcaggcagcattaaaaggggactgaactccttcactgtctttgtttctgacacctcgctttgatctcttggcctcccgatgcctctccttgcctcttcctcctaaggacagctttccttgtgttctcattttccaaacaacacacatcagcgaaccgacaaagcctgtctgcgtgcgtctgccttgcgccatggagcagagacttgaggctgcggccaggcagaaacaggactgccaagtgagcggtggagaaaaagggctgttcttaatcagtagtcatcactttgtggaggataatggcaatttaattaattgcccaatgccagtgctgaagacagggtctgcaggaacattgctagaatttgaggaaattattacaaattgtgcattcaactcttaggatgaataccaaatccagacatcatatgttttaacatacctattatttatatgcaaatctggctcttcaaagaggatttcccaggagcccatggggttagttttcctgtaggctcagaaagtgactgtccatttgcccggcacgtccctctcctctggtatcccaaggaaggttgcccagttaagtccgggtccggtggctcacgcctctaattccagcactttgggaggctgaggcaggtgaatcacctgtggtcgggagtttgagaccagcctgaccaacatggagaaaccccgtctctactaaaaatacaaaattagccaggcgtggtagcgcatgcctgtaatcccagctactctggaggctgaggcaggagaactgcttgaacccaggacatggcggttgcagtgagccgagatcatgctgttgcactccagcctgggcaacaagagcgaaactctgtctcaaaaaaaagaaaagaaaagaaggttgcccagttggatcagatttcaccacttctggccactcttcctctttagggcctagttccatcaggtcttagtaagaatgtggcataaatacagtattggtagaaatagtttgaagagtctttctggagccaagataacaaacagtcctcccttctgatgccaggcagggttaggcactttgggctctatgaaaactaccttgcctggtccacccagctgatctgatcattctggattgctaagcaaagctgtcagggtggcacatgcttgtgaacagcagcagcagtggccacgggacaatgagagcagtggctagttggaatttattgagcactcactctgagccagactctgtgccaagggttttatcataatgccctaaggtcatgcaaggatggcaaagataagctgctttctaaagaaagtggttaggaaaatgtgctctggagtcagacaggctgtattaagataggttcagctgcaagtgaccgaaaacatcataatagcggtgacttaaataagacggtttgatttttcttttttttattttttatttatttatttattattatactttaagttttagggtacatgtgcacattgtgcaggttagttacatacgtatacatgtgccatgctggtgtgctgcacccactaactcgtcatctagcattaggtatatctcccaatgctatccctcccccctcccccaaccccacaacagtccccagagtgtgatgttccccttcctgtgtccatgtgttctcattgttcaattcccacctatgagtgagaatatgcggtgttcggttttttgttcttgcaatagtttactgagaatgatgatttccaatttcatccatgtccctacaaaggacatgaactcatcattttttatggctgcatagtattccatggggtatatgtgccacattttcttaatccagtctatcattgttggacatttgggttggttccaagtctttgctattgtgaatagtgccgcaataaacacatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgatttttctacctgggaaacgattggttagagggttgagaactggctgggcaactggttgctcattagagtcccagcctccaataatgcagtaccactgtcctcaatagatagccttcacctcatggcacaaaatagctgcttgagttcaagccatagtgcctgcattccagccagcaggaaaggagagaacaacgcttttgcctgtatcctactggccagaatgcaattgcagtcacatctaactacagaggagggtaggaaatgtaggcttcactctgagtgtccacatgcccagctaaatttggggattctaatacttaaggaagagaaagctgggcaaagggaaacagatagctatctctgccatagagttagatgcaaagttagttgttttccttgggtgaattgggatatgtcttctggatatcatttccttatctatgaaatcaggtaaatctggtacttggagaggatgtgcgctaattgctctgtgatgcttagcgtagtaccagatgtaaacatgggccagaaggatggaaggcgttgccatcattccccaggacaggcacagcccctggttcttccatctgaggccagcctctagtactagctatggggaattgcaagccaattaatttattctacacttcatagtttaaatactctgccacatttgaattccgtaataagccagtgtgattggtgttcttgcccccactgtagcaaggctggcccaaggactcaaacccagatccctccaatgtgaaatgcggcgctctttcatttctccatacattgatgagccctcctgcaggcaaaagaataaaaggacaacaatatttgacataaaacattaagcacatgcctctttgttgcagtgatttcttagcctagatagatacttgcttcctagatgatagatagatagatagatagatagatagatagatagatagatattcctatagcctcaaaggttgagtctaggaaattttgagaaaatgctttccttttgccaatgagttcatttatttatacaaccagtatctatttactgagcaactagtatgtgccaggcactgtgctaaacactgggaatataatgatgaacaaaaccagaccatctccatgcttgtgtggagcttagcgttctatgtgggaagaagtaagataatcacatgatcataaaaatcaagggcatgcttgcctggaaattgtacactgagaccacatggagagtgtgggtcgtaaccctgcagggcttcctacgccatcaacacactaagacctttgccgcagaaaaggaagaaggagggccaggacggacattgttgccaaatataaatagtgagaaaagcattttatattccctaaggctccttgacacccactgaacatttctctgtgcacttactcagacgcctaattattcatttactccttctcactcatctaacgtgtgtagtatagcaatctggaatacagactccggtgccagttagattcaaaccggttaaaaccctggtcctgtctgcccagtaactaaccttggacaagttaggttaacttctgtgtgcctcagtcttctcatctgtaaaaatgggcgtaggatatctacttcatagggttgttgagagcattaaaatgcattacaacatataaggcacttagaacaacatagggcacagagtgagctccatgtaagtgctagctcaggatgatgggggtgaggtgatggtggtgatcatggtcatggtggtggtgctgctgctactgtcgatgctgtcgaacaagatgatggtgatggtggtggtggtgctggtgctgctgatgttgttgaagatgataagaatgatgatgaggaggaggatgaggatgatggagatgatgataattttgataaggaggatgagggtgatgaggatgatgatcgtggaggattcttgagtccccaccatgtgccaatgacaccctcggtgcgggtatgcagagaagaacagagaatctgcccccatttttccagtatagtgggagcaaagtccaaaggtgaccacagagccccatacatgtaatggagcaaagaagggcatggaactcccttcccactgaaacacaggacgggactgggctgccacgccctgctccaactcccagtgctagatccaccctgggaaagaaaaggtggcaggggaaagctgtggcttctcttgcaggaaataccatgggaaggcttctgtgccagggatgtgggaaaagggggaatggagcgaaagatggctgttggctccattctgaaagcaccacctgcagcacaatttgtacttactgcttctgccagaggtttgaaagtggccgcagcttcacggtggctcagtggcttggttccagtccaactttccggggcagctggcctggtgcaggaaaggggagcaagctggccagggccccctaaggctgcagacctcacctggatgctaatcctgagtgcctgggtagcttcttcatgtccactgccctgtgggccctatactgtgtgtgatgattgatatgagtcgatgtgtgggccttggagggccttttgtgaatccgtggctaattttttggcgaacaagtagatcaaatgcttgatatttccctttttgttattcaaaattaaaagaaatttgtacctatcaaagcagcaaggacacacattagataaatcaatctttgccattttgtcactcttaattttttgttaatttaattagaatagagatagtcaagtctaggtgtgctaaatcacagaccataaaattctgtaaatcacttcagcatgtaactgggtgtgcgtgtggttgctaattaggaggggcagagctgcggctttggagatgagttcctggcaaggaccctgggttggcaaggagtggaaagactccggggacatgtccaactacctcttgggccactgaagcctctgcctccctgtacccgtcagcgccactgcccagggatggttcagccaggcgagcgtggggatgggcccaggactcacagcctctcctttcctgtgtgagctcccaggataggacatctctgcaggaggcagtactgcaccagctggaagttggaccacccagcttcagcagaacagccctcctatgccccctgcccatcctgcttgcctgttcactatttttttttttttttgagacagagtctcgctctgtcacccaggctagagtgcagtggcgtgatctcggctcactgcaacctccgcctcccaggttcaaactattctcctgcctcagcctcctgagtagcagggactacaggcacatgccaccactcccggctaagtttttgtatttttagtagagacaaggtttcaccgtgttagccaggagcctgttcactattaacaggacacttgattttgccggtcaaaccactgcagcaatatttccagaacaaatacagctgcttagacatttgcttttggcgttttacgtttcaagttgaatctgttgatttcggccttgctgtttgaatagcgtctctgcaggtttattctgggcacttacatttccaaatgtgcaagtactgggctcgcgggccagtgtttgaagtgatgggagccagacaggccagggaagggcccttagaggccactcctcactcacagggagagccccggggggaagagtgctgcctggagagcagcaaacaccaggaaaaaatgaggctgcagaggccaggccagccccgaggcctgttggagacatctctacagcgtgctccacccagcacgatgctccctgctttccaaagtgattctggggtgcccgctccccagcactttctcccaaagctcagctctcaccacccactgctagccactctcttccacatttggcctcccagcactgggcgcctctgacggtctgattgaaatccgaggccctcactggccatttggttgtgtccagtgcggtgctgagcttcgttccacatgcaggagcctcactcactcgctccttctgggctgtgagggcctctgggcacctgggtgttgcgtgtgcctcccccatgctaagggtgctgcagaagcccaccctggctcctccaggctcctccgctcccccagagaatgaaaggcattggccccccaaaggaagtctggcttcacagggaccattgtcaggcagagacacatgcgcacagccccagcccgctggaaggccatctgttgtcagaaaggttgcgttttgagcccgtcttttcatctgggacaagtttgtactgaactggccacatttgtgctaaagacatggttcgtagtcagcttcgcaggcccaagaggcagagctcggttagcatcttgtgcagagtccccgtgatgccctgactcatcatgagcagccgccgtcacccagctgagctgtacagcgagagagagatgcagtgtccggaagacttgggccctctgggaggctgtagccactcagtcatccctgccaaggatggtgggacaatggcagtgtcaaccttgccaaggggctgggtttccagccatggctgggccctcagcctgctcggtggagcatctcatctcccaccccacggtggatgttcttggccttctctctccaactaacatctgccaaggcctcctcctacgcagcgatgcctcccttcctcctaagaaggccgtgcaccttgacgatgggcagatggggttggaggcccagccctcccttcccagcacgtgacctgctgcaagttacttgatccccaccagcctccacctcctccttggtaaaacacaagtggcaacagctcctgtttcccaaggctaagaagtcagtaggaaaatgcataaaaaatactttcccgggtcacttggctccttcctcccctcctaacacccatacaggccactgaaactgttctgagaagtccctgttgccaagtcaaggactttggttccatctcacggcagtctccgctggtgacgttcagtgctgctgcctgctcttgttgccatggtttccatgatgctacatctccggtccctcttatgttcctaactgtttggttcccaatcttctttgctggcttgccctgaaagtcagcagcccctggaaccctgcccttggcttccttctcttcctgggctctcttcctgggtctgtctctgggtggaactcacccattcccatggcttcagtctcccccctccaacgggagacttctctcccacaaatccattactccagactgggctccttcccttgtgtatgctgttgacccctctcattgaacaggcttggaccctaccctgcttcctcccatccaccaaacacctcttcaccaccatttccaccacccagtgactggcttctctctcccaccgacatggcaccaccacacagccaccccaaccaggagacctcacaatcctagtttctgctcgcccttcacttcccaaatccaatcccttattaagaaattcccattctcttctcccatctgttttccatttctgtccaggccaggccgtggggtctctgagcttcacggctgcagctgcccctgccagcaagcagggtcccagctgccctagaccccagccactgtcctgccagggtcccagcctgaggctcacccagcccaggtgcctcctggggcctctcgtgcttctctgcttttcttaaagctggaggcaggttagcgtcaactaacacacacagagaaaaagctgcaaaacaggttttaaaatgtgcacggtgtaaaaatgatagtgggagtttggacacagatgggtaggaggttatgacagggaaagaattttgcttaatcttggaatgaaaaatactctgatcctggcagagtccagtcagaaggaatttccagcaagatctgtcttcttgccacattgtctgcaacacaattgatctttgctttgattgctttcccctccctccccctcacttggcttttcgcagataatgtacagaaagcccctttttgttgttggagcggtttactgggggaggccttcagaatcaacatccagctctcccagtgtgacctcccccttcccctgccaagtcagagatgggctttctttgtctgtgacttgagatcttggagggccttgggttccaatctgagccctgtcactagccttgggtggatgatcactctaaggaccaatttcctttttcatctggaaaatggggatagtagtccctttctccgggggtcgttgtgagaattaagtgaaatgacacagggctttaatggatggtgctgcacctgttgtcatggccactgtggatgtgagcggcagagctgcaaacacgccttgctcctctgaggtcagcccatgccggctgccctttgggtgccagccaggccgttgtgctgcagggaagggaggagaggagcctctcttctgggtgagccagacaaaaaggaacctctcgtggcgtttgtcccagcatcctctgaccgtgagccttccgatgtgcctgcctggtatgaacagaaacgtggatccaacccacactccttcctgatttcaaacgtccctgtgaatcggatgggacgtagttaatagcccctgtcttcctggaaggaaatgttcagggaggactggtgttgggaagctagaggggaggcggcccggccttggagcccagccctgttggtgttgctctctttggccctggtgaacgtcctggccttggtctcctgagtccagggggcctggccagcagcctgccttcctgaggcccaagcccctggttctgactgctgatgcgcctcctgggagcgttcctgcccatctccacttggagttaccaggaactgagttgttggttctgctggcagctcccatcctgtcccatggggggttcagacacggagaccagtgctggaaggccctgaggcctctgagccctccagccagagccagggtgtgcccagtgcatgcactgctgtgtctgcctgggctggtctccccaccagaccgagcttcctgccggactggggcagggccctaacgctctgttgttacactctccatccccgtgccattcagagcctcccagcactgagtaggcactgcacggcgagagggagggggaggaggaagggagtctggctctgtgcctgtccccggctgcctggctctgactgtcagagtcactctgcagcagcacagagcgagtccgctgggtgctgtgagacgaccctggagagatcctcccacccccagctgtctcttctctagcctgttgcccccagctccatccctcctaaccctaccccttggccagctctctgggctctgggctcggcaggagcctctttcccccatgggctcagtcagtgctccccctgcagccctgctgggtctccctggagctcaccatccggactcgggctgtgtgggcactggagttcttgatgtcacacacgtcagcgtgttcccttagcactgtgtgaacacgaccctgtcccctggccggcctgggagatggcaaaaaagaatggagtggctccctggcaggaagtgcaggaaggcaggggcacagccccattgcagcacccctgccagcacaggccagcttctccactgatttgcccttgactgttcccttagaaacagacatgagtggccacaggccgaacgaggctccgtggagagaagtgggggcaggtggtgggtgggtaatttatcttacttactgtagggtgtgggggtagaaagccagggctgaaaatcttgcttctctaggaggtgactaaaggccttcacagtggtctggacaggaaagggtggagtccaagcacagggtccccagaggagtgtggtgaggccgagggaggagggacccaggcaagggaatcttggaggagaaggcaggacagttagcccagactagggtggccggggcaggctctgtgaggctgctgttgggggtcccgtggctgcagagaggtttgctttccaagtcagggccactagtttccctcggatgctatttgtgtcccccgccttccattgtgatgctgcacaataacttttacagcctggcctggtgcctggcctgcagccctgaatcactgattcatctttacctgccgcttccctgccggacggctctgggtgcaggagccaagagcccgggcgacggcgcagggctggttccttcccacttctgcccagtcacttccccaccctctgaggaccctggagaaattcagccagggcctgggcctctaggagctgccaagcctccctctcttaagcaaagcgagcttagggttcacagggccagagcaagagggtgacacaacccgcccagggtgcctgccttctctaagcatctgacacagctcagggacctgctgtcctcaggctcattccaggtgggtgccttggccctgggcctcagaccagcctcccctcagagctctatctggacccttgtgatggatgccattacttgtctgacatgtccccaaaggagcccgcagatcccactgccaacgccagtaccagtgcacggcccaggattggccctgctgcttactactcctgagcccctgcaagtgagttctgctctctgggcctcagtttcctcctgtctacaacagggtcgctagtagtgcctgtggcagtagggttgctgttcagacacccaggctgtgaaaagttcctggaagggaccccaccctacagaaagcactcagtaccaaagaaagcctcatgggtgtaaatgaatctgctccactctgcaaagaaaaagagcacctctcccccacatgcattcctacggggcttgcagccctggtgccctcactggctgccattgagagcctgtgctctgcaccgcccgccaggtgtgccagggtgacgtgactccacaccaagcactgggggctggacttgtttagccatttctctcaagatggccatttctacactttcatgagaaggaggcctcgcctccgttggagtggctgagtggtgcatccagctggttcctgggactggggacaggttttagtgctccgagaatctgggttgttgtttttttttttatggagttttgctcttgttgcccgggctggagtgcagtgacgcgatctcggctcaccgcaacccccacctcccaggttcaagtgattctcctgcctcagcctcccgagtagccgggattacaggcatgtgccaccatgctgggctaattttgtatttttagtagagatggggtttctccatgttggtcaggctggtctccaactcctgacctcaggtgatctgcccacctcggcctcccaaagtgctgggattacaggcatgagctaccacacccggctgtatctggatgttttatgcatccctttacacagtgtgtgtgtgtgtgtgtgtgtgtgtgtgtacatcttcagctgatccttcaaagtctgtgggttttattgtcatcccctttttatagattaggaagctgctgctcagacggattaaatcatttggcccaggtcatatggctaaggggcgcttggtgtcccgcacttctggagatacaattaacatatggtaaaaattccgactttctgtggccattctgagagctttggcaaatgtatgtggtttccatcagcttggtccagtgatcaccaccacaatcaatatggagatggtttctatcagctcaaaaactcactgcacctctttgtcagataagctgctcggcgtactccagcctctgggaatgaatggcctgttttcagtccctatagcattgccttttccagaatgtcatataaatgaaatcatacaggatgtggccttttgagtctggcttctttcgccagacataatgatcctgagatttatccatgtagttgcatgtatcagtacttccttcctttttatgggtgagtggtgttccatggtgtggatatacagcaatttgtttaaccattcacctattgaaggatgtctgggctgtttccagttgacattacatgccaaggactctacacatttgcatacaggttttggtgtcatcatacatttttatttctcttgggaaaatatatagaggtaagattgccaggtcgtatagtaaatctgtttaacttaatgagaaactacccaactgtgttccaaagagactactactttgcattcccatcaggaatatataagagttttagttggctgggcactgtggctcatgcctgtaattccaacactttgggaggccaaggtgagaggattgcttgaggccaggagtttgagaccctccaaacctcaacatggtgagacccccatcttttttttttttttttgagtcagttttgctcttgttacccaggctggaacgcaatggtgcaatctcagctcaccgcaacctccacctcccaggttcaagtgattctcctgcctcagcctcaggagtagctgggattacaggcatgtgccaccacacccagctgattttgtatttttagtagagtccgggtttctccatgttggtcaggctggtcccgaactcccaacctcaggtgatccacctgccttggcctcccaaagtgctgggattacaggcatgagccacggcacccggccaagacccccatctttacaatttttttttaattagctggaggtgggcgcaatagctcatgctgtaatcctagcattttgggaggccaaggtgggtggattgcctgagctcaggagttcgagaccagcctgggcaacatggcaaaacccgtctctactaaaaatataaaaaattagccgggtgtggtggcaggcacctgtagtcccagctacttgggaggctgaggcatgagaattgcttgaacccggaaggcagagattgcagtgagccgagatcacgccactgagctccagcctggacgacagagactctgtctcgatcaatcaatcaatcaatcaatcaatctataagctgagtgtggtggttagtgcacacctgtagtcccagctacttgggaagctgaggcgagaggatcatttgaggtcaggagttcgaggctgcagtgagctatgatcgcgccactgcgttccagcctggatgacagagtgatactatatctcttaaaaaaaaaaaaaaagttttagttgctccacatccttgccagcatttagtattgttgtttttaaagctattctaataggtacatagtatttcatcaagattttggtttccatttccctaatgactgatgttttttcatgtacttgcttatatgccatctgtatgtttactttagtggggtgtccaaatttctgtggtctgtttttcatttttgttttgttttgtttttgaggcagggtcctactctgttacccaggctggagtgcagtggtgtgaccaccagctcactgcagccttgacctcctgggctcaagcaatcctctagtctcagcctttcgagtagctgagaccacaggcatgcaccaccacacccagctaattttttatttattttttcttttttttgtagagatagggtctccctatgttgcccaggctggtctccaactcctgggctaaagtgatcctcctgtcccagccttgtttgttttttcttttctttttttggctttcacatttaattgacacaggataattgtacatgtttatgggatacagtgcaatgttttgacacatgtatacattgtgtaatgatcaaatcacagtatttagcatatttagcacctcacacatataccatttctttgaggtgaaaacatttaaaatcctctcttttagctatttcgaaatatagaatacaatattgttaaccatagtctccctagtatgctatcaaacactagaaattattccttttatctaactgtatttttatactcattaaccaacccctcttcatcctccctctccaggttctggtaaccactattctactctctacgtctatgagatcaacttcttaagattccacatatggatgagatcatgcagtgtttgtctttctgtgccaggcttatttcacttaacaaaatgtcctctaggtaggttcatccatgttgctacaaatggcaggatttcattcttttttatgactgaagagtattccattgtgtatatgtaccacattttctttatacattcatctgctgatgaacacttaggttgattctatgtcttggctattgtgaatagtgctgcaataaacatgggagtgcagatataatgatttcgtttgctttggatgtatatattcagtagtaggattgctgaatcatatggtagttctatttttaattttttgaggaacttccaaaatgttttccataatggctgtactaatttacattcctaccaaaagtgtatgagattccccctttctccacatttatgccagcttttgttattttttgcctctttgattagccattctaattggggtaaggtgatatctcattgtggttttgacttgcatttccctgatgattagtgatgttgagcatttttaaaatgtacttgttgaccatttgtatgctgtcttttgagaaatgtctattcaggttttttgcccactttttaatcagattatttgttttcttgctactgagttatttgagttccttatacattctggatattaagcccttgtcagatacacagtttgcaaatattttctcctattctgcagcttgtcttttcactctgtttattgtttcctttgctgtgcagaagctttttaaatttgatgtaatcccatttgtctattgttccttttgttgcctatgcttttgaggtattatttttaaaaaatccttacccagaccaatatcatgaagcatttcccctatattttcttgtagttgtgtgtgtgtgtgtgtgtgtgtgtgtgtgtctgtgtgtgtgtctgtgtgtgtggtgtttctttttttttcttttttttttgttttctgagatggagtttcgctcttcttgaccaggctgcaatgcagtggtgcaatctcagctcactgcaacctctgcctcctgggttcaagctattcttctgcctcagcgtcccaagtagccaggactacaggtgtccgccaccacgcctggttaacttttgtgtttttggtagagaaggggtttcaccatgttgtccaggctggtctcaaactcctgacctcgggtgatccacccgcctcagcctcccaaagtgctgggattacaggcgtgagccaccgcacctggcctcttctagtagttttattgtttcagttcttacatataagaatatttaatccattttgtttttttgtatggtgagagataggctctaatttcattgttatgcatgtagatgtccagttttcccagcaaaacttactgaaaagactgccctttccccagtgtgtattattgttgcctttgttgaaaattggttccctgtaagtacacagatttatttctgtgttctctattctgttccattcgtctatatgtctgtgtttatggtggtgccatgctgttttgattattatagctttgttgtatattttgaaggtaggtaatgtgatggaccctctggctttattcattttactcaaaattgatttcactattcagagtcttttatggttccatatgaatttcctgattgttttatctgtttctatgaacaatgttattggtattttgatacaggttgcatcaaacctatagattgatttgggtaatgtgaacattttaacaatatcaattcttccaatccatgaatatgggatatcttttcatttatttgtgtcctcttccatttcttatatcaatttttttatagttttcattgtagaactctgtgacctctttgcttaaatttattactaggtaccttagttttttggtagctatggtaaatggggttgtttcttgatttctttttcagataattcactattggcatataaaaaaacctcctgatttttatttcctacaactttactgaattcatttattagttctaatgggtcttttttggtggagtctttagggttttctttatataagatcatgtcatctgcaaacagggatgttatggtttggatatttgacccctccaaagctcatattgaaatttgatatccactgttggagatgggacctaatgggaggtgtttgggtcatgcaggcagatccctcatgaatgacttggtgtcatcctcgcagtaatgagggaattcgtgttctattagttcccacgatagcttgttcaaaagagcctggcacattccctcacacctctctcttgcctcctctctcatcaagtgatctctgcacacactggctctctttcctcttccaccatgagtggaaaaagcttgaggccctcactagatgcagatgctgacactaagctttttgtacagcctgtagagccatgagctaaataaatctcttttctttacaagttacctagcctcaggtattcctttatagcaatacaaatagactaagacaggaacaatgtgagtttgtattttccaacttggttgccctttatttctttctcttgcctaattgcactagctaaaacttccagtactgttttgaataaaagtggtaaaagagggcatcattgtcttattccagatcttagaagaaaagcatttaattttttccagttcaatatgatgttagctgtgtgtttgtcatatatgacctttattgtgttgaggtacatttcctgtatatctgatttttaaagagttgtatgatgaagggatgtcaaattttatcaaatgctttttctgtgtctactgaagtgattatatagtttttgtccttgattatgttaatgtgatgtatcatgcttattgacttgcatatgttgaaccatccttgcatccctgggatgagtaccacttgatcatggttaatgatctctttaatgtactgttgaattcagtttgctagtattttgttgaggacttttgcatctgttttcatcatgtagattggcctgcagttttcttttctgtgtgagtgtgttcttttctggttttggtatcagggtaatgccagcctcacagaatgagtttggaagaattccctcttaattttttggaatcgtttggaaaacattggtaatagttatttaaatatttggtagaactcagcaatgaagtcatcaggtcctggacttttctttgataggagattttattattaatttaactcattactcattattcatttgttccaattttctatttcttcataattcaattttattaggttgtatgtgttcagaaatttttccatttcctctaagttttccaatttgttgccatatagttgttcataatagtctcttatgatcctttgtatttctgtggtatcacctataatgttgccttttcatctctgattttttttaaatttgagttttctctctttgttccttaggtagtctagagaacagtttgttgatttttttgtatcaatatatcaacaaaacaaagaaaaccaacctttattttgttgatatattgtattgggttttggtctctattttgtttattcctgctctcatctctattttttattgctatctactaattctgggtttagcttgttcttgtttttctagttccctgaagtgcaatgttaaatttttttatttgagatctttctacttttttgatataggcatttattgctataaacttctctcttagaacttgtattccataggttgtggtatgttatgtttccatttttaatttgtcccaagaattttgtcattgatccattggtaattcatgggcgtgttgtttaattttcatgtattcatatggcttccaaagtttctcctgttattgatttttagttttattccattatgatcagaaaagatacatgatattatttttatttaaaaaaactttttgagacttgttttgtgacctaagtaacatatggcctatcttggagaaagtgccatgtgctgtagagaagaatgtatattctgcagctgctggataaaatgttctgtaaatgttttttaggtccatttgatctagagtttagtttaaatataatgtttctatgttgattttcagtctggatgatctgttcattgctgaatgtggggctggatattggagtctcctactattattgtattgcaatctatctcttccttcagaagttagatataataatattgctctctctctctctctctctctctctctctctctctctctatatatatatatatatatatatatatatatatatatatatatatttgcttaatatatctgggtgccccaatgttgggtgcatgtgtatttataaacattatatcctgtgatgaattgaccactttattattatatagcgagtgtctttttctctttttacagcttttgatttaaagtctgttttatctgatataagtatggctactcctgcactcttttattttccatttgcatggaatatcattttccatctgcatggaatatcattttccatccctttactttcagtttattagtgtccttacaggtgaactgaatctcttgtaggcagcacatagtcaagttgtgttttcttatccattcagccactctgtatcttttacctgggaaacttaatccatttacattgaatttattccataagttggtggaataaatctatcaatttattattgataggtaaggacttactcctgccatttttaagtgttttttggctcttttgtacatcctgtgttcctttctttctctcttattgtttacctttgaggtttggtgattttctataatagtaagctttgattcctttctctttttcatttgtgtatctgctatagttttttcctttgtagttactacggggtttacattaacaatcttagagttatagtatactattttaagttgataataacttatctttggctacatttaaatattccagacttttaccctaaccactcccccatttttaattttgttgcttaatttatatctttttatattttgtgttccttagcaacttattttagcatagttattgttgatcattttgacttttaaccttctgctgtagtttggatatgtttgtccctcaaacctcatgctgaaatttgatccccaatgttggaagtaggacctaatgggaggtgtttgtatcatgggggtggatccttcatgaaaggtttggttctgttctcatggtaatgaatgcgttcttgctctgttagtttctgtgagagttcccccaagagctcattgtttaaaatagcctggcacctttgctctctctcttgcatttatttatcaccaagtgatctttgcacattcctgcttccattttccttcctgccatgagtggaagcagcctgtagccctcaccagaagcagatggtgatgccatgcttctaatacagcctgtagaaccatgagctaaataaacctcttttctttataagctacccagcctcaggtattcctttatagcaacacaaaaatggactaaggcaccttcatactagaggtttgaaaaagtatgtatcatcattacagtaatatagtattctgaatttgataacaaatttatctgcacccgtgagattatgctttcatatgtttcacaatagtaattattgttcctttacttctggttgaagtactcccttaagtatttcttgtgaggttggtctagtggtgatgaataccctcagctttgcttgtctgggacagactatttctccttcatttctgaaagatagttttgttgggcataatattctaggctggcaggttttttttcttccagcactttgaatatattatcccattctctcctggtctgcaaggtttgtgctgagaaatctgctgatagtttaatggggattttcttataatgacttcatgcttttatcttgcaccttttaaaattctctctgtctctgacttttgacagtttaattataatgttccttggagaggacctctttgggttgaacctgtttgaggtcttttgagcttcatggatctagatgtccatatctctatcaagacttggacaattttcaactattattttgttaaataagatttctgtgccttttaccaactgttagtcctctgaaaacctcataatgaagatatttgtcagcttaattgtgtcccacaagtcctataagctttgtttactctttttgattctgttttctcttttgtactgtgggttatttcaaaagacatgtctttaagtttagaaattcttatttctacttgatctagtctgctgctgatgttctcaattacatttttaattttattcattgaattcttcagctgtaagactttgtttggttctttttttatatacatctatctctttgttgaatttctcattcagatcatgatttgttttcctgatttcattgaattctttacccatgttctcttttacctcactgagttcccttaagataattatattgagctttttccaggcaatttgtaaatttctatttctttggggtcagttagtggagaggtattgtttctctgatggtgtcatatttctttgttgtttttttttcatgtttgttgtgttcctgcatagatagctgtacatctggtggaatggtcacctctcccaattttatagggtggctttcatagggaaagactttcatcttcagatatgtcctagagtatacgttgggtagggtgcattggctttggttccaggtaggcacagtagtaatctctatgaagtttcttttgctgtatcaatatcagtgatgcctgtgagtacctcagtggcctaggctgctagagtttgtgtggctgatccaccccacttgggtgctgctcctgtggaagtggggcaccagactagtttgcatgctgagggagtatttcaagagttctttatatattctagatacaagtcatttatcattatgtgatttgcaaatattgtctttgagtctatagcttatcatcttattctcattttattcccttaatgttgtgtctttcaaagaataggtgttcttaattttgatgaagtaaaatggatcaatttgttcatttatgaattgtgtttttggtgtcatatctaagcaatctttgcctcattcaagatcacaaacattttctatcctttttctagttttataattttatattatgtctatgatctgctttgcattaacatttgtatacggtgcaaggtatagattaagaagtgtttttctttttaatgtatgggtatacaaattttcagtaccatttattgaaatgactgtcctttttccattgaattgcctttgcacttttgttgaaaatcaattggtcatatatgtgtgattctgtttctagactagttcattgataactacccctttgccaattctatactaccttgattactgtattattatggtaagtcttgaaatcacgtagaatgtcttccaacttcattctttttcaaaaattgctttggaaattctgcttcctttgcattttcatataaaatttagaattagtttgttcacttctaaaaaaaaaaatccttctgggaatttaatcggaactgcattgaatctatagatcagtttggggagaattaacgtaactattgggtcttcacatcaacatggtatgtttctccatttatttaggtctcctttgatttctttcattagtgctctctagttttcagcatccagatcttaaacatatttagtttgattcattattaacttttttgttgctatcataaatgatactgttttttcctcatttccaattttacattgctgttatataaaaatgcagtttatttttggttgttgtatattgacctgagcttaggtctttatggctccacatccagctctatgcttcccactccccaccctctaggctgtttccttagcagcaggagcagccctgggaactaggttactatgttatgatccccatgcctgactctgagtcaccttaaaggagtgagtcaccagcctctcttgcagtagttttcctctccctaaagcaaggattaaaccacttgctctcttattgctcccaggaatgttaaagatgagtgactaaggcagcaagggtgtcagcactctgacatgaatagtttgacgtaattgagacctggtagttttgtgggttttttcctaatccaggtgttattgtcaattacatgttgggaaaaagagataaaggtgggatgagtcaggagacagctgctcacactctgtaggtctccagcggctttcctccaccctctcacacagcctcagaagacccctggtcctcccttgttttgcctactctcccaacccaaaagtacctctttctcccctcacctttctattttaaccatctgagagatccagcttgagccttccctcctcaccttcttctgctgcatgacattacccagcacctgtcaatctccctgaggccatgataggcagcactgtcccccagcttggggttagatatctgtcccatcgcccaaaaatatgaacgtgaggagggcatcttttctgtggcctgtcatagggcccattatatgctgcagtcgtgatgggggcttaacaaataagtaagtaaagccacgctatgctcagggtctgcagcttttccttcccctcctttctttgtggtttgcagttgtcttgggagggccttctgtctgggtttgacagtgaacatgagtaaagtgagcaggggctttggcaagaagagtggtgagcagaagctggtggagacttgggggctgcacaggacctaacttttgaaactgaaagcaaagtcaagtctaaaatacatcacattaaccctcttttggtctgtctgtctctttctcagacagtgtccctgctgagagtaagaagtgttctcaaagccttttccacagcaggaatggggcacgcgggactcgcatccattcattcacaaaatggtacctggtacagagtaagggattagagaatattgtttgaataaatgaacaaatgattctgccttatgtgccaggcactgtgctagctctttgggacactaagatgaatagaaaatgatattaatcacccaggcgcggtggctcacgcctataatcccagcaccttgggaggcctaggtggggggatcagctgaggtcaggagttcgagaccagcctgcccaacatggcaaaaccccgtctctactaaaaatacaaaaaattagccaggcgtgatgacgggtgcctgtaatcccagctactcgagaggctgagacaggagaatcgcttgaacccaggaggcggaggttgaaccaggatcgtaccactgcactccagcctgggcaacaagaatgaaactccatctcaaaaaaaagaaagaaaatgatattaatccccaagcagctcatggcctagtgagggaggcagatacaaacatataaataacactctgtggggaatcccagtgagagagatctctttaagtgtatgtagcgagatcagagagcggaaagtacctcctggaagatgtaacactaggctttcaagaatgagtaggagctggtcaggtgttagtgaaggggtgaaggggaagaggcacagggacaacctgagtgtggggatggggagcagcatggtgctttggtggtgctaccggcaaaggtgagtagtctgtggtgttccctctgaagccgaggaccaccaccagccctatggctgcagggtcagcactgcacctgggaccatctagaacctggttgatctggcatgggaagaagttgttgagtgataacaggtgctggcttctgtgctgaggcttccagaggtcctcagtgaatcctcaccgcaaccccccaagggacgtaccaggactagtcattttacaagtgaggaaatgggtgcagggaggcaaaggagcttccccaaggtctctggcttctcagtggcagagtccgggcccctgacccctgcgggatcctacctgcctagagtgctcctggagagcagcggggagggatgctgtttactgaacaccttttgtggcttggtgctgggctgggcagcagatatctgtgatctcattttattctcacaaatatatgggtgggtggttttatctgcattttacaagggaggacactgccccatccgatgtcacagtttttgactcagagatccccactcccgacaccacccacactcttgtccctccatggcccattggccaacgagctcgccacgctctggacccgtttctgaacctctttctggggttggcgccaactcccggaagatgcctttgtacttgctttttctactcagacctcactctggccactgagcctctccaaaagcctcctccaacacccaacaccctattccgtacaattctatatgcatttgaaatgggcttctgatgtcctctggtgttggtcacccccaagtgtccacgagaaggtgagcccctttgggcagagaccaccttttgtgcgggcttcccgaggagagtggcctgttgccacgcacagagctgatgggaaatgtgagctctggagttgtggggtgacactgtctatgttgtatcgttgctggagaatttgctggcccaggagttttggggaccctctcctcagcttgagctgcaggcccacgtccgtcccctcaccctggctccccaggagtcctgctgagggcttcctataggaagccaagctctgagacatggagccaccctcaccagagccgcctacgggaaaggaagagccagcctcctttcctttggggcagctggaagacaatgtacaacacattttgagaaagtctctgcagaacaagaaaattgacaaatactttcaggtctgtagtcaaaggaatctggagtatgctgcctccttagttcatgactagcagaaaataaaagggtctttttttgtttgttttttggggtttgtttgtttgttttttctgttttttgttttttttagtataacaatgacttatacagttgaggtgaagtgaaaatatcattacaatagaggtgacattaacttgctaccgattgtgcctggtactcattgcaggtaagaggtgagccatgctgttggaggctggtctctgtgggctaagaggtccccgggccttccctcctccctcacttcctgcaggcaagtaggatgcgtcctccatggagtctctgcattttctaactcaataatggagtcagatatcccggtagaggaccaggcttgggggccacaagatgggcctaaaagcgcatcttgaaggcctagtgtcacctcctccaggacttccttggtacttctctctctctgatttcactatatacacttagaaaaaaagcttttcttttctttttttttggtttgtttgctgttgttgttattttgagatagggtctcactctgtcacccaggctggagtgcagtagcacgatcatggctcccttcagccttaacttctcaggctcaagcaatcctcccacttcagcctccagaatagttgatactacaggcatgtgccaccatgcctggctaatttttgtatttttttttagagacaggggatcaccatgttgcccaggctgatcttgaactcctaggctcaagtcatctgcccaccttggcctcccacagtgctgggattacaggtgtaagtcaccatacccggcctgcaacaagctttgatcttgaacatgtgagttatttttaccaggcctcagtttcctgatctgtaaatgggtataacaccacaccgggtggatgtgaggcttccacacactgataggtcaacagcagtgcagtgccctggaggaggaccaagcatgcctcagtgttgaaagagtaactaactaggtgctggctgaggacagcacctccccagctgttgggggacagaagggggcaccgttctcgaagcagctgccctgctgttggggatttgggggattttgctgttgtgagggtgagccctaccgtctgcaccccctgctcgggccccggcactgcagtgggagactcacagaacactctggacagaggttaaatggtgaggaacaggggtccccacaatggcagagctggagcttctgcagcagcatgggctcctggtgcctgtcacttcctgtgataagtaaatcttgtccagtctccagattgctttggctccagaggatgagaagggctatgccaagtgggcaatgtcctgggcatggcagagagggggccatgatatggaccaagaagcatgaaccagcttttacagtatccagcaccaggggtgccccaaaccctagactctgacaaggaaggacgaggctgtttcagagcacagttggcaccacagctaaccagtagtaagtgttcctgaaaggtaggacatgaggccagaagccactatgcagggcagtcctccacgtcttagatgaacaatcgggatagggaagggcctgaaaattctttttatactggacactcggagagtgtctttggtttgacaacaatatccatggctttgccttttctcaccatcttcaattgctcacatgtccatgcaggtgtacacacacatgcacaggcacacacatgcacacaagcacacacggatgtacacacacacacatgcatgcagacacacacgagcacacacacgcacacacatgcacacagagagatgcatacatgtatacacaagcagggcttacgtgtaaaggggactacttcctaaggcccctgggcctgggcggcggctctacccagaagcatttgtgtcctgtcactccccaggtggcccactgctgcccccacagcccccctcccgacaatgggtagagttactcaggcttttcaaaaaacctcacctgagtttctgccagttttctttctgagtgatatttgcataaaccactcctaagacacgcacatccaactgtgagaggggacattctgaggcctcatcagtttcatgtctcagcccccaaccacctgtctcctgggctttggtagagcttggaactaagtgcccgcagcccggcggcacatgcaaccttgcacttagtgcgagagacatcaggcggctgctgaacactgctcgattcattgaaggcaggcggccaagcaggcccttctgagcaggttctggtgccatcgccgctcggccccatgcataggttagtgataatatgctccttcctacccagcctccctgaagcacctgtcgactggcaaggttactaaaagaactgacttggggggctcatggctgctggggtagtaactgcaggggaagatacagaggctattaaagccagggcctttggtgcagcccaggctcggggagggcacaggctgtcttgggggaccacagacaggcacctgcatgcagtgtgtgactggagggtctgggaagggccctgctctgtggggcccctcactcctcactctgaagtctgaagtctcagggctgaggaagaggccacccatggtgagttgggaggagctgagctgccctagagagtggagccaccttgagggagttggttccctgtgttggcctcacctccccacccccaaatgcaaaggacatgggtgggtgttggggggtgactgcaaaggtggtctctaggcccctctggctttaagaatgaaagccctttgatttgcactgagacagcgcgtctccgtccaacgcactggggatgcccgtgccagcctgcaggtctctgccaggcatgttcacgaggtgctgcttggttttagaagggagcctgatgcccaggccaaggtccaggcatggatgtaggtgaccaaggccatcgcagggcattgggggcctggggacagtcccccaggaagggagggagccagggccatcttgcattctatcccatttttaccttggcctaccctgcattcaacgaaggttctcccaagcccactggagaggacttgtttgcttcttagaggagccagaagttctcaacaaacaccaatgcaagcagagagctggccaaagaccctgagtgggagaaaggttggaagcaggcctggcaccggccacgaggcctggtcgtgggtgctctctgtcccgcctgctccgtccaggaggcatctcagggacagagctcatggtggtcctctggcccatgtcaggtgtcatctgaacgaagtggttgcaagtggctcagggggaaatcggagaccagggcccccggcaagcctggcgatggcggggcagacagagactcctgagaatagggaccaagcatgtctgcgttagctttgcatctttgtgctcagcaaggacttggcacagaacagctgctccgcgtgtctgtggagtaagaggtggagcccctgagccttctgcgagcagcggggctggtggggtcccagtcattaggagcagcccctcccctcctccccatgcctcgcctcgctcctgccaggtgtgctgtcttggccaggcctctgctgacctcagctgtctctatgtcctgagccgcttggccacttgtgggagcctcagaggagatgtagggacagggtagggaggaggaagccaccctgggcagcacctctgccctggctggagtctccctgctgagccacagcttcacaggctgctctcgattttggtgatggtgccaggtgggcatgcatggctatcagcttctgggcactgccatctacagtaagccctgggcgccaggcggcctgggtcctcagcctccatagcacgccttgctgggcaagcatcagagccgagaggacaatggtgatcatctagttcatctctctgaattggcaggtggggaaactgaggccccaagtctggcactcattggcagcagggcccacggttccccctcccactcacacaccttcctttgccaccccttggtgcctgtctgctcagcgccagccaggtgttccaacctccctgcccatatgaaagcaacagaggccagaggctgctccagaacactcctcctgtcccagcctcccctggccctcagcagacaacacctaggcgctcctttaagtacctgcctgtggccctctctccaaggtcgtgaccacggcagcctgagagaaggagctacacatggagcccaagggctctgacctcccagcagtgagctgctgagaggctgagaagaaaactgggtccacctactcagggcatgcaggctggacttccgtcatctactagacaatcccagatggagagacagagcggaccaagagggggatggtgggaaagagcacgacctgattgtccgaatacttcttcttggagggaggagagcccactgtcagcccaagatgtccggagacccctggcctccatcagagctggcccttctgtcctgcaggggaggccttccatcctgcccctctggccaccagccactaagcttaccagtcccttagccctacaggctggtcgagagcctggccagtgggaaatgagacccacgccccgcccttgagggcagagtccagcatgaggactcacctgacacttgcaggctcccaagggcttcctgggccatggctggcatttcgtgactatcacctgtcccaggtttgacttcccacttgactgtgctgagccctcccagctgcccacggggtaggagggattgccgtctccacagggaggaacaagggctcagagaagctaattctgcccaaggccaccagctcacacaggacaagagactaggaccccctcatttagctttcaaatgcaaaataaattaatttttttgttctcagagggaaacccccaactcctcacctcatttttctctcctgggcacctcagcaaggtgacacccaagttcttttggaatcggacaaatcattgcagggtctttcaagctcaagggaccctgttgatgggtgggctgaggcctggacctggccaagaacaggaggtcaggagagttactgagcaggaaggagccgggtaccctcagctgttgctttctgccactgcctcaagacagacagcttcgaagggaatgggggccagtaggtttgtgtttcaaagagcaaaggatgtggctggaggcttttctccagttgctctcccctccttgaaggaaagcagtaaggatttgttacagttgattttaaagtgagctgtaaatgcgtaaacttaggttaaggcagaattggaaaaggactagattgggcatttttcactggagtacagcctggacctgggaaatagagacagaatggggaagaaagaaccaaagacgtgggcatgagcccccaaaaactggtggacatggggcccagggcctgcggcagagctgccccctgagctgctgggtgagggtcccacccctcaccgtcacctggctcgagcctctgaatggccagggcccctcccgcctgtcgtcaggagcccacgtgggtgcagagtgacacgtggagcccatctgatggcttttgcgtttgaacaggccagaccacaattcctgattcagcaacatcttcaaagatttgataaccatagaaacaataactctttgcaaaaaaggaaaaggagacaccatcacccaaagagggagaggaggccctggtgaatatttatgaccagaggctacagaattcagaatgtacttatctcagctcaggttgaagaactcgtgacctgagagtccttgagtgtggaccacttgatgacgtccccacagcccatgtagcggggctggaaatacggagccctgaagcttgcaggcgctttaatgccttcaaaatgcagatgctgtggaaaagcagggcgttctgggcccacacggggcgctctgctgggagatacttgctagttgtgtcactaaaggggttgtgggttcccaacgtgcatggagggtgggcgtctgtgtgtgtgtgtgtgtgtgtgtgtgtatgtctgtgtgtatgtgtgtatatgtgtgtatgtctgtgtgtgtatgtgtgtgtatatgtgtttgtgtatgtgtgtgtatgtctgtgtgtgtgtgtgcacccacatccatgcacgttttagtgtcttttttggagaagcaaatagactccataatatattcgattctcaccacggtcatcctggttttctaagctattatcttgctctgttcctctggataaggagccagctgcttcagaacaggtcctcacactctttccatcactgtggtttggaggggccgcgtcggaccctgggatggcaagttcagtcatttcgaagcctccctggggcatgagcaggggtccccctctttggcgcaatgacagttctagtccccgactgacgcaggatgtttcagcgtcctataagagaccatcctggccaacatggtgaaaccccatgtctactgaaaacacaaaagattagccgggcgtggtgacacggccctgtaatcccagctactcaggaggctgaggcaggagaatcgatagaacctgggaggcggaggttgcagtgagccgagattgcaccactgcactccagcctggtgagactctgcctcaaaaaaaaaaaaaaaaaaaaaaaaaaaggaattagtatcaagttaaataactttctttttttttaagccatgattcagaagaccgaggacacccttgctggcagctgatctttgaagaagtaccagctcagagagagactcttggcccatgtcaggactcaacaaatgtggctgaatgaacgaatgaatgattgtgatgggataaagccagcttttcctttttttattttattttattattattatactttaagttttagggtacatgtgcacaatgtgcaggtttgttacatatgtatacatgggccatgttggtgtactgcaaccattaactcgtcatttagcattaggtatatctcctaatgctatccctcccccctccccccaccccacaacagtcctcggagtgtgatgttccccttcctgtgtccatgtgttctcattgttcaattcccacctatgagtgagaacatgcggtgtttggttttttgtccttgccatagtttgctgagaatgatgatttccagtttcatccatgtccctgcaaaggacatgaactcatcattttttatggctgcatagtattccatggggtatatgtgccacattttcttactccagtctatcgttgttggacatttgggttggttccaagtctttgctatcgtgaatagtgctgcaataaacatacgtgtgcgtgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctggtggccagtgatggtgagcattgtttcatgtgttttttggctgcataaatatcttcttttgagaagtgtctgttcatatccttcgcccactttttgatggggttgtttttttcttgtaaatttgtttgagttcattgtagattctggttattagccctttgtcagatgagtaggttgcgaaaattttctcccattttgtaggttgcctgttcactctgatggtagtttcttttgctgtgcagaaactctttagtttaatgagatcccatttgtcaattttggcttttgttgccattgcttttggtgttttagacatgaagtccttgcccatgcctatgtcctgaatggtattgcctaggttttcttctagggtttttatgcttttaggtctaacatgtaagtctttaatccatcttgaattaatttttgtttaaggtgtaaggaagggatccagtttcagctttctacatatggctagccagttttcccagcaccatttattaaatagggaatcctttccccattgcttgtttttctcaggtttgtcaaagatcagatagttgtagacatgcagcattatttctgagggctctgttctgttccattgatctatatctctgttttggtaccagtaccatgctgttttggttactgtagccttgtagtatagtttgaagtcaggtagtgtgatgcctccgcctttgttcttttggcttaagattgacttggtgatgcgggctcttttttggttccatatgaactttaaagtagttttttccaattctgtgaagaaagccattggtagcttgatggggatggcattgaatctataaattaccttgggcagtatggccattttcacgatattgattcttccaacccatgagcatggaatgttcttccatttgtttgtatcctcttttatttcattgagcagtggtttgtagttctccttgaagaggtccttcatgtcccttgtaagttggattcctaggtattttattctccttgaagcaattgtgaatgggagttcattcatgatttggctctctgtttgtctgttattggtgtataagaatgcttgtgatttttgcacattgattttgtatcctgagactttgctgaagttgcttatcagcttaaggagattttgggctgagacaatggggttttctagatatacaatcatgtcatctgcaaacaaggacaatttgacttcctcttttcctaattgaataccctttatttccttctcctgcctaattgccctggccagaacttccaacactaggttgaataggagtggtgagagagggcatccctgtcttgtgccagttttcaaagggaatgcttccagtttttgcccattcagtatgatattggctgtgggtttgtcatagataactcttatgattttgacgtacatcccatcaatacctaatttattgagagcttttagcatgaagggttgttgaattttgtcaaaggccttttctgcatctattgagataatcatgtggtttttgtctttggttctgtttatatgctggattacatttattgatttgggtatgttgaaccagccttgcatcccagggatgaagcccacttgatcatggtggataagctttttgatgtgctgctggattcggtttgccagtgttttattgaggatttttgcatcaatgttcatcaaggatattggtctaaaattctctttttttggttgtatctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgcgtcgaggaatttatccatttcttctagattttctagtttatttgcgtagaggtgtttgtagtattctctgatggtattttgtatttctgtgggatcggtggtgatatcccctttatcattttttattgtgtctgtttgattcttctctcttttcttctttattattcttgctagcggtctatcaattttgttgatcttttaaaaaaaccagctcctggattcattaattttttgaagggttttttgtgtctctatttccttcagttctgctctgattttagttatttcttgccttctgctagcttttgaatgtgtttgttcttgcttttctagttcttttaattgtgatgttagggtgtcaattttggatctttcctgctttcttctgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcagttttgagtgagtttctgaatcctgagttctagtttgattgcactgtggtctgagagacagtttgttataatttctgttcttttacatttgctgaggagtgctttacttccaactatgtggtcaattttggaataggtgtggtgtggtgctgaaaaaaatgtatattctgttgatttggggtggagagctctgtagacatctattaggtctgcttggtgcagagctgagttcaattcctgggtatccttgttaactttctgtctcgttgatctttctaatgttgacagtggggtgttaaattctcccattattattgtgtgggagtctaagtctctttgtaggtcactcaggacttgctttatgaatctgggtgctcctgtattgggtgcatatatatttaggatagttagctcttcttgttgaattgattcctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtttctgcacatgagatgggtttcctgaatacagcacactgatgggtcttgactctttatccaatttgccagtctgtgtcttttaattggagcatttagcccatttacatttaaagttaatattattatgtgtgaatttgatcctgtcattatgatgttagctggttattttgctcattagttgatgcagtttcttcctagccttgatggtctttacaatttggcatgtttttgcagtggctggtactggttgttcctttccatgtttagtgcttccttcaggagctcttttagggcaggcctggcggtgacaaaatctctcagcgtttgcttgtctgtaaagtactttatttctccttcacttatgaagcttagtttggctggatatgaaattctgggttgaaaattcttttttttaagaatgttgaatattggcccccactctcttctggcttgtagagtttctgctgagagatccgctgttagtctgatgggcttccctttgtgggtaacccgacctttctctctggctgcccttaatattttttccttcatttcaactttggtgaatctgacaattatgtgtcttggagttgctcttctcgaggagtatctttgtggcattctctgtatttcctgaatctgaatgttggcctgccttgctagtttggggaagttctcctggataatatcctgcagagtgttttccaacttggttccattctccccgtcactttcaggcacaccaatcagacgtagatttggtcttttcacatagtcttatatttcttggagacttttttcgtttctttttattcttttttctctaaacttctcttctcgcttcatttcattcatttgatcttccatcactgataccctttcttccagttgattgcattggctcctgaggcttttgcattcttcacgtagttctcgagccttggctttcagctccatcagctccattaagcacttctctgcattggttattctagttatacattcatctaattttttttcaaagtttttaacttctttgccattggtttgaatttcctcctgtagctcggagtagtttgattgtctgaagacttcttctctcaactcgtcaaagtcattctccgtccagctttgttccattgctgatgagtaactatgttcctttggaggaggagaggtgctctgctttttagagtttcagcttttctgctctgttttttccccatctttgtggttttatctacttttggtctttgatgatggtgatgtacagatgggtttttggtgtggatgtcctttctgtttgttagttttccttctaacagacaggaccctcagctgcaggtctgtcggagtttgctagaggtccactccagatcctgtttgcctgggtatcagcagcagtggctgcagaacagcggtggctgtagaacagcagattttcgtgaaccgcaaatgctgctgcctgatcgttcctctggaagttttgtctcagaggagtacccggccgtgtgaggtgtcagtctgcccctactggggggtgcctcccagttaggctgctcaggggtcagggacccacttgaggaggcagtctgcccgttctcagatctccagctgcgtgctgggagaaccactactctcttcaaagctgtcagacagggacgtttaagtctgcagaggttactgctatctttttgtttgtctgtgccctgcccccagaggtggagtctacagaggcaggcaggccctcttgagctgtggtgggctccacccagttcgagcttcccggctgctttgtttacctaagcaagcctgggcaatggcaggcgcccatcccccagccttgtgccgccttgcagtttgatctcagactgctgtgctagcaatcagcgagactccatgggcgtaggaccctctgagccaggtgtgggatataatctcctggtgtgctgttttttaagccctttggaaaagtgcagtatttagggtgggagtgacccaattttccaggtgccgtctgtcacccctttctttgactaggaaagggaactccctgaccccttgtacttcccgagtgaggcaatgcctcgctgtgcttcggctcacacacagtgtgccgcacccactgtcctgcacccaccgtccggcactccctagtgagatgagcctggtacctcagatagaaatgcagaaatcacccgtcttctgtgtcgctcacgctgggagctatagacccgagctgttcctatttggccatcttagctccacctaaagccagcttttcgccatgattttaaaaagcaagtctgaagacccaggcccttcctcctgtgccaagcatcaggaccctcacctccttggccattcctcagctagtcttgggtaccttggtgtggtcgattgcccccttctcttggtttccaagacaccaccttctcccagctttcctcctaccccttggtttctctatttcaggatcttttctccccgctctgggattccagagtccacttcctggtcctctttctgctcttcaacacttctttttgttgttgttgttgagatggagtcttactttgtcacctgagctggagtgcagtggtgcaatctcggctcactgcaacctccacctcccaggttcaagtgattcttctgcctcagcctcccaaatagctgggattacaggtgcccaccaccaatgtgcctgactaatttttgtatttttagtagagacaggatttcgccatgttgcccaggcttgtcttgaactcttgacctcaggtggtccgcccaccttggcctcccaaagtgcttggattacaggcatgagccaccgtgcctggcttctcaacacttcctgatgacctcctcttgtccccaggacctgaaaggctatctctgtgccagtggccccagatgcggatccctagcccagggccttgtgttgaatttcacatttgctgatccacctgtccactccacatcgccacttggctgtccaacaagtgtctcaaatatcaggagcccaaagctgagcccctgaacttcccctcctgagtcccacttcactgcagcctgcccatcttggtcagcggcaaccctgtccttccaagctctctgggcaagcacgttggagcatcctggacgctgctctcctgcccacctccaccccactcagtgcagcctgttggctctgcccttgcatgctgccgggacccgaatctggaccaccatagccacctccaccccaggcgcttctggccattatcaacactgcagccagagggatcttcagacacaggtcagatcaggtcactgcccgccagaaaccctgcagcagctcctgcctcactcaaattaaaagcccagtcactgcggcctctgtattcctaacctcagagctccaccttccatcccatgttgtctgtgtagacaggtggctgagcactcctcattcatgcagcactttcttcccttcccgaacttcttcttctttttatttttatttatgtatttatttgagacgaagttttgctcttgttgcccaggctggaatgcagggcacgatctcggctcactgcaacctccacctcctgggtttaaatgattcttctgcctcagcctcccaagtagctgggattacaggcatctgccaccattcctggctaattttttgtatttttagtagagatagagtttcatcatgttggccaggctggtctcgaacttctgaactcaaatgatctgcccacctcggcctcccaaagtgctgggattacaggcgtgagccaccatgcccagccccaatctccttgactcatgacttttggggatcccagggctcccttcctgggccacctctctgtctgcacacaatccctaggtgagctcactcagtctcgtggttctaaacaccacaaggcacatttaagctgatgcttcccaaactgattccctgggcctggcctctgcccctgaagtctagactcagactcctaagtgtcgactcatcctcctgacctggacgtttgcatttcaaactgaccacggccacatggagcccacaccccaccaccacccagcagcctcctcctgtcatcccacctgaaccaggacatggcagttttcaccttccagccattcagccaaaatcatcagcatcatccatggcccaccccattcttcctctccaccccccacccatcaggagatcctgcgggctcttccttcagagtgctttctgcttctcaccacccctgcagttttgccacgctggaccactccaccatcccgccctccatcctgatcatcataacagctgcatgtttctgccattggcccccgtggtctctttgttacctggagccatcagctaatgtcactttcctgctcagaagccaccaggaggaggctttgcagcttactgagagcaactgccccaaccccagtggggacctccactctgggcccgcacaccctcctgaacccatgctgttctccacgcgtgcccctcctttggccttcacactcacgagcccatccacctggagcacctgcccggtcctgcacacttggccgcctggctcccccacctctcccctctgtctgggtaggctgagttccatcaccccagcggagagacctttccagacctgctgcccagtgccctgctccttgctctgtcttgtttttctccattgcttttcttaccatgtacagtgctgtgtttactcatttgttcgctgtctgtctctccactagagtggagcttcgtggggccacatgtgtttgctgctgtatcctcagtgcctaccacagcaccaggccctggtggcactcaggaaatcatgtctagtgaaggactaagggagtgaataggccagggagggtttcccttccatgtggccctcgtttgctcttcccaccgagcccccaccagcttctccacagagctgcgatgtgtcttggctctgtcaataagtttctgttctatgctcagtctcctggaaatccatgcgtataacctcccagtccaaatattagcaatgccctgagccaaaatcagcatattctttgagcctccaagctggtggagaagcagacagaaccgttcaagtacaaatgtgtctgtgcagcagggcctccacaaagggcacccagccaggggggcagaggggcctcagctgggtcctgaggggcacgttcccagccacaggtgctgacatcatcctggacttgagcctgaagcaccctgaggcacaagctggacattctctgggatcctgagatttgccacaggccacacaccagtgggggcttctcaggggaggcctccctgggatgaaagtcccaactgtctcttgacctgagaaaagcaggtgctgcccttctgtgtcctggctgtcttctggccttcatccaggacatttccagcaccccttggaatagcggctaggtgccccgttcagtagatattggttgaatttcttttttctttctttcttttttttttttttgagttggagtctcactcttgttgcccaggctggagtgcagtggcatgatctcagttcactgcaacctccacctcctggattcaagcaattctcctgcctcagcctcccgagtagctgggattacaggcgcccgccaccacacccagctaatttttgtaatttttagtagagacggggtcttgccatgttggccgggatggtcttgaactcctgacctcagctcatccgcccgtcccggcctcctaaagcactgggattataggtgtgagccactatgcccagcctattggttgaatatttttaaccagataacactggagtggagaggctgaacgtgacgagtgctggattgctctgggacttattagtgaggtcacctggacaagttactgaactctctctgggcctcagtttcttcctgtaggaactggaggtaacaacggcctccccctcttgggctgtgtgaggattagttgatgtgaaatgatcagaatggcacctggcacgcagaggggccttccatgccagcactcactgttgccacctcattggtggtaccaggtgggtccgtgatggaggatgggaagggaaagaccaaggaggcaggaggccgttctcctggggttgggtgtctgtggtcaacagacagaggggaccataccctcctgcaggcccacggggcactggggcatgacccagcagcgctcactccacactggaagcctccctcccctggcaagcgttgctctgtgtggcatctgtgctgtgcatctgcaggtgccctctcggtgcgccgtggctgggggagtggaggagggcatggatctccagcattcctcatcacctcttccagctcctggagatatttacaatcagcccagggagaaaagtgccacatgtcagaaaccatgagaacataaagcagggctgactggcaggagggtctgaaggggcagagtgggagctggacagggcagattgggccctcccctgtgcaggggcctgtgctgtgggtcgtacatgcaggcgtggtctctgttttcaagatgcctggtttccagctgtgggtcctggtgcccatgctaggagctgaagggagacagtgagtgatgcaagaggctcagaggaaaggccgggggcttccatccagggcctggtggatcctcctgctgggggtgggtgagaggggcttcaggaccagggaagccaccctggaggagacagcagatcccggcttccacggacaggcgagaggacatagcaggaaaaagggcacatgtgggcaggaagagggttgacaacaccaatggccagaccccctctgtgctggggggatctgtgctgtgctgctgcccatcacagcagcctagcagagatgggatgccatgaggatgatacatcttttagacaatggactacaaatattgaaaatgaggattttaatatccctcttttacagacagggaaagtggaggtcagagaggttaagaccaaggccaagcagcccacagccaatggggccaggctgtgaacgctgcctgtcaaccctagggccctcacacccactccataggcagcttcccacatggggctggcacatgccacctggacacagggctccctgcagtccccacacccccctacattggggtctgcaagcaccaagtggagggcatgctttccattggctcttagagactggcccgtggatgcgaggggccctttgcaaacctttgatggatttgtatttgaaactgcaatgaacacctttcccaggttgccctgcaagatgcattttcagagcatagattaatggcagtgccatttaagtgttttgaaaatgttttctccattaatctcaatcaggagccgattactaccaataaggctcatgaagacagcatgagttagatggagtctcagggcaaaagagccccagggcgaggcagccctcacagccccaggtgggggcctggccccgggccaagccttcctcaatggtttagaagcagtgcacagggccaggcgtggtggctcaggcctgtaagcccagcactttgggaggccgaggcaggtggatcaccagaggtcaggagctcgagactagcctggccaacatagcgaaaccgcgtctctactaaaactacaaaattagcagggcttggtggtgggtgcctgtaatcccagctacttgggaggctgaggcaggagaatcgcttgaacccggaggcagaggttgcagtgagccaagattgtgccactgcactccagcctgggtgacaagagcaaaactccatctcaaaaaaaaaaaaaaaaaaaaagaaccagcacacagataatgcctgctgcctgcctgtacccagcctccccccgccgggtgtcattacctcattctctattgttctacttaggtgagatgcaactacatattcaattttatatcctgcttttgtcaatgaacatgaattccacaagggtcaaactgtgtaatctctctgatcagtttttcttaccaataaaatgcgcaacgacttcccttgcttacctcccagggccatcactgggtcagctgtgatgagcgaaggaggatgtcgtatggccgagtgtttgtgctgttaggattttgcacctgctcttttttcattcattcattaggcaaataaatatttaacataccagatggaaaataaagcaaggtacggggcgagaggacagagaggggagggactctgaatgctgcttacacctttatcaaccaggcggccaactctttgcccaaatgtcacctctttctggctttagggagcactgtgagctatttggaagcccttgccgtctgccccagcaccatgcggcacctttcttggggtgaggtgcttggtgggcacctgatgggggcagaaggataagcccacgtcagccttcctctcaccaccgtccccacgtgggctctgtgcttgtggctgtcttctctcgggcatctctttcctaccttcagggaggctgcccctcaggtgcagccattgcatacaggcagctgcttctctctggtaccaacatggagcattttgcagtcatttatcacataaacatcaatagacattttttaaaagaaaccaaattagaggtcctccccaacccacttcctctgctctacaaattaaattgctttgatttttcttattctctgccagatcttggaaatatcattttgtattgcgtgtcacagtgaggggcctttcatgaagcagcattcctgttttggccacgctgggaggatgagggggggtgggggtgggggacagctagggatttgcctgcctgagaggggatccacatggtgactcccatcccacttgctgcatgggagcaaacagggcagccacgtcctggcctgaaactaagcctgttggtgcagctgacacgttgtaagaaagcaggccgctgtggatggcactttctcatgggctaaaccctctccttccttcctctcagtctctggctacagttgagtcatgctccaggctcctgggaggtgaaaggtggcttcagagaccctggaacgtggcccaaagctgtcatgttgcagctcggataaggtgaaatgggtccttggccaagttcaacagtctgggcctgcagtggggaagccatccctgtccctaaaaaccgctccactctgacataaagataataatgtgtgggtttgtcatggtggcgctcatcctcccagaacgctgtcttctagccagcagttgaggggacaagaagggagtgtccctgcatagggagggagggaggcaggatggacttggcttcacttccaggggggctcggggaatccaatctgtgcccttagacctgagagcactgcttatttacttttgggagaacttgaatgtatctgagaattggaccaaagctgagaacctagtccccataaacaaagtgtacaccggctcactattctcacgtttgtaaggtctcaaagagcccacagaccccaggccaagaggccttgatccaggactgtggggaagacttcctgctctgagaagaggctcagagaaggtgcactgcccaaagctcagggaagacagagcgaggcttgcaggtggcccttccatggtgccctgaggagaggccgcacagttccctgggggccagcggggctcttggcattatggtctgggtgctcaggtggcacctagaccctgggaaagaggccctggcagtcccctagcccatgtcagtcatcctctgtgaatggcgatgggggcaggaaggacagtcctctaggagtttgtctggggtggacgctgcaaggccagggtccttcagagcagcctccatggcagataaagggagagtgtgaatgaggctgccaggtgggaagctatgggtcggggtgtctaaagagccaggcacttcttgctgtcagaggagagtcagagggggcaggagcaatcccccctccaccatactgccccttctctatgactcaaagacgtcaggcatggctgctacccaccgagagcccttctgggactggcagggtccatccacctcactctgttgctgagaccagcaaacagggagcaccccttcccacttgctcgcttcctagacgaggggactcccagtctccctttcactttgggccctggtctcactctgtagccagaggggcccagttgtgactccagcttccccatcttctccctgcccccatagccactgggccagccactgaaggccaatgtttgtgatttcattgattcatgtacctgccctgtgccaggcatggggccaggtgctgagaaaagaggctgcagtgactggcactacacatgcttgagatcacaggtgagctgcggtcctggaaaaggtggcagggtaggggcctcctggcatctgcagggctcctccctccttctgctagtcccatcagccaccccatctctaaacacttctgagcagattacctttccagcctgactttaacagtttaaaaaggtgagggcacctcccccagaccttgctctttaactatatccaggtgcccagggccagagagagctgcacggtccgaagctcagagcatcctcactagcatttctgtagcccctcagagtcctagggtgccctgcctggtgggtgcatggggccagcaagggcaggtggtgtcaactcccatcctggcatcggatataggaccagcggtagtgatctcccccaaaaaactgcctacctgggtttccaacttgcagcccattatctattaatactaaataactgcatcgattcgattgatactacttgttagatcaagcggagggccctggccagggctgagcaaggcctgatttacatggagatcgtttaaaagattaactttagtgaaagcttcgaggtttggcaaatccataattaatcagcctggctcagagcttctgtgattgggggctgatggcgactgtgcaaaaaagcaggggttggggcgggggaaaggtggagaaaacttcgctcaccgcatttgggcaggagaaatctgagattcagagacgtgggagttccgaatgagatcatttttgtgcctggttgcagcatattagcttgcacgtgacttaaaaataatggctttcgtagaattgcaaaattagagttaaaaagacctgaacggctgtcctcctgggagtcaggttgagatgaaatttggtccttaaatctggcctgtgtttttagtaatttatcaggccaccagcaaggcctttttgctcagcggtggcgttcagaatcgtgttttccttactcaacattcccaggtgtcgtcccctcttaagctgtcctagatgaatcttccagaagcagggcagccgacttagaggcctgaagaggtggcatccatcctcaaggacaagcgaggcctccagcaggtgggggacaggaggtgtctgagccgagaagagctgtttattacaaccctgaaaatgagcttggccatctttgataaaaaattaatgctgcgatgacatcaaccttttgaccgcttcctaagtggcccacaaatgtcagaaaagctccgttcctatttgtacattgtgaattccagcacatttagtcactaatcttaagagattaatgcttagctatttgggctgcaggagcacaaatgtaatatttataagtagattgcgagtgatccaaactcagtatttctacggcaatgggttcaaaaagacctcctcagacaccactgattgtcactcctgccagcatatccaagctgcaggaagctctgcagagtctaaattggaatgtgaagatttagtacggggctacacaataatttgctataagctgtataaatagtattttatttgggaattcattgaaaggaagtgtcgaaggtcaaatccttcccagcagtgagtgcatacgtatttaattttcaatctctagtctcttttataatcctgagtggcttggcttcagaaatatttttagcaatgggaaattaaatgtcaatttgagaaagctctcccctgggatgggctgtcctctccctctgcacacattctgccgcccagggacgaggcgcaatcccagctggtcctctgggggagagtgggttacccctgagcactcagcccctcagacattgcaggtcctctagggtgagccttgaggtacagggagctctgggttccagaatattctcagggccccttgcgactcatcctttcctttctagggtaccctctttggggattacagaaatgagctccaaactacagagcagacctggcaagggaggctccaggacgtgctgctgccacgggagggaagcaggaagcaggcagcactggagtcggcgtccgtgggaaacactgtgtctctgggaagcactgtgtgtctgaaaggttctggccagcacgcagaagtgctatctggagggagggtgggggcaggaagtccacgggcaaccatcagactctggagagctatggagacgttggtactgttgggaagcacagcctggggcagggaaagttgtctcttgcacactggaaggcgaatttctagaggggaagacctcgtcgggcgaatgcactgttccattgccagcacctagaccagtgcccagggtgtaggaggcgctcactgagtatctgttgtatgaatgggatctttggggtgggggctctgaaggaagggaggagatggaggcacaccttgctgcctctaggattttaccgagggccgatcaccacatcagggattgtgtggctctcatgaccctgccctgctcagttgcctctggtggcttcccggagcacatagagtcaagtccagatgccttcccgcataggtgataggtcagggctctgcagtggaggcccagcactgcctcccagcagcgtccctaccacatcctcccctgagtcctattctaaagtcatccagagcacctggctcttcctctgaccccccacactgtcctctccactaggatgacatcccctctccctcatccatcactccttcaaagccatgactgccccaccccaccacccctgtgcctaatcagagtgattccctgagtgccacgtcttgtattgcgtggcctttgcatattggtttcggagctggttgtctgtgtgcgtctgattcctgcagctagcaccggtgcctggcaccactgtaagggctcagtgggtgtttattattaaatgttattttctctggtctgctggcagcgatggcagaagtcatcttagcagatggttattgcatacaagccacaggctgaacgaaatacccagcacctctaatggacgcctctaatggagaagtttcctccccatcttgagatttcttggagtgctttctgcttccacgaaatgctcttccatttgagagtgttgtcagaatttgggagccataatgacctgggttgcgattagagccccaccacctacagggtgtatgtccttgagtgagttcctaacctctctgagcatccgtttccatactggatacacaattggatacacgtacctcatatggtggttgcgaggttgaaatgtaatgatttatgtcaagcccttagcatagtgcacggcatattttaagtgttcaacacatggaaactattcgcatggtgatgatggtgatgaggatggagataatgatgggcataatggtggtgatgatgatggtgataactatggtgatcatgatggtggtgatgattatatcaatgatggtgattatggtggtgatggtgatgatgacagtgataatacgggtgatgatgatggtgatgatggtggtaatggtggtactgaaggtgatggtgatgatggtgatgatgatgacagtgataatatggatgatgatgatggtgatgctggtggcagtggtgaatggtgatgctgatggtggtgatggtgataatgatgatgatggtgatgacagtgctgataatatggatgatgatgaaagtgatgatggtatgttagttctcacattgctgtaaagagatacttgagactgggtaatttataaagaaaagaggtttaattggctcacatttctgcatgctgtacaggaagcatagtggcttctggggaggcctcaggaaactttcaatcatggcagaaggcaaaggggaagcaggcacatcttacatggctggagcaggaggaaaagagagtgggggaggtgctacacacttttaaacaaccagatctagtaagaattcactgtcaccacgacagcaccaaggggaatggtgttaatcatgagaaaccacccctatgatccgatcacctcccaccaggccctacctccagcattggggattacatttcaacatgaaatttgggtagggacatagatccaaaggtggcaaatctgctgctactgctgctgctgatggggatgttgatgacaatgatggcaatgatggggatgatggtggaggtgatggtgatgatgacgatggcagtggtgatgacggtgataacatggatgatggtgattatggtggtgatgatgatgatggtggtgaatctgctgctgatgatgatggggatgatgatgacgaggatgatggagatgttggtagaggtgctgctgctgctgatggcagtggtgatgacagcaatcacatggatgatggtgattatgatggtgatggtgaccatggtggtgaatctgctgctgctgctcatcaggaggatgatgatgatggtggaggtgacagtgataataacgatggtgatggtgatgacagcgataacatggatgatggtgattttggtggtggtgatgatgatggtggtgaacctgctgccgatgatgatgatgggtatgaggatgacgatgatggggatgatggtggaggtgatggtgacagggatcttgatatgtttctaccattttgaggctccatgaggatccatggcttcaggtcttggcaagcctctctgttacctgaccagggccgggacatagaataacctgccccttccctctcattctctgcatgttcacccacagggaagcctgctggagaggcctctatttctgccctgtgggccagtaaaggcaccaagtaaaatctttgctaaatccctgcacttccaaggctcgccatctgtttcctattagagtctcatgcatccctttgacatatttttattgtcaggttagaagaaaatattccactcatttgcaacattctcattatattccctttataacaatttctaaaagagaataaatataaaatatttctctgtattgtggagatatttcagcctgactttaatatgctgcatagttttccaactcacaattcttctaaccttgtgatgacagttaagaaatcttcaggctggggaaaacatgtggatcaatgagttagtggaagtgcaggacactttatgaggactcagggagagcggctttctgccgactcagagatgccttctcagccttttgagaataaactgttccaacagtcccaaagtctctttcccttgggccatttctaagaactcagagatgtctcctttgagatcgatcagcagctgggtcctcaaggagcctggccaggaagcttggtttgaaagggcaaaagtggaaacccttgtccacagcctctgagtaagcctggctgctccaggtggcagtcacgactgaccctaccccagaggacccagtcaaagggcatccagatttctcatttccacccgggagtacaggtcctactgtgccttcagccccaggcttgtggctgccccaggtccctgatcgctgggaagagcgtcctgccatagactcagctccacactgggcagccccacttggcagatcgaagaaggcagcattcccaactgccctcccgaatggacggccactttggggtgggcgccaggcagttaagcctgctggtggcctctacttcctcctgccgtggcgccgctcaagcataccccagcccatctgcagatcaggtccccttaggtgaattcctgcccctgctcccttgccaagtgtctcccactcccagtaagcccttccttcaaactgcctcttccctgcagatctttgagaccaactctctaaggcttttctgatgcctaagcccctggagaccacccttacctcctcctgccccatccccaagctcccaaagtcctatgtcatctgtgcagaggccctttgcacatgcagcatgggagccactcatcctaccagactctaggacccccgaaggcagcgactgtaatgctggtgccaggggaacaacctgggccctgagccaggcagaggcaaccctggtccccaagaagcctgcagtcagttctggagaacaagacataaacctgggaagatgatcgaacaacgctgacaaagtggactagaaacaaggctgaccagcgcagagcccaggggccctgggaagagccggagctgtgagaaccgctgttggctgtgggtatgctaggtgccaggagcatccgtattctcttttaagcctcacccagccttgtgagctaaacataacatccctattccacagacccagaaacaggcccagagagggaaagtgacctccccaaggtcacacagccggaaagtactgaagtcaggttttgaattcaggtctaactataaattggtgtcccagggagttcaatccaggaggcctttctgtgggtgtttaacataatttagaggatctgagggaatgggaggagcatgttccggtagcggccagggaattgaggcacagagaccattctatgcagcagaagacaagtgagaggtggctgcgtggcatgagaagtcagggctgtctgggagaggaagcatcctggtggggtcaccacggggccaggatgctgaggggccagggccagtgctctgcctccgtccgggcctcagcccacctctggtgctggggtggtccgtcctgagcaagccttgggaagggaatctggctgctccccacacagcagctgcctttctgttgtctgagctccactcagttgaacaaaatttgccgtcccccttgtggccctgcatctcctgttatctctattcagggcccttctgcctttcagcttcaccaggagaggattatttacggccttgtttatttcgctctctgcaggcaatgcccaggctgaggagacaagtagcagtgggcagcctgcagccagggcccagccagcacctgcctttcttcgtgcataggttctgcaccggggccagccccagagggatctccagacccgacagacccccagccttggtgaaatcacctcctcagaaggaagcaggcagcctccctctgaccaccgggtatgccggcccccagtccccatggctgaagggtacttggtccctgtggccttattcaatagagccaggttgcctgcctcctgctcatggaggtccctgagggaggaattgcccaggaaataggccagcctaaggcttgtggctgccctagcaggctggtgttgggtgtcagagaaggaggcagggcagaaggaagggctgtgctgcctgcatcctccacctgggcatctctatctaagcctccagcaacctgagcaacctccttggtggccacagctgtgtgactccctcctttccattcctctgcagcccttcagatgggactgtggcagctgggagcttctgaaagccacggcctgtgtgattcccactcctggccaggcccagcctttgcctttgaggctcccaaggaccacctagcagtttcttgctgcagggcccctccaggtacccacttctcagggaggggccaggtccaatggcaaggtgaagccactactacctcaccaacggagaaaaaaggacgagccaattgatgtacgtgagcacctggaggaacccccagagaacactgctgagcaaaacaagccaatcccagaaggccacatactgcacggttccatttagataatatcattgaaatgacagaattatagaaatagagagcagattagtggccgccagtggttaagaaggagttgggctgggagggaagtgggtgtggctgaaaagggtagaaggaagggcccttgtgatggaagattccgtttcctgactgtcctggtatcaacatctgggatgtacaggaaagggagactcatggggccaggacagcagtagccccagcctcagccccacaagccagcagcacaggatcagccctcctcattcaatgcaaggggagggggccctggtggacggggaagcattaagcctattgcctggaccttgggcttcactgctgcctgcttcgccctgtcccctgtccctcccccacatcccttccacctcctggagagtccctcccccacatcccttcctcctcctggagagtccctccccaagcatccatgcctcccagctctctctcttttactttccaaacttgctctcagaaaggaggaggctggccctctgctgctctgagcatttgcagaactctctgctctttcccaagggatcagctcatgaaggcaaccatatcctcaccctgtgcaaaaaattgcaggatacaggagccacggggagcatggcagtaaggacagctccctcagccccgaacactgcacagacgctggccttctccatctcgccagggcagacactgtctgtgtgacatactccccatagggtggctaggcagtgatgggttggccacccctggggcttaggaggaaagcaccattcattcattcattcattcattcattcagattcagcaaatccccactgagtcccccgctaccttctaggacctgccctaggtactgggttctctaaaatgagtctgacatcatcagacattggcttgagccttagtctgtttgtgctcctgtaacagagtgtctgagattgggtaacttagaacagaaatttatttcccatcaatggttctggaggctgggaagtccaaagccaaggtgccagcatcttacctagtgagggccttcttgctctgtccccgagtggtggacagtagtggggaggggagccgggcatggtggctcacgcctgtaatctcagcactctgggagaccgaggcaggctgatcgcttaagctcaggagtttgagaccaacctgggcaacatggcaaaatcctgtctctacaaaaaaaaaaaaaaaaatacagaaattagccaagcatggtggcacatgcctatagtcctacctactgggtaggctgaggtaaaaggatcacctgagcccaggaggttgaggctgcagtgagctgagatcccaccactgcactccagcctgggtgacagcaaaaccctgtctcaaaacaagaaaaaagaaaaaaaagaaggcagagggcatgctagctgaatgctgcctgaagccttttttataagggcctgaatcccattttggcaggaggagctctcatggctttctcacctcttacagaccccacctcttaaaacaatcacattggcaacagctgcattttggagggggtgcattcaaaccacagcagtttgcctagacctgctgagctcacagtccagtggggagatcaggccccaggctgcctttattctcactgtctcaggcatgaactcaggccagaatcccatcattctaaagcccagaatcccagaactccagaattccaagtttgggactcctgtacctctccctgtgggatccctgccctaggctgggttcttgctctgctgctattcctgttttgaaacagaaccttccggtttgttgagggttgggtcatcatcccctctgttaccctgaagagagcaaccggcagtgggctcttcagggttctcagcctggttcactgtggtggcagtggagcgcagtccccatgcttggggaaagtcccccagctttggcggaatcagcgcctcagaaagaaccaggcagcctccttctgaccaggcaagggctggccgccgttctcatggctgaagggtactcagttcctatagcccgatcatggcattgtcacggtggcacaggggcccgcctatctgaagtcagggcaatccacgcagagagccctcctcatggcccggctcagggagccaccctcccattcctgcacccttgccttctggcagggcttgcatgcctccgagctcacagcatgacccaggggcctggctgtgctgcaccctggggaagatactgtcttaggtacaagaggcacctcaggagcagaggagggagctgggaagctccccatgccaccaccctgagcttgcagcagagaaccagcccaatttgcaagcaggagcgggaggctctgggctttcttagaacattatttatcaggtagactctcagcctcatggcagctcgagccacagcctgatatgaatattgattggaaaaaatgtctctcccctcgtcccccaggcccggggctgccagggagctctccaagcagtctgggaggcgagagggagccgggcatggggagaagaggctcatgggaagagagtgtgtttgaagctgggagatgccctgcgtgccgcaggcccctgtcctcaggagcagatgaagccctggcttccgggctggttccagcatgggattgttcaggattgttcagggagggggcctgggagggaaaaggggaagagtgacgccccagttccaggcagcagacttaatgctaggcttggaggggtgcttctgtcctagcactaagcacctggaggggtgctcccagcttcctgcagcatctaaagctctgtcttgtgggcccggcagagcctctgggccgccctctgcctgcagaccacagggccccagggaacctgaggtgggaggagcagggtgaggtcggtaaggggtccctccttgccagggcctggtccctcctcccagctccccagctctagaggtactagagcagttgaaggctggttcctggacttgcccttcccgggcctgtggcatctgaaagggttattacttccagggtcattttgtttagtttctgtctcttattaacttgtagtccctcgcctctgtaccctgggaacggcagtggggctggggtcccagcggggcggatgcagaggtagaatgcaggctgtggctgggagctgagggccctgcaatctgggtgtgggatgtaaagaggtaactgaggctggaggttgtgggtgccgggtaccaaagtggggcacattctgagctgtgggcaaagcctgcacgttggggggaatggcagggcacagcggcattgcaggaggatctaagtcccccatgtctcagcccctctggggcacagctggcaggcttggccaggtgggacaggagcagaaaggggaaactgacagccgcaggcaagcagaggaggccgcagaggaagaggagggaggcccagcagaggcccttcccagccctatcctccccggatgcctggatgccggaggcaggtctccggtgtccaaccagcagcctggcccctctttagcctccaggcctggaaagcggatcatcctcctaaggggacagatgagcctaaaagcaccacagcctgggggcttaagccacagggatccatcctgccaccctggaggctgcacgtccattcctcctgagggcggtgaggaaaaccctgttcggggcctctcttgccttctaatgctttgcttggtgtccctgggctgggagaagcctcatctgagctctgccctcatgtttacttggcattctacctgtgttcgtgtctgtgcccacactccctgccgtgtaaggacaccagtcatgctgaatcagggcccaccgactcatctgaactccttacatctgcagagactttccaaattaggccacattctgaggtcctgggggctaggacttcaacgtatgaattttgggagacaacattcaatccataaccgggggcctctgacttttaagggaagagacccctcccctgggaaacctcagattctgggtctgtagaagcctgcagcttggtgggttggagggcctgacacagggtgctgcctccccagctggccctgtggggtaagtcccgggccagcaggcgcattcactcattcagcgagtacgaccggctcctacacggtcgggcggtgtgtccagcacatgggtgaagcaggccgcacgacagccaaggttttaccacctgggtcttgctttctgggaagaagccagaggacaaacaggtcaacaaatataaaaaatcatctcaagtggggatgagagctaagaatgaagtcacgtgacgggaaatcacagagggccttgctgagagtgggacgtttgagcagaatctgaaggagaggggctttgaggaacccaagaagaacacctcaggagtaggggtgtagaggcggaggcagaggcagaaggcagggctgggtggtgttgggggaatcagagatgccagctctcaccccagctgcggcccatagggctgccacctccaggcagctgggcagggcctgggtaggtcagaggtcttgagactggggtgaggggcaagacgcactgtccgagcggcaggtttgcgggggtggagcatggtggagaaggactctgttctagggaaaacccagatacagctttctttggagtcttttaaatcctttgagaagaagccaaagtgatgagtgagccagggtggccgggaacaaggggaagttgtgactttgagctggtctcggtcactcggggcaaccatggctggagagactgggatcccccaagggcctgggctcagccaggaatctctatcctcaccctgagggcatcccagggtccccatcatccaccactggcccctgtgtccaggcaggaggggtcaactgtacccagagccgtgggaggcccctggcttccagtttccctccttcctgtggctgcaatgcagctgtggccccaacatctgtctcctccgaggggcaagggcaggtggaagcaggcagagggggtcccgcacacaggaatcagacaggttttagaactcaaagggcctcgagggtcctggtggagcagaaagagcatggcctgtggagcccggaaggcctgacctgctgttactgagcagggttggacaggaagaaaagtcctggccactctcagcctcagcttcctcatctgtaaaacccagtgtccacctccatatcatagtgagacagtgaggatggaatgaccatctctgagagtcctgggtgcggtgcctgcacagagaggtgtcacggagccgcctctcatcacaccagggccagagtgagcagggctcgtgctggctctgagagggaaggccaccacaaagaggggcagcttctggctgcaggcaggtggtcggtggggggctgcaggcccagagctgcgtcctcccagggccgagggcccctccaggccctgctgctcccaggtggggtctgcggtcctgggtcgggcccgcccttgctgactggacacaggtgggacaggctccccatttctgtcatactgctttctgcctgggtccatgctgccactgacccctcctaggtgggggatctgtgtcccctggaccacactgagccatcgttggctgcgactctgatgttcttcgttgtctggaatcgagcccctccctgagactgtgcagtgaatgagccccctgcccctgcaccacccaggtcaggccgagtggacactaccctgaagcacgtctcccggtccagcccccactcctgcctcactgcgactctgccacctgatgcctccatggagggtcgattcacctgcctgagtctgtgtgggacccaccacccatgcaggaccagggctccccactgaggaccctctgagctactggttaacaggctcaagcctgcgcatggtacggccaccgtcctacataggtcctgggatccagcctccagagtgcaggcccataggccagacaccacctgggcagcttctcattcaggactgccccactgtgatgatggggaggaacggaagtgtgcaggcctctagggtgcaggtctctgagctccccaggtgcagatgaaggggtgaagggagggagagtgccgagcccagcctcccaggaggcaaagcctgggtatctgaggctgtccaaggtgcggagtgtcggagtcacgtgagctgcatctccaaccttggcttcctcatttgcaaaatgaagaggccccagtgagctcggagatcccttcacagaatcatcgctagaattccgtgaggctttgttgaggcccagcaggcctgtctcagtggcaagggaggcaggtggctcctggaacgcaggcagcactgggcgggtacccgcactgggcatcccatgtgccccacatctctggcacattagcccatggctcaggtggcactggccccgtggcataggcgagagggcaggctagggactgctcctaccagtgtgtcttgggctctgtgcccactacctggtggggagaggtgtccactttgtccacttcatggcatgggagccgatgcggcttcaatcctgactccgcagctgcctcctgaccagtcagcaatcgggagccccgacctcttccctctccatcctcactgcagcctgggcaggccggaggccaatgtccccagggcagagctgggacagtcccagtgggaaggaggcctggccgggccagacagcagcctgggaaggagccgtgtgttgcctgggagttccacggcaccggctgaacctgcatcttgaaggtttgattgattgcgtcgttcagagtgaatatattttttaataatcggtttccaaaattagtctttctctgtgtagcagctatcacaaacagcatgagacgcactccttttattttttttttacctgccagaggcagatatttgtttttccttcaagagagcagcaggtgaaggtgtggtccccggatcccagcacctggaagctgcggtctggtcctgcctgcttggagcctgtgggccgagaaagacaggggcagaggcagcctgaccaaacctcctcttgctcccactctccgtggcttgcgggccaagcgacatcagctctgcacccctcggtttccttagccgatggcgatggtttgattacttcatcacactgttttgggattaagacaggacaagcttagtgcacacattatagctgctcagtgcccattcagtaactggtagcttggtcctcctacctcgtgcccttgcggtagctctgggaagccaactctgtctccatttgactggtcctacaggtgcgggttttaaaccctacgtcacccacatctccttttggacatcacaaaactcctgaggtgcccagcccacttacccccaagtgctcaccttctgtgagctcctgagcttcttcaccagctgagatttttccttgtggagttttctacttctgttgtttgtaattcaaactaataagttcttcctgcatttgaaaaatgaaaacatggtgtaatattgaatgttgctgttcaaactgctccccacacccagcattttgcaatgtcccccaggggcacacacccttgatgcttgactgaaaaactaccataccagtgactgtctgtatctcattggcctgagaaattaaaagctgctactgtgttacattaagtgtctgctgtacgcaccgccctgggctgggccagtcctgggggataaagaacagtatcagaaagatactcagacagagctgtctctgtggtggaggagatgagagctaagagaagtgaaaatgcagagccgaggccaggccatcccgcagtgtccactggtgcaggggtgggctgcgggtcgcgagccacgggagcttgcaaaagggaagggcatggcttgaagtcagcttcccggaagaggaagaggcggtccttggctgatggcagaatttgcatgggctgataggaagggacggcttcaaggttgagttggctaacaactcgagccaaggcccagaggtggggatgagtttgctgccaaaggggacggctggcaggaagctactcagtgtgcttgttcgtctcgctcattaattgggcacaaagagcagcaaatcccatccccatcccgaggccctgcagcatggtaggatcatgcccacttctccctgctcttagaccaacgtgggttctgcctcccctgcccaaagcgtaggcgcagactctgggtggaatcaaggtgcaaaggaggcctcgattccggcggtttcagagggctgctccctgcgtaagtcatccacccatcctcttgttaccccacctctggcttctgggggccccaggacttccccagcgctgtcctcagccctgaaacctccatggggtttccatggagaagtgctgacaattttgtttctactctcccagttcttcctgaaattcatctgcatcaaagtgagatcccttatgctcagcgctcagcaaggctgtggtgattaagcacttaaattgattaatcaaatttcctgtgatgagaactactgtcattcattaatctgagcgggattataaataagagatggcagatacaggagacaaccgtgttgacagatggacacggtggcctgaatcacaagtaggtgcctgcttcctgggggctttcgctgtgggcagctggggacggagcttccctaaagacaaaattattcggagattgaagtatccccattttaataacgaaatatgcatagatgagcaggcagccggtacagggagcacgtaggttcgcataccaatggcccggttgtattcatggaggtggtagcagcagctccaagagataaagaatctgctagaaaaagaggccaaagcaaagtggcacacgggttgagaatatgggtttgagggtcagagcagccctgggtgcaaatcctgcctccatggtttactcaacgcgtgacttggctgaggttctcaatctcccagagcctccattccctcactggcaaaatgcggatgctgataatcctgattccactgggttgttgttaagagtaaatgagacaatatctatgaggcactttttatctagtttacaaacatttattgagcacctactgtatgtcagtactgtgctggtatttagagattggcaaggaataaagcaagcatggtccctgcccccagagctggtgttcttatggagaaggcagacactgagactcaagggctatgacacagtgctactgccctggccttcccagatgccacattctctgttgacctcctggactcaggatgtcctttccatccctgtctttgaacacttcttcctgcctgtggtctctccttgcccctgcgcagatcctcctcctgacttcttggcctcattcactccaacagaactgtccctcccagctcaagtatactgtgtctctacccaagtcaaagccctggatgacggctgcaaagcataaggcttcgggttcccagctcagtcacacataagcttcataccctagacgtgtatgatgatctgcatgaagtccatttccccactttcgtggggtacagtccccttgaggcagggaccaggtctgttctggtccccatcgcatgctcagccccagcatcgggcctggcccatggcaagcctagctagtacttgttgagttagtagatgctgcatcaaggtggccttgggagcacgtggagatgatgatagccatgtcagacgacagcagggagagtggaaagtcacccagccctgggcatccgaatcagcattttctggagactggcgcctggaccacctcagcacaatacctaccactgattgagcttctgcttggcatatggccctgctagggcactgggaacccagtctcaccttccagccatattgagtggcacagaggaggctcgcaagcagagatgattgcagtgccctatagtgcaccgttggggtagagggaggcccagagcctggggcattctgggtgagctgatgccagaggtgggttttgtagatgtggaggtttggtaagaagggagaagtggggctccagagagggtccctcaggtctctgcaccctcttttccatttatttgtacctcctgatatcctgtccagggtcccaagacagcctctacagggggtcccagctgagcaggccagagggaggaggcacagcctctcacccatgcctctgcctggacacaggaccaggaaatgccatccccagtcttgttgggctcagacattgtgatccgtcggtgagccatcgagcccctccttcaggcccccagaggaagctggaggagtttgcggagggtgggagctggggctgggagcagggaaaagtcagattccctcgctcagaggaaacccgctggtgctcagtgagattaaaactatcactcctggctgaattggcctcttctactgttttgctaaatatttaaagaccccttattaaaagagttaccatcttaaaaatgtcagatcttcatctgtcatgtccttcctctggagtgtggcctcagggctgtatccaagcaccccagaaacagaaaccctctttgccctgggccccaggatcatttcaagtggtttctgaggacccactctgtacccagcactgtggctgcccgagcatctgcctctccagccacagtagcttctgccacgtgatgggctggcaccagcctgagcaggtctcagggaatatggtgaggaggcagcttgggctgcagtacgtggccatagtgcactctgcccagcccaaggttctgtttgctgcttccctcctccctgggcaccaggctgggctggaggcagagaagctaaggacagcccagcctagggagtgaggaagcaggaagtgaagccctgagccacggcaaggtcttggccctgctgatgatgttgggcaagcagagggtcatgggggcaccgagcaagaagcatccacttctgcctggaggaattagagccagattagaggagaagctgttgtaggattaggatgagaattaggtctttgagcagcacctaaaaggtgaataccagttcactggacatagaaatgggggtttcccccaaccctctaaaaacaaagaaaaccagacaacacaaagacatacaggttcaaagacttgttcaacaagcaattgagcacctactgtatgccaggaaccatgccaggccctgagaatatagaactgagtgtgacatgttcctgcttcccgtaaaatttgcccgcctagctggggaaatagactaaaaacagcccatgatgtggaatcaaatgtgctgtaataaaagcggttgcagctgcctccctagcacggggtaggaggtgggggatggggtgggggttacctctgtgcctcaggtgggaggtgggaggggtgcctcaaggggaggtgatgtctaagcaggttttgaggataccctgaatccactaggaatgtgcagtagcttggtgtggcctggacagatggggagagagggaagtactgatgaatgagaccagagaaagggccccagagtacaagggaaaggcatgggaaagagatatccagagccttctggaatgatccaagcagagagggatggagaagccgctgctatgaggaaagactgccccacagagacaagggtggagacggagctggtgaggaaggggaagcccatgggagctgtggtctgagctgggtctgaagggctggtcagccgggggatgccccactgcccacagatggtacagtgaggctggtgccagtgtggcccacagggaacgaatgcccagccagagcagaaccacccaaggtgaccctggacgggggaggggctcagcctggagggggaggcggagctggcctgtgtcccctcccaggtggaaagacctgggcccaaggccacctgacgccggaggagccagagagaagaggggacacaggacagaacaaagacatggctggacgttcactcacatccaccctcatggtagaagagtctggaactcagtttaaatttttcaagtctttcatgaaaggggaggttgcctcctcttcctaagcgatgaacatctcaatttgctgctgctacagagggccaggggtagcatcactgaggctaggagatgtcaccggatgtcagccttgacttgagcgaacattcaggggtcaggatggtgtcatgaatggagctcccagagcctgcgagtccaaagacctgggtcccatctgggtgtggccacagatgcctggcgtgaccttggacacagctgtggctgctccaggcctccctcctcacctgataaacaggggagttgggctggtgggtggacaatccctctctgctccacacattttccatcccggtgcatcctccgcccgccgctcaccttgctgtcggcaagagttaagttttactgagaaaagaatttctctctggaatattgagtataattaaaactctgctgtgaaaaaaaaaaaaaagcctagcaaacactgagagacctagaggaagtgaaaatgtaaaaacacgacccccattttcctctccctatgacatggattattaagtcaggtttgaaaagttcctattaaatatttaaatatttcattaaatattcatcatctcaaaaattgcttcctaacagatccttaggtaaatataacaatatttgatcacaaaagctgcttggcctgactgaggctcaggaagggtgatactctgtctggggctctggtcccacgggtacagggaatcctgcttacgagagggaggctgagagaccgggaggggaacacacgcctggccaccaggagggcccgggtggccacggacttgcctactgggcgaatgagcctcagaaaggtgatacggcaaacggagctcatgtggcttgtagtggtgcagctgggagccgaacccatgttggccggacccctctgtgggcgatgaagaaggctctcccacagtaggggctgcccgctggcttaggccatcccaacactggccacgtgcaggggacattgtgaaagggaccttctatcagaccagcagctgggctggaaacccttgacatcccttccccggggctgtggaggggaggggtgctcccctggggttctgtggaactggattcacagcccggttgttccttgtaagggcacctggtctcccaaagtggagtataaacagctttcagtgggcaggacatgtggcagccaccctcgcctccaccgtctttcttacctcccaggtatggtgctggggtctgcaggagggtctcaaacctggagctgtcggggtttgggccagatggaggagtcaaggtggagaccgtcccgtgcactggaggatgcggctcccactgggcctgcacctagtagatgccagtgtgccccaacccctcatgcccacctgaaatgcccagacacttcctatgcccccagggagccatactgcccctggctgagaacattgctttaccagaagggcactttgtaaacacgtggtgcgcgtggatggtgtagcaccatctggagggagagagtaggggagggaagcagagtgactctacaagaagggcacttggtaaacacgtggcacgcatggatggcatgacaccgtctggagggagagtaggggagggaagcggagtgaagtcaggttgatagtgttgggcctgcctttggcctgaagggctttgagtgggggcggggtggggggtgagggggtgggggagctgctgagtgctggatttcagcagccacggtgccagctttcagttcccacatgggcttcttctcaaaggcctcaggggatcgtgccaggctaaggggtccctggctctgctcacctccacctggcactcgctaggcatatgctgcagcccctaaccctccctggggctcaggactcagtggaacggcagggactcagagcagccctgccagtgccacgggcctcccagccctgtgtgggggttctctcgtccacccgagtgctttcactggccctggaagcctccccagcctgaatgcagcccttggagggtggggacactgtcctctcctgccttcctgtgctgagtgtgaggaactcccatgagcattccaggtgggctcgctgctgaacaaggtagaagctcttcactgctttttatagtgcaggcacctgggtgcagagaagcaaagctatttgcccaaggtcacatggcaatcaatccaggtttacacccaggttggtctgacctcagagcccatgctctgaagcaggctgtccatgcacaccacacagactgcccatgtcactgagtcctcggagcaggtcagcgggtgctcctctgcggccgctgtcttgatcctcctcattccaaacgcatgtgtttgcagagcagagagggagtcttggtgcccaagcccagtccccgcacctccctcctctccttccctgggcaaattctggggtgaggaggagggcacaaagattgatgggctcccctcactggcagcaggcatggacatggagtgggggggctctcccctccagaattctgatgcatgacacctgctgccagtgccaccctctcaggctcctgggtgacaggaaggtgtgaaacctgacgtttccttgggtctggaatgtgtgcgaacctccatgtcctggaggaaggaccctctgcctggggagaactggtctccaggtgggtgctcagctgaggcctctgtggaggccgaggctctctgtgctgtgtccaagctgggagctgggcaggcgccagccctccttgtgggtgggggacagagcctgtcccagtctgtctgggctgctataacacaatctatagactaggtggcgtataaaaaacagagatttatttcccagagttcaggaggctggaagtccaagatcaaggtaccagcaggttcggtatctggtgagggccttcttcctggttcatagaccgtgccttcttgctgcgtccttacgtggtagaagaggcaggggtctccctccagcctctttttataaggacactaatcccatgcacaagggctctgtccccatgacttcatcacttcccaaaggccccacctcctaatcccatctcctcggggtcaggatttcagcatatgaatttggggacacaaaaacattcagacattgcaggcccctctgtgggcgcccagcagcactgcctgcttgctctgaggcagcgatccaggctgttttgcacacacaggtggaaatggctccaaggtacagaagcaaaatgtttcccaaaacaaacaataacctgtcgtgaacattgataccaacatggtctgtggggcgccatgggctggaggcctgggcagctgctgggggccactgccgagcaggaagggtggctggcggtttgcacattcttaaggaaaacagcaaagaaagaagaagctgaccctgggagcatgggctgtgtctggattctagacaaaccacaaggctgataaagcgaggagatgtaggcctagacatttgtcaggatggggctagggcttcttaacccagcgaagctgcacccaacgtggtgtgcgtgggccaagcaacatttttctgacacgaggtctctaactctcatcagagaagtcagaagcagtctaagaccaccgggccaggcagagcagctcccaccagggtaggcaaggatgctggcagcgtgtgggatccaggagtcagagccctctgacctcgtcttttccaagggcctcagttatctcacctagaagataggaatgagggccagggcagtggcccagccctataatcccagcactttggaaggccaaggcgggcggatcaattgaggacaggagttcaacaccagcctggccaacatggtgaaaccccatctctactgaaaatacaaaaattagctgggcgtcatggtgcatgtctgtaatcccagctacttgggaggctggggcaggagaatcacttgaacctgggaggtggaggttgcagtgagccgaaatagtgccactacactccagtctgggcaacagagcaagactcggtctcaaaaaaaaaaaaaaaaaaagaaagaaagaaaaaagaaaagaaagtactggggcccagtactcagtggaacggcagggactcagagcagcccccgaggagtatgagcctgactccttgctccatgcagcccccaggggagaaaggcgtttgataccacacttcgcaacaagaccaccaggtggcttgggggtaggagggaggagaggggcagggtttgaattctggcactgccatcatgttacccttagggcctggtgtcctgcttggagagatgaggcccaggatgaagccccaccagccagcccagcagggatgcggcccccttggggactgcaggcaccaacttggaggccaccatcccgcaagccatgggtctgaatccctgtggaatgtgtacaagtcctgagcctctccaaggcttgatactccatcctgaaagaggatgtgctaattccctcctccttgaaggttgttgtaaggaccaaaagtgaggatgggtgcccatcagccagccagtgaagacactaccttaggcaacagtggcccagagatacaacagctcagtgagacaacctggggagacttccctaaaaatccagaacacagaaagtgtggcatcaggcaaaggatttccattatgagcagccacaagaaggaaagcaggcgccctgccacctccacccacctctgctggaggggaggggatggaaggggcctctgcagctttcacaccttgtaagcagaccagatgcagaagtagagacaggtgggattgaattaaccacaggtgcccggggctgcaggccccaccgcctgcccgctctgcctgcaagattcaataccgccccgtgcaggttagcagcacattggattccaacgagtcatattttaacactgctggatagttgcaggtgacagaaaacctgtttctttcccattttatacatccaggaaatttgtaccacatgcagcctgcatgtcattacacactttaaaatactgcattctctctttctggagcccgcggacccatcacaaggcagataaaatgcaggaccgagggtgagagcccctctattggggcagagagagcagctaaatgcagggcatctcatcttactgttaagaactgattcctcccttccacccccaggaggatcatcctagaggctgcaggacaatctgttatttccccggggaggtcggcgaaggtgttagctcgggagaagcaggtgtaattacagaggcccaggcagggcactgcattaatagatgtaggctcttcagctagagacttatgtacatgttgctgaggccccagaccctgctgaggctccaggtccagagagcaaacctcctgcctggtcccattaaagcactgagccagccccatctctccccgtccctgactccagttgacagccatttgcatgatgttctcatctgcagattgcacttcttgctggggagctgctcagaacctaccgggaggggttttggaaagcggatttccagggctccagatcagtgcactgagctctgcagctgcctggatggccccaggcagctcagcccccaggctttacctggtgcagggatctccctcctactgtggccaggtggccgccctcgccactgcggcactgcctacggagggtcacagctctgcctgggggatgagggatgagtcagctcgccccatccctgctctccgaagccccaggtccctcctgagccacctttccaccttgagtccttagccccctgagctttaccagaatacgcactgtgtgccaagtgctgtgtcaggttggggaggtggtggggaacttgaagcctagcctctccctgagaacccttagaatggacagggaggcctcccttcctcctgtcaatgaaccatcactgagcacgttctctgtggctgctccctgtgaggcctggagtccacagctgagtttgggcagaacctcagccctcagagctccagagggttctcacccaaccagaagggctattggctccctgccctcagctcccctggtttcctctgagctgggtcccagcaacacaccattgtccagtagctctgctgggccgcgtgtgcagacccagggatgcagaaatacatgaaaggtcaagttcatgcccacaaggagtcagcagcctcattgggcaggtgggccccttagaagctaatatggaggggacacaagaggcaggcagctcccagccgcagtgctgaggtttggacctcaggctcactgggctaggctacacagaacaccaggccggggggctaacccccctctaaactggaggcctcaagggcaggacaaactttgcctggttccccatcaaatttcagcacctcgaatggggcctggaatataataggtgctcggcaaacttgtcagttgaacagatagactcacggggggtctgtgtctcctgcatcccccctggttcctctccaggcccccctccgccctgccaggagggtgtgtgtgctgaggcagcttccccagggactggacagagtggaatccctggcccttgtctgtgcctgggccacggtttctttttgtttgttttcattttggtcagattcacataatgcaaaattaactttttaaagtcagcaattcagaagcattagtacatttacagtgttgtaccgtcatcaccactatcttgttccaaaacactttcatcaccccaaagggaaactcccaatgcattagcagccgttcccccttcttccctccctctgcctctagcgaccaccaatctgcattctgaccctataggttgacctcttcagaatgtttcctaggaatggaatcatacaatgtgtggccttctgtgcctggcttctttcagtgagtctgttttcaaggttcatccatgttgtggcgcatgtcagctcttggttcccctctcggggtggataacgttccattgtatggcgagcccacatttgcttacctcttcctctgccgatgggcatgtaggctgttcctgccttgtgtgaagtgtgccactgtagatatgtgtgtgcaggtacctgtttgagtctgttttcagttcttttgggcagttacctaggagtggaatggctgggttgtatgctaatcctatgtttaactttttgaggaatgggccacagtttctctatgaagttcaaacgaggttcttgaatcggcttccagttgactaactagactccaaggaaacacagatgaaataagaccccatcccagcccccaggacctcctggcctgctctcagcccatgtgaggcagcaaagctgctgctgggacaggaggaccctaggggaagctttggagagtccgagctcccagcagcatctggtggcagaaccttcttttggcttcgtccctgaagcataaatgtggaatcgtgtccagcggcagcctgggttccccagcctgggaggttcacgggaggaggctggcccagaaagcacatggcccagaatgagccacacggggtgactgtggctttgggcaggtccccctctccctgcacctccctccccactgtcattatctgcagagtcaggggtgggcctgacagcttccagcagtctgtccaggtgcctagatctctatactcctggaccccaaatctaggaaccactaatcaggaaggaaattcctccaccaatccttccaggcctttccacagagaaggcagcccttttagcattttatgtccggatgaaatagttctaggcactatgctggaacccccagctctgagccaaacaggccttccctggtccccccaagtcctgggggaaggctgccctgcacctgtccctggagggggacatgtgggcagatggcacaaaggtggtactggccataaaagccatgttgcaggcaacaggctggtcccattggccttccctgctctctcctcagtaggaggcaaggcctagagagctgacccttaggcagaagaaggggtggctgtggcagacaaaagacccccctgagggagggaaggaaagggacggtggggttcccactttccttggagctgctgtggagtctttgctcactcatgctgggacccggccccccgcagcagcccggggacctggaggtgcatccactgtggtgagctgcagcaggcgtgttgggttaagacctatgtggttggttctgaagagagctgggaatttcaggggagacctgagcggaaccagggaggatctgacatttttataaaaggaggtccctgtgctcatccagtggggaggggatcccagagcttatgtccccgaggggagctctgactctgtccccctttctgtttgcacttgggcagggctctcgagtccttggaagctgccgtttattttaaaacagcccggactccttgaggaagctgaggagagaggaaatggcagaggcgacctcgcctcacacttcctgggcgggagtccccactaggtggccgcctgagccatggggagctattaggaggatcctgctgtaatcaagagatgggcaggcaggggacagagtgccccgtgtctggggaaactgaggaggtttgtgtttatcgaagaccttttatgtgccagtcactgcaaacgtattgtcatttaatccaacaaacctgcaagatcagggtcatccttcatcccctccctactaatgaggacattgtgattcagtgtcgcggccactggcccacagtcatcagtgctgctaagatgtgcaggcgagtttcaaacccaagtctggcttagtgcccaaacttccaccaggcaccccaggcccaaggccaggcaccccgacctccatccaggaggaccgagtgagtttctctgcctgatcagggaggataggaaggggcctctacccccgcttcgtcctactcagctctctcctcctgagggtctgaggcctggacagcagtgctgggcgggaggcctcagtcagcctgggtctgagggtgcagagctccctggggacattacctcttcctgcaaggggcaaagttcctcagtccctgtgttaaaggaaggttggcttctcctctgcccgagatcccagagcgctcacagtgcagcccttctttctgctaaactgcagacttattttatcagcagttattattgaagtctcaccattactattattttcattctgcagatgatgaagtcagggctcagtgagactgagtgattcagctggggttcatccccctgctccgtgccagagcctcggaggttccgatgcactcagggccctgggggcatccagggccggcctggctggggcagcgcatctgcaggtgtttgaggcacatttgttttcaggggaaggggcgctgctgtgcagaccctgctaagtctgttccaggacaagacatgctgcccatccctcctgcttctctagtgcaggagccgcggctcggcatggttctgcgtgtgtgtttccgacactggctcccaggtggaaggcctgatgccgccctgctgtctgctctcttttgtagagatgttttcgtgaacttgagaaaaaatcgggaaaaggccgattccctctgcccagcccattaattctgcatgctcaggccgaattaaccttggcaagccttcaagaggagagagtaattctaaccttaaaaatctgctgatgaaagctggtttcaggaatccaactcctcttaatgtcctggcagacagctcagccttgcattaacatagccacagaccggcccggcgtttccctccacctgcttcataagcaaaaccctgttgtccgttttaagcaagaatccctgcccagactccctggccacatgcagccgcacatgttggagtgtgccgtggatacctacgtggcgtcacaggtgcctagagcgggcggcgctggggagctggatgccagcaggctctggagctgagtagtaaccacagccaggaatcccggcagtgccagccccgcagacgcctgcccacaggagaagagagccactgatttctgggcagcacttggccctccgtgccgtccagaatggcctcggggagtgggctcctggcatctgcatctgctctcctctgggaatggcagatgagtagagagaaaggccggccacctggggctgtgtagccgaagctcccagcgccagagggtacagcctgagcctccttaccaaggctcagggtcccaccgttggtcatccctgaggctgaaatacacaacacccctgctggcctaacaggctgttgataaggaacacatcagacccagagctacttgcaggcattcgtcagagatcccttgtgcttaatgcaggcagacctggtgaagggtgagggggtacccataacagagggatggaggaagggagggagggagatggaagggagggaggaaaaatgggagggagggaggaagaatgggagagagggagggagagaaggagggagggaggaagggaggaaggggggcagggaggcaagaagaatgggagggaggaaggacagggagcgggaaggaggaaggcaggccatcaccagtatacaccactctggagaccagctctagccacttggcagggctccaagaaataggtctcagcggtacattttgatgaaagagagggaatttcactttatttatatattatttatgcccagtacttttaggaagtatttgagatagcaacagcactgatacattgaaataggctaaaagaacaagagccagtgggtgggagataactgagcaagaatatacacgtacactgagcagagctcctgctgatgacaggaccgcagatcccagcagcctggcacacccagctcagagaaagcctgttctttgctggggcccgcagggagccaggtatcaggacagatttctgagacacgaaaggtgcaggtctccagctcccgcttggctgggcctgtgcagggtgaggagctgggctgccttccccaaagcggtttggcaggtgctgggacacagcaggggcccatgtgggcctggctgaacgtcctcagagggtgggaaaacaggcaggtgagagtggccaggttcctggacgtgaccctaagcagcaggcgctagagctgacgagaacagcccatgtggagcgtgcagcaaggcccagatgggagcagcccatgtggagagtggagcgaggcccagcagagttcggcgccgccctcccgttcctcctccctcccattcttcctccctcccttccatttcccctcacccgccccgccccctgcgccgccgtgcccctcacccgccccctgcgccaacgtgcccctcacccacccctggccttctctgacttgagattcatgacttggatcaactctttctctaaatctaaatttaccttattatcaatttttagctattattccattttatgcccactaatttattaatcttggaacccccaaaaacaataaagctgaagctccagatattttatttatatctttcaacatgatttttatggctttttatctaaaaattcattgaatttttattgccctcctcactcatgtcgtcgttaggccggcggccgctttatttagatgtttcccctgcagatacttgggggccccaacaggaaggagctcaggtgaggggaggtgggtgggggcagaggcacgggtgccagcctcctaggggactactaggttaggtcccctgcccctcagtgtccccgggccaggctgtgtcccatgcccctcagtgtccccgggccaggctgcacacctccctggttcctttctggagcacacactgttctccgcgactcttacctctgctcccattttgccttccagcttgcaaaagggcctatgctgcaaaagcaatctagaacattcctcagagaggctgggggagcctccagcttgaagacccagtgtccctctctccatgacccccctgcagagtttctcactggtcttcatccagaccgaggggccctccttcctgttccccattcgacggcacacctgtcctccctcctgagcagagctctggggtctccagggtccccacctggcgggtcttcttggtgctctctgcctgcccaaggatcccccttccgcggagctccggccgacccagatacccaggggaggagtctgtcctgtcccccacggccagaggcccgcaggcactttctgcctcatgatggggtggggcgcccacgtgtcctgcgcctgcctggcgctgcctggttcttctggctgtttccctcaccagcttcctgtctgggggtggggactagggggtggcgggtggccagctttttgacgtttgctgccgttcctggtttctatctgctcttcaatcgcctccatctcaaaggaaccaaccttcatggccagactgggccacctggtcccctgtgtccctccagggtgtgcaccagggcttctgatgagggagacggggttaactcctgcaggctttgccggccaggggactggagttcagattctagctttatcatgcccctgtgacctctgccaaggaaggaattgatgcctctgagctgcagttcccacatctgcagagagggattcatactactcttccttccaggagggtggtgaggtccctggaagggctacccttcctcatcctcctgtgtccactatggcagaaagagtgatttaacattgtggaaggacaggaccagccagaatgccaagccaagggacggctactctcccagggagccctggagaatgaattttggggagccttcccgcccctgcccagaggagtcccccaagaaagtgcagtgttaaggggctgttttcaggagagcctctagtcccacttggggagcctgggcctgagctgtggccggcacctgacttcataacctgaaggcatcagggtttggggatccaggccagccctcttgctgtctggcctcagtcccctggcgtggcagggccacaagctgctttgggagacaccattgcagattgtcttaggaaagaggccaggctagagccctggtcaatgacgatctaatattccaaatctctgctgtgacccaaccctggaggctgaatcagactgcaatccatttagctcaaactcgttttaaagcaattcactatttaacaagttctgaggcgccatgcttttgcaggcaatatgtgaattgaatcatttggtctaatcttagattaatacaaaccaaatccttcagcgaggacagtcttgggagcagctccaggacttcatctcattgtctttgatgaaggcgggtcccaaagaagacctgactctcagccaatggcacgggtgtctgagcgaggaccagggggtggcctgctggggaggaaggagcaagggctttgcggtcagatgacgcttgtttgaatccttctgcctgttcctagccgggtgaccttagacaaactgctgagcctgtctaggctctggtcttccccacagatgcctctgtgcaagacacttgtgcaactagagaactagggtaagaggaatccatgtcatcctctccttgccccacacaggatcttgccaaggcctcccaggatctgcgtctgcgttcagggtaccctggggagcaatagggctgcttggtcctcctcctgtgccttgctgtacctgctgctggttagggagctctggaaagtgctggaaggttttcactcccacctgctctttgaggagcacctacttcttcctgacgtctaggctttgacaggaaaggaaccacatttttacccccttctgtgagccccacagccctgcccttggacatcagcgtagcacactcaggccctgcttctgctgacagatctgccctccaggctgcaggcccctgctcaggtgctgccctaccccactgacagtcctgggcttgcagtccaggtaagtcaaagtccctccctggtgctgtcaccccaaatctggaagagagagactttcctgcctcttgggtcacagccggaagaaggggactctggctacgtgccacatgaagtcagcccaactgtagtgggagagaaacagcgcagggaaggcatacagagaggagaaatggagacatgggatggtgagcgggtcagagccaaagttctagtcctgagcctgcacttgagccatcagttctcagagcaatcctgagtccttcctggaaatctgcttcaatacacagagtctggaccagtggagaagggcagcgccataaaatcacagggcctttgcttcaaaggcaaggccatctgccagccgctcactgtgggtcccttaggggagattctgcagaactgtgtgtggagtcatgcactcggcccctgcagcttcaccccgcatgcgggacgcggatgagagagctggggaggggcccgccgtcctctcccgtggcggcccctctgctttgcatcccttttgtccacctggccaattccctctcaccttttttggctcagcacaaatgtcacttcctcttaggtgactttgctgaccttgaatgaaaaggggacacttcatcctccgggctgatcctgccccctcggtactctgcccttagcaacagggctctttgatttggtctcgtgtgtttgcccggcatgtacacgctctctatctctctcctctacgagactgggggaggctggaggacaagagctcaaggcaggcacagagcagacagcagtgaaaagttactcacatgggatctggtcccacacgttccttggatgtccaagctacggcccagctggtccaggatgccccgttctggaggctgtgactgccccccccaaccccagcctgcccccagttctgcctctcacctgctcctgtcccctcattgcttgaggatagcattaaaccctcatcttctaggtggattttcccttcccttctatgagctcttttcttccatcagctttataccctggacacattttaaaaactgttcatctttgtcgtgggtacatcagatacaagcaagagtgataaaccaagcaccaacaaaatctatgttctctctgattgcctttgtgtagacagccacttccctagcggcagagagatgggcccagtggagtctctggggccagccacaggggctgtggtggtgtggaggccaccacagccagcctaacgtggtgctctctgacccctaccggtggcctggctgctaggactggggcagggctgtttgcagaggaggtagcagagggaccctcataaaagaggattatagatggagatttgctggtaaacacccctgtctgccgcccccgcgggtattatccttgcattagagaaggttttagggaagagaggggaggggagctcaggaatgagctttgccatcacaggcacagaaggctctggggaatcttccctggttgattcaggcctgcccaggtagaacaacaggtgccaaccttcaagcatacggactccccaagtcctcatcccttgaagccctgactcccccagatcgtggcccctggggtcccaagctcccagtgtctttgccaaacatctctgaactggaccctaacccatgttctctagcgtgggagcatcggtataactttctgccattgctgtgctgtccaatgtggtagccctcggccacatgtggctgttgagcacttgaaatgtggctgctgcaactgaggaactgaagctttgattggatttaattttacttcatttaaatttgaattcgaacagccgcagtgactagtggctgccaagttagatagcccagctttaaagacacctgttgagcaatgccaaggatgtcttttccagtgatccatgaaattagatgctggcctcacattttcccagaatgggaggtcaacagcaagccctggcttctgggggttccctgcctccttgtgggaggtggacccaaggaaacagcataaaaggggcttccctagaaaaggtcttcatggcagaccaactagaagttctagggtcattttgttcctccaggggaaaagggccatgcatgctcatactcaggaccagaaaacaaacatcccaaacgaagtacaattggaaagacatttccagtttcctttgtgtctgtatcatatgcagtccatgatctcccatacgcctgggccatgctccccttccctgccctgcctaagggcgcacaggaaatcacacatattgagcacctgctatgcgaatgtcactagcagtgatttaaaattgggaattttttgaaggacgatataatccacacttgtcccaacctgacaggtcacaggtcagcaagcaatgctccataggccaaatccggcccactacctatttttattttatttttgagacagagtttcactcttgttgcccaggctggagtgcaatggtgtgatctcggctcaccacaacctccgcctcctgggttcaagcaattctcctgcctcagcctcccaaggagctggtatttttattttttattttttgagatggagtctcactctgttgcccaggctggagtgcagtggcataatcttgccttactgcaacctccacctcccaggttcaagcaattcttctgcctcagcctcctgcgtagctgagactacaggtgcatgccatcacgccggctaatttttgtatttttagtagagatggggtttcgccatgttggccaggctggtctggaactcctgacctcaggtgattggcctcccaaagtgctgggattacaggcaggaaccaccacacccggcctaactacctatttttgaacagctgtgaggtaagaatagcttttacattttttttaattgttgaaaaatagccaaaagaagaatactcatgacacttgaaaatcatctgaattcagatttctgtgtccgtggtagtttgattgggatgcatccccaccccattcctcctgccgctcctcccctgccctggcagggacctagtaacccccgaggccacccggctctcaaagctggacacatctgctctctgactcttagcaggaagtctgccagcccacaggatgggtgaggtgaggctgcagaggtgaagagtgaaatgacccgaggcagagtccacatcctccctccacccgtgtgcccactgtctcgctctgatgagtgttcccagcgtctgctcctaggccactgggtcgggggctcctggagggggacctgagctggactccagctgagcggggtcttcggaggcagcacagggaggttgtcctggtgaatggcactgtgtgcggcagagcctataggtgggcacataaggcctcctggggccgggggttcatgtgagcagggacacggggagggctgccctgtggcccgctgtgaccttcaggccccatctgctccccggggctccatgccctaagcatgctctgctcaggacgccttgggtaagttgctgaatcctctgcggcttcccccaggcagggcatgggaggtggaaggaaagggatggagggtgtgtgtgtgtcagacacagagacagggacaggcaagggaaacagagacagggagagacagagagacagagaaagatggagagagatagcaggagagacagagacagatacagaaacggagagagaaataaagacagacggggagagacagatgggggaaatgggagagagacagagagaggacaagacagctgcagagatggagagagagagaaagaaagagactgagaaagagattgagagacagggagagacagagagagaaagaagatgagacagatacagagatagagaaagatagagacggaagaagagagaccaagggacagagacacagagaggcaaggagagagagacagatacagagataggaagagagaaacagatggtgggagtaggtgggggcagaaatctgctgcgtcagatgaggccgtagagagctggccgggaagggaggtgcccacaacataccaacctataagtgatgtgcttccttcttgggccactaagccatcactgcccagccttcaggagccctctttggtgtgggacccccactgcgtttgagggggctctgcggccatgctcccttcagaaacgccactttcttttttgaggcatttactttgagctgaagggagctcttgtttgctgttggtttcccctgtaatttcatctttacttttttataaaaataaataaataaataagccctatagtgtcataaaagcaattttgaatatttaccaaaaaatttttccttgctcaactgccatgttaaggggaagctgccaggccttaattccccaatacaactgattcaaaggttgctttcatctgaaaggtgatgtcctcccaggtttcctataaatacctagttgcttcctttctctctctttttgtgtatacacaaaaataagggaacccacggcatgtactccctcacactcccacacgcgtgtgcacctcacacgcggatttatccacgagccccggaatgtggctccctgcagtgaaaagctcaactggggaaaccccagaggaccctgagagcctgatcaaaaagcgccaggagtttgtacaacacaaatcactacagacaaacttgattgcttttttgattagtggataaagggaatggattcgccacacggcctcatggaatattgtgcaattaatccccaattggcttggtaatgaccttgtcatatggcctggaatctggtgaaaagactgcagagtgagggcggtggtagcagctagagcctggggtcagggctgggctgtagggtggtttgggccaaggggtgaatggaaggggagagggaatctcctgtccttcactggctgcttttcctgctgctgtgcttccctcggcaaaccctgctcatccttaaagcttttgcagcctcctctgatgtccccttccggtgacaatcactgatgagggtgcacactcacggggggtccaaggagcatcccgagggttccattgctgcataagctctcagcccacacagccacccgagagaaaggattagaatcgtacccatggtgcagcctggcaggacaaggactctctgagcccaagtcacacatctcccaccccaggcaggctccacctctcgccgaggccctcacagccaccccggctcatcagcaggggattgccgtgagctgctttccccacttggacagcaaagcgcgactccacacaagtctgctttccttgaaactgaagctcaaccctttaagccctaaatgtagagccatttttcaaggttgttttctagtgtgtattagaagtccttagcgttcagggtgccacgggcaaaacttaaacattgaccgtctctggagtcctttcctgggacctgtgtcctggagctgccagtggggagaactgggatatctttattcaaaaagcctaaggccctgtgccctcaggagcccccattctgagaaggcagatgggtaaattaaccaaataaccaaccattggggtagcccagtgtgctgagccaggcagcatggaaggggtcccattccctgtgggcttcctgagtccctggggctctttgtgtagcttttttctttcctcctctggtactgtttgatgtgatccttgcctattggggatctgccttcagccgcacttcccatccctcccaccatccagggaccacgcttctcatccaaggagaccaggggcatgggattgccacagtggttagaggagtatctaaaaatggagtaaccgggttctggagtgagggcccgagggttcctctgattcaaatgagtgagccttgatgtagaaatggcagtgtttctttcatcttaacttcattttgtttatcggatggttctggggcagttgtgggtaggccagagaggtgttaggaggcttcaggggaaagcgggcctgggccttcctcttcttttgtaggttcacagaggaaacacagttggtgtttgggaaattctcacctctgagtgtggggttcagagatgctgaagcccagtccaggcagacaggcaggcaatcgagggagaagtgatggtgaaaaccaaccacggtcttttcaagtccaagagaaagtagtggacagagaataagacaggtgaagagggaaagtcattgcaaagtctagagaggaatagagtggggaaacagcagatggaaacctcttatttcaaagggacgagagaaacacccctcagccgttgatatctccctccatttggctcatcacatgagtcaaagtaatgaacctgcctgtgagaacatgcaaattccaaaggaaaggagatggtgaatgtcacaggtgggttgcttgttcattgcaaccaaacgcttagacaaaaatgtctagacatgcgtctccttcggcaaggagtgagttatcaaaccaccaaaacaacgaaaacaaaacaccgtgtcttgaaaaccagaaaagtcaagaaagaatattgctttcttaataataaatacatttcatgggcaagaattgcaagggaattgtttaaattaatttccgctttgtatgtttggtttatacagggcttaagtcccagctgacagtgatctgtaaaagttctaacatattgaaatctgattttcttgcagccagaatcgcatagtccaaaatgatttctctgtcaactctgctaatcagacaggcagggctccgatggactcctagttcaaccaaattgcacccgctcttttgggggtgtaaataatagctgatgaaagctttaaagcagagctggtggcatttctctctggagagctggttcaagggtatggggacaacagtgagattaaaatgagcaaggagaggtgggggaggccttttcccacctggcagatgtcctgtgtggctctgaggaactttcctcccctctatgccccaccccttctagagcggatgcagtgggaagccaggggaactctgaagctgatggaagggagatcattccagtctggaatcagaggcaccaaaagaaaagctttgcccctggctttggtgggggcccccatcactgggtgccttgagacttccctctccaaattgatgacctgctcaaggctgggcccctccctcccactcagaccttccagctggattgcaagagggacctgatcaatggttctccttaggcccctttctccatctcaccagcaagcctggcccacggtgcccagctctacacacgcaggcagcaccagagaatcagagcagggcggccttcctcaccaacatgccagccccaatgaccccacccactggtcaactctgctcacctgggtctaggtgatgggcccctgagagccatcccgacccacagtccacccttcctgaccttgactttccacccaccttctccaacctggctctggctgttttccaaaaccaaatccatctgcaaaagatgcaggattacttaacaaatatatgaataaacagtaggcaaagtcaacaagcagggatgcacaagaggccccacaagctctagaagcccatcctgggaagtgccgccccaccctgtcccccctggttgggctcgtaccggccagggccccctggccaggaaaggtctgtagcatgtatgtttcatgtgtttaatgaattctgtaaccatcagccattccctgtaccccaaagggtcttaacctaggctctaggaatgaactacagagtaactccaagcccctaaaattataggaaaatgcatacgtaggtacatttccctggtccttggctgtcctgggttctcgacgcctctatggctcccggagggtaaggccccagctgcccatcgagtctgccggctggtgtgtccccacggggcttcgtaggtgctgtcccagagccttagtcttggagctggagccagacgcagaggtgccctcggtctccctgggccgctgccaggcggctgtggccccttcttgctccttctctgttgcgccgtcttccttccttccttccttccctctttccaactgaattctcgtttttcctctctccctagtgcttgtacggctgctatgtccattcctccatcatccccaccttccaccggaggtgctactggctccttcaggtaggtggctgggactggattcttcttctgtctctggtgctcgggaagggtctgtggagggcactgagggcgcggggctccgcatgcgacacggcttcgggctgagagccctggtgagcttgcctagggagacttcggctgttgcggcactgaggccagctcagtggctgggctggtgttgtcatgtgtcaggaaggggagaaggcctggtggcaggggtagctgtcacccactgatgggaaataaacctaggtgcttccagcttccaaggcgcctcagttttcttttgatgaggacaagaaagaaggccgagtatcctgccctgaaatgcctgttggctgaaagctgtacattcattttctctcatgggttagttacaaggcacatgtggaaaacaggctcccggaggttgccaggcacagctggattgattgggatagctgtggggaaaggaggaaggagctccgtaatcgatttgtgatgtctgctgtggcagggatggaacaggttgtggctgggcatgctagccattcctgtgggagagtggcctggtgcccagatctctgtccatggtgtttgtgcacagcgttgctgaaccaggggtgggtaggtacgggaggcccacctggcctcttgccctctggggatcgtctgccagctgtcttgcctgccgtgtgggcgggaaggtctgagggatccatgcagtcggactagacataggtccttttcaaaatgcatcctctgatttgcagctgttcttggtagaacccattccccatggcctgcctctgtcaccccaagttcttactgttgcctctacccaggagttgctgcctgaggcctttcccaccatggttctactttctgttgttcaaggcagcaaacccctggaccttgatggtttagggatctctctgacctggcgggggtgtagttggaggggcctggcagctggggaagcaagtcccccagtgctatgacacaagctcagggagaaaagagtcacacatgccacggagtgcagagaggctgatggccacaggagagctggtctggaaggtgcccacagggccggagccatgtcgatgtggaggccgggctcagcctagacagggccctctatccatcggctctgcccagccccagcctccaaaccctttccattctccctcagttcccagaaatagccgtctgttgttcagcaagttcaaatgatgcccgagaccatccggggacgtgctgatttgcagaggctgcttcccaatacctcaccctgtcatcagtttccctggctctgcctcccctggaggctgacgtgctagcacctgcttttctaattgctcagacctgtgtgcttgaggaggggagttgtcacatggtcatgggatgaggcttttggggtcttgttactaggaattggtcccaaggtgttccaccccttggcagagggttttctcctctacccgatgaagggtggggttccacccgaggccagagttctggcggctgagtcagagtcagagcatgtccttgagtccccagggacaaactctggcttcccaagaaacaccatttatccaaagcagcctgcagccctgtacactccttcctgggcctccagccccatgggtctggtttctgcccttttccttttcggtttcatgccccctggtcagaacacctctttggccattgccctcctgtcggggcagcacctggaagctggcatcctgccagcagcccagccacccgctcctccaggctggtctgctcctccaggccttttctcctgcacccacgcctccgcctgcctcccctcattccatcatgcccttgtggctttttaattccactaaatttactttcctggaatcagacaccattgggcagccacgaggtctgagctgatgacttcccaagctgcattctgctcattccgggtccctcctagattcagctgctcctgttcctcaactcgggccaagcgaggagaggggtcctgctctctgccccagccctccctcactggcgctcctgttttccagcctccgtatgctggaggcatacctggactgattcatgtgtgtctggttcgttacctcccagctggcggggaagttggagtctccccgaaggccaggatggcaggaccaggcttcttcatggccgagctggggcctcttcatcttctctgcccaagcctgggggagccatccctccccatccctctcctctgtgtcctccagcatcagacttgtttctgtgatcagatcacaaagagggagcgcacacaggtgtagggggttcctgctcccccaggtctgtgcggggcaacagcaggttaaggagctaaggccaaagcaattagcacaatgcacgccctgctcggagcccagagcctatgtggcagccggtgccgctcagggcaatttgttctggtgctaattacaacaccaggataatgatgctgtggccaggtttaatttctctgatgttaaataggaaagaagccatgagttactggctcagatggaaattggctcaagtgtgtctctgacaccaattaccaagaaaaaggattaggtggggtccaaggtgtcagggcagtgcccatgttgggagctgaggaaggaggctgctcagatgccagccccgagccagcctggtcctctgaatgcaggaggcactaggaaagggagtgatgggctggccatgctctctcagccccctgcagggggtgagccttctagaaaggtaagggcattggaggaaagagggaggaaggaaaggaagaagtgcttctggaaaaaggagactttctccaaggaatagcacccactgccccacctttgtagcctcagttcagtggccgcctcctgccggcccactgtgaactcgctcctgccctctgagatgctccagctgatgtcacccaaggccacttagcacttagtgggcacgtctgcctatgttggcctcgattttcctctccaactagtcagctcccaagggagagacatgaattcctgtctcccctgagtgcccagcccagagccacagccaccacagggcaggagccagcatttgggagagccatgttctgctgtggtgacgtatccaccccggggcgggaatgagcaggcctcgcagactcggggcctggagctcaggattggtgccaagatttacagagaagggcctgagttgacgtggcacgtaagcttctgagtcatcgggctttcaggggagggtgctacctctctgtctgtgtctgtctgtctgtctttcaggctctctgtctctctctgcgtctctctctgtcatgttctccctccccatctctccattgctgacaaatattctattaggctatgagcgaggagacgggcagggagcctctcacaggcagggcactagagcccatgtggcccataggctcataaagccattggcatgaccagtaaccaccatgtgaggtcaccaggacagctggggagggaccagatgacctgagctcagcccactccagctgggcagggccagagccatgacctggaagaggccacctcttcccctctgctggtggcacccatcctcagcattgctgggggctctgtgtcacagctgacagggccttcaggctcccctgagcctacccagtgcattttctagaaggatttctgagacccagcgagagcagggccaggcccaggtcacccagtgggtcaggggaggagcaggcagtgctccgttctcccgatgccttggcctctgcccctaccgcctgatgtgggtgtcactgcagccgcaggaccctgagcctcgtgaggtagaggaggcatgaaggggtgagctggacagagcggtccctcctgtttgggattttctgatggtttcgaggggtaggcagcagaggttcagggccccctgacctcctcatgtgcccctttctcctggtcctccaccttccgtccttctctgcattctccgcctgcccccgcaggggaccaggcccccattccaggccagacttccctgcagattctgtatggctcatttggaaactatttctgcttctaatgagtgttttcctttgtgcccttgtcctctaaaatgcttaatgactgctttccgtgctcgagtgaagcgggggtgtgtccccgcatggctgccattgccaggccggagctgtttggctgccaagcccggcttgcttgggtggaggcagcggggggtccttcctggcccacgctggcagcacagaccaagcctgtgggggcaagagcacggctgcggggagacgaggaccctggggccttaggagaccacaggacagggtggcagtgcaggtcggggctcccacatcactggaacaggcagatctttgagcctgagttctaggagttgagctccttgggggactctggattcagagtctgaggagctggattccagctctgcctggacctacctgagcaccaggagcggtgaccatgccactggacacctctggtgctgactcctggctgggcagtgagcctccaccacgcaccacacttcacctgggagaaaacagcctccgagaagctccacagttgctcagtcaatagggggcaaccatcgctgccctccgctgcctcccctgggggcaccaccatcacccctgtttatagatgaggcatttgagaatcagagagattgggcaccttgtagcagatcacggaagtggccagaaagtgggacagctgctgggccctcagcctggatgctgtctgcttgctgcccccacatgagcctttgccagccctgggtccccctagaagtagtgggtgcagggcacaggggtgccatcaccccctagagcaggcaccgtgagactaagcaccacaggcattgtggccagaacagagcccagccacagcagcctctgtggctggtgctgctgagtggggactcggggcggggacaatgccagttcaccatggggttcactccaggcggtcctggccccaaagggcccccatgtccaggagcgaagttgcctttacctgggactcaccaccccccaggagaggaagaagatgccttctccatggggctgcctctgggcaggatccaggcttccccacaaggcctggggctctgaaaccaggttcacaggggagagatgaagctccagatccccaaatcagtgggccttccatccccagagtggtcagctgcttgtccaccctggggctgagagcagggtttcctagggtagttcccagagaggggagaagggcaaggctgcagggagaggccctaggggagatgccccggttccactcctgccccaggccatctgccctccatgggagccctgcagagttagccagaacatggatctctccagccagagcaggtcccattggcatacttggccttttggcccataggaggaacagctggggctggggcagctccatggcagagggaccggcagtcctagagcccaggctcggggctcccccaaggaggaggaggaggacaagtggcctctccaggctgctacagcctctggagttccatactcaggccctagagaagccacttctgctccttgttcaggagaccttgcagccaacagccttttcagcctctgccccagacacaggccctataggcctcagcccaggcatgcccccagggagtcctcccttcatgctgcagccctcaagaggggccgtggggccccctcactgctgaagaatcttttcagagggacaggccctgcaggtccctgagggcaactgagtcccaggcacccccagccaacagagaagagagtaggccgtgagccctcctggcccagctccagggaccgtggcacctcatggtgggtctgagatgagcccagctccacactggggcattagtgtagtttttctccactgacgccggaacctggctgtggaacgcgatggcctctctgagccgactgcctctggctccccaggaagggtcctcaggatgtgtctcttctgggagcaccaaagcgtgctgctgtgtcaggtctaggcatcctgcagggtccctgaaccccagcccctgcctgctgcaaccacacaggaggctgcccttccggggccacccccctggacactgggtgagtggatgggcaccatcagccctctgtgtggggtggggtttagacccgtcaaatagtggggttaggatcacccaaagaagcacctattagctgtgtgacactgggcagtttgtctaatttctccgagtctcagttagctcatccataaaatggagccaacagcaaagaagcagctattagctgtgtgactctgggcagtttgtctaatgtctctgagtctcagttagctcatccataaaatggagccaacagcaaagaagcagctattggctgtgtgaatctgggcagtctgtctattttctctgagtctcagtttgctcatccataaaatggagccaacagcagcatggaatacagaggctgttggaggagtggaagtctgcattgatgccgtgcataaaatgtcacccagtccctggcacagggcaagcatccacgaatgatagcttgatgctgccagcaccaggtagacctgtaagtggacatcctgaatcccggagaaagcgtctgtgacatccccaccccatccctagcatcccacctctgcattctctctcccagaggcgttgagctaggctgagccagcccctcccaaagcctgagccaggcaggagccccgctggtacaggcagcctctctacccttcataccaccctcttctgcagcccggacagagaagggagcagaggctacaccagggtggtgctgtcattgcaataaatgtcccttagccacccaagagacttgatgtctatttggagaatgagcagctctttggcaacccaagtgtctccccagaagtgcagcctctccccgcaccccactccaggaccatgccctgcagccctcaggaaggactgccctggcggtgagctgtgagctcggtcatggaagggactgcaggccaagtgggacaccctgaagagtatggccgcgctcgcccctcagcccgtggcctcctcctggtggtggggacctctccacccggatgagctgggctcttccctggcaggccatctctaggaagcacaagctagcttaacaggatatcatttctttctttctttttctttcttcttttttaaaaatctttcttaaaatggagaatattatagcttcataaaaaatacctgagctttttgctcagcaaccatttttatgtttcatcagggtgaaatagaaatggcttggaaataaagcctgacggcactggctctgtacctgggccttctactgccatctatcgctggggcagggctccacggctcccaccaaatgaggcttggcgggggggattagagcaacaggaggccttgctgtcaggctgacactctgccccaaagaggacatttggacccatgtgcttcaaggaaaggaagcaagtcgctccctgaggggtcctggcctccacatctgggctcagcagggaggggaaggtgtcccaggcctgccagaccctctgcgcaccatcccgcagcccagccctggtatctttggtgttataagcaccctgtgttaccttcagccaccaagagtggggacgtggctgatgccgaggtgcccctatacacgctcaccaccgtgcatggctcaggagaccacagccctggccgtgcgtgacggccactgagcgcttgatcagaaacttcaaggcctggcttttggttctcacagctaccctgggaaggaaacagggcaggggtgagttcgtcccagtgtttcatagaagaagaaactgagggtcaggaagagaataaggggctccaaaagacatagggtaggcagggccctggtccaggccctttaaacagacgtggtccctgtcctgggggagcccacaggccacagcggccaggcccaaggtgcacacatgtgcagtgagcagagatgagaaggaagagcagcttccagagcctggatgtgctggcctcacagggaccagtcctgatgccaagaagggcaagagaaaggttgaccgaccctgacataaaccccaagtttcccctgccctggcccttggcgtccctgtgaggctggggtctgatgggacctttcttccacacctttggccgccacagctgagctgaccatgggcacactccagagcacttggacctcggcaggggacactgagccagcccgctgtactccaaggggtagctggaacttggcagcagagacaggagtggccaggccctgacatttgggcccttggatccttgcatggacagcagatggaggaccctgtggtgtcaaagccatttctgaccctagcctagttggtggtccctaaagctggtcaagacggtggatccagagaaggagacacagaatgggcggggcggtcaggggaggcttcctggaggaggtgagcccaaagttgaaggatggaagaaatggggagggggtgtttccatgccctctgacatggggcaagcatgggtcacagtgctaagtgctcagtgagactaacaaggccacttgaggggtcccagttcccatgagccagttccacacacctcacccggcacagggctgtctgggaagaggccctcaggacaggtgtcccagcaccggtgccagccaggtgatctggaggggagcatggggaagggcctggaatcctcctgactctctgctgggctcagaagagagcaggacaggaagagcctcaccagaccagtgcatgcagcttcaacatggccatgcaagctccccacagctgacagtgacagcagtggccatcctcatcctcatcctgtcaccagtagcaataacaacagtcatcgaaggctgcgggcaagcactcagcctgcctgtgaggccagcatttagtcactgtcaccatgtggaaaggaggctgggtctgtgcttcaggtcaggcctccgcagcccccgccatgcagagggaaggctggctgaagacccagacactggctcgcttcacagaccttgcaggaaagacaagaccccagcagacgcttgcgccattagataattaggagaagggcaagggggtgtgagggaggccagggctccagcggtgccccaggtaggaggaaaccctggcaggagtgaccatggtgacactgagaaactcactcagtccagaagctgcgggccagggatagaaacccagccctggtcttagaagccgcctcgaaagcttcatctggactagtaaacggcaaagccctcctgcagctggggaggggcgggttttggaaaagagagttgaggatgaaaggttgtgtcagccagagggttcctaagctgcctcctgggtctggcttcattctagctggcagcttccacatctttctccatttaatgtcccttgaataacgtgacgaggagataaggtagacactgggaatttacggtgctgtgcaaaaaattgctcaattccattaagatttcaggacccttgccaaggctgcacggcagagcggacagtatttcccgctcagacatctttgcctgattgcagtttacgatgccaaggccactgctgtacccacctaaagcctccagaaaatatggcagagctcccaaaacggccattatcctctctgagaaaagtcactgggcattttctagaagattccctcttcccgattccttccttcacccctccccgcctctggggactgggcgacaggaggacatccagtcggctttctcagagggtccccttgcaggccccattgctcacccttcaccttgcagactgcggcggccaacgtctgctatgtggccagagccctctggggaggggcaccctctgctcccgccgtgtggacgagtgggtactgagtacaggggagacctcggggcatcaggaaagtcttcctcctggccacctatgtgggaccaccagagccaaaggttttgaattcatcaccacccttatgagccaagtgactctggccaactgaatcaacttctttgaaccttatttcctttttggtaaaataaaataaaatacctccctcctgagctgaatgggaagatgaattgagctaagacacacagaggtcttttggactcggcagccccctgggaagtggtggctgttttcaccccaccaggaccctttccagcagcttttactctaggggattggacgggtggaatagcagtggtcggggaagggggtcccctgagaaggtcctatccaacccagtttgcaaatggcaaaatgctaggcttgtgagatgcaactgtgattaggaacaaaactcacttgttccgcagcctcaggcgggaatctggtgtctggctgagtgagatggaagctctgccttctggcacttgtctcctgtgtgccaccctccccgagcctctctgctccacaccatcccctgtgactgccaccaggacctctcctggcctggcctgccgacgctcctctgtccctcagcccttagggactgggctgcccaggcttgactgggagagaggaaggatgaagcttccggagccgcagttccttagagatggaaattattaattagtcttattatccagaacttgtcagtctcttaatccttccgtcggcagaggggtttatgcctccacagcgtgtgctgtcagcttggctaaacaatcgcttttcatatacagccagaacaatgggcaatacagtttggttactatctttatcaagccaaacaattcctgccccctctaagaacatccttcaaagatgtggagaatgcagaagctgcttaatttcccttctagatggcttataatatggggcttttgtttaattatccttttcatgtaatcttcagctgacattgtgtccttaatattctaatctcctttggagcaaaggggagactgtagtttccaaagcaaaagacaaaactttgcctcaaggaaacactttctcttttgcctctgacgtgattcaaagggcaaagagtgaaatccagacgtagtgggacagaatgcagtggaagacgtgggcggtgggtgacccactctgcgtgtggacgtcagcagcttgctgggcctccagctgcacccagctggtgatgttggtctgtgtgggcgtgtcagagactctagctcaacaaggaagtcccatgacatggtgtcatcactgcttttagcaccattaatatttcagtggctctcgggatgcaggttgtatattcccacgggagacacaccacctgcttcggactcctggcaaatggttttgcctagacaggtgaagacaggtgcgcccaggtacccacaggtgcacacagctgtacacaggcgtcactgcgccacaagcctcccctctcagttctcctgccttcatgctggagtaaggatctggggtgggggtggtacctgaaggaggcttcttgccatccccatcaccaccccaaaatgggcaggacgtcctgggggattttatgctctttttccagacatgccagggtccctgtaggtgatggggaatattaacagagctgtcctctcactccacctggctgctgggagaaggcagccatgagcccagggtgtgtcttccccaggcctcattgggctgtcatgtgagatgcgctggtgctggcgagcctcctgcccagcccagctcagcctagctcagctcagcagcatcccaagcctgaagcctctggaacctaggccacctcccagcatgcagagccatcctgcctcatgtctttctttgctgttcctgcaattctgcctctctacctagtcccttatctgcttctgccagagcagccccactggctggcagccaccgaacccacatagccaagtgctcctgtgggttcagcttcccttcagctcagtgttctgcacccctagaagatatatgtgtgtgtgcatgtgtgtgaatgtgtatatgtgtgtatgagtgtatgtcagtgtgtgagtacacaagtgtgtatatatgtgaatgtatgtgcatgtgtgtgaatgcttgtgtatgactctgagtgcatgtgtatgtccatgtgtgagtccgtatgagtgtgtttgtgtgagtgcatgtgtccgtgtgtgtgcctgtgtgtgagagcgtgtgtgtgtgtgtgagtatgtgtgtgtgagcgcctgtgtccgtgtgggtgcatgtgtgtgtgcttgtgtctcagtgcatgtgtgtgcatgtgtgtgagtgcatgtgtgtacgtgtgtgtgagtgcatgtgtccgtgtgtgtgcatgtgtgtatgtgtgtgagtgcatctgtgtatgagtgcgtgtgtgtatgagtgcatttgtaagtgtgtgtgtgtatgagtgcatgtatatgtgcatgtgtgtgtttgtgcatgtgtgtgagtgcctgcatgtgcgtatatgagagtgtgtgtgtgtgtgtgtgtgagagagagagacagagagagatatcctcgcccctagttcccctctcctcctcttctccccctgctccttccagctttccttctcctccaggccccgatgaggctcttggagaggtcactaatgacctctgccttgctataccagaaggtcactgtgccatcgtcatgtttcctggcctcccagcagcacctcttcaggcggccattccctccttatgaacgctccctgctgccgagacttcccggctatctccctcctttctgttcttggcaatccctcttgctcaaccccccgatgctggactatccctgagctgctgaggccttctcttctctgtctacactttctcctgggatcatctcatccagccccacggccccagtgccaactgtatgctagtgactcccacgttcatatctatgtcctgcctcactgctctgcaccagatttttacccgactcaacatcctctcttaatgcagaatctgcatctccaacttctcacggctagagcaggactcatgatgatttcctccctgaactgctcttcctcctgccttagagcatcgatggctcgccgtcatgcagaggctcaagccaaccctccattatgcccctctttccctcactgcctctttcctgctcagaaatatgtcctgaacccacctccttctctccctctcttctgcttcccaaccctaagccacggctccctcctacccagagctggagtccctccttcttagcctgtgctgcactctccacaaagcggtgggggcagccacttaaatcccaaatcagatcacatcacccttatgcttcaggcagttcaagaagtctccacggcacttaatgtccaaaaccttaccgtgacctctgaagacctgtacccttgaccttggtcttcctctccctgctcactctccagccatactggcttctttctctcctcaaagagtcaggtcctttcgtgcctcagggcctttgcacatgctcctccctctgactggaggctgccctggaccttccatggttcacactaagattcaggtctcctttcaactttcaactccacatcaaagccctcttgacactccatctactgttccctcactctctggcaagcccttctgttcctccctccccagcattttatgatgaaatgtttatgatatacagaaaagttgagagaattgtacacacacccgtacagctgccacccagattctgccgttaacatttgaccatatcatttgatcacttacgtgttccacctatccagcaatttttcgaggatttcaaagtaagcaacagccacagcacacctcccccaagtctttcaaggtgcatagcattaaccaaagttcaatatttgcatacagttcttttttttttttgcttttgaagtaaagtttatacactgtgaaacaattgaatgcatacatgttaagtgcactagttgatgagttttgatcgatgcgtgcgtcagtcataccctaagcccacatcaagatttggaacatcgccatcaccccagaaagtacccatgtgtccctttgcagtcaatacccacttcacccccagaggccaccactgttctgatttctccactataggttcattttttctgttctagaacttcgtagaactggaatcctgcagtatatgcactcaggtatatacttggcttctttcactccacatcgtattttgccattcatcatgttgctactgcctactgtgttatttatgccttgtctatccccccaagcccagccccatccttcaagcataagctccacagggtcaggggcatgatctgttttgttcactgctacatttggagtgcctggagccatgcctagcacataagtacttgtttattggataggtgtgaatggtgtccatccatccagcaccgggcttcctgagggcagggccaggtcactacttcctggggtttctcctaggctctcccacagctgcccctaggtccagctgtgccccacgagcacaagcgtcagcactcggtaaagacaccagaatggatgcgctctccacgcagtgtgtccccacctccctccatcctcctgaagagggagaagacatgctctttagagatacagtttaaactggccttagcttgggcagaactaaagcatcagagagcctttggaatgcccagaaagggtgaccctggtgacaccaggcatgagaattctctgtgagcttagcttggaggattgagaaggaaattcggggcagaaacgtttgttgatcctgaattgctaaaaggtttcttagtttggagaccaagttctcagaaaaacactgtcggttccaaagaaatgagctcccatggggtctcattttgccctatctgtgccctcagtttctctgcagcagaggaggtggcattggggtgcaggcgtctcctgtggaaagtccccagctcaggtccctgatgcaggggctctgtcaacacctcctctcagtcagagtgatgtgagctgtaaatgtgcccaggccccaccccatgtcatcccagggtgagcctggagccagtgccagccaactggggccacctctacagcctgagagggctgcagaactccagacaggaggctgagccaacccctctgcattcaatatgtctcagcctctctcaggaagctgggccccagcagcccgaggtcaagggggaatccttcagccccctgcaggctcaggacatatttgagagcaggaaagaggcagtgagggaaagagaggcatgaaggagggttgcatggatggagatttgtcattgcagtcagaccggaggaagagagctcagggaggaaatcaggagtcctgcttcagccacgagaagtttaagatgcaaattctgcattaagaagggatgttgagttcaatctaaaatctggtgcagagcagcccgtggcagcgacaagaagccaccacggccagagactgcagtctgggagcctgggccggagggagaccctcagctcggggagctcttctccccaccctgaggaagggcagagacaaggaatgcagccccctcagatcgcagccaaagccactgggaagaagcaagttcccttcctttcctggggagaactgtaaaagcctctgggcagggagatcagccaggaaccagagcaggggctggaggattcccccttgacctcaggctgccggggcccagcgtcctgagggaggctgagagctggcatcttgctgaccccaggacagggcagtagcccagggcggggagcagggggttgcagaacagagtctcgtcccaccctggggagggaaacctcaccttcctgcagcctcctgctgactggaggactcctcaggtgcacagggagctggagaacgcagcccacaggccgtggcaggaccccaggggtggctcctggagtcggccagcccctgacctggctcccgtgagcagcctgagctccacacacctcctgggcctgttccctcctggggcagaggacctttctatcatttttattcccactttgacccttggccagggagactgggggagccccaccttggccctgcacttactaccctcgtaggtaggaagtgctcacttcattatgggctaaaatattgtagacccagcattcactctgagcctcaccaagcaagagacataaaacacagccacttgcagaccgtggcctggggccgcagggccatcaccagctcatcccagggcagacccggtgtgggtaggtgggtgagtacctggcacagaggggggcccacctcaggtccgccttccctcggggggctcaccagcctgactcaggctggcccccagtcccaggagactgagcctctccccaggaggcctggaaagggttgtcctgatgcagccgcaaggtcaggccctgggtgttcacactgacctgggttctaatcccccttcttcaaccacgtggagctgtgtcacctcgggctaattaacccaaaaccaggggctcagtttcctcatccgcagaatttttaaagcactttgcacagggtcggacatagaccagcattcagataacaatcgtggccgggcacggtggctcacgcctgtaatcccagcactttgggaggccaaggcaggtggatcacaaggtcaggagatcaagaccatcctggctaacacggtgaaatcccgtctctactaaaaatataaaaaattagccaggcatggtggtggacacctgtagtcccaactactcaggaggctgaggcaggagaatggcatgaacctgggaggcggagcttgcagtgagctgagatcgcaccactgcactccaacctgggcgacagagcgagactatgtctcagaaaaaaaaaaaatcgtggctgttgtcatgaccgttgtgttgttacaaaaccacgtgataacccctgatagagccgcccgtgctgagctgggcccacaaagaccccgtcctaggctctctcccctctctggccatcagttgagttgtacactgtgacccaccaggccactgcttccagcattcacagccaaagaccttggccaagcaccggcccacgctcaccatgggccatgcctgccctggtgactctgggaatgtccccagagctgcccggacctggatccagccccttctgttgcctccaaaaggcttggattcagaattccacaggaggatcttctctggctgcccatccccagtcccccaccctttcctggccaatggcctccctgtgtcccctgatgtctgagcctgaaagccacggcccttgtgcgcgcattacatagctgcagttgccagttgtcacccatgtctccatcgtgcctcgtctctcagggtgtgtcagagcagtcactcccactgccttaggggagacaagaaggaagccccatcccaccaccctcctgacagccactcgtgctccctgccacatgctgctctcagctccctgggatcagctgcctttgggggcagctggggaaggtgaaagggtttggtcatggagcctcttctgccaaagccataattctgaacttggagtagtatgggcagtgccgggctgagagccacagcagagagagtgcagcatgcttggggtttggggctgacgttccttgccagagtcactggcaggatcttctgctgctgggaccctgccaggctctgggcccctgggtgagtccaggagagcccctcccactgagtcacaatgactctgccccttccccaccaggcgaggcaggacttcagaaaccatccggcccagtgccttgctttgcatgggaaagctgtcacctagggcaggccaatgacttatccagggacacccagtgacttagcagaagagctgggcttgaaccccaacttcctgactgcatggctgggctctttctgagacttccctctcaatagagatggtgggcaacccacagcacttttaacactccagaccagcttctcaggccaccccggcatgcacctcagccgccagctgttggtgtctgatcagagagtgcacgctcacaacattagcccaagttgagcttaattagataaaagatcattctactgccagaaacagaccatgctttcccagctccagaagtgacgtttgcatataactgctgtttgagatgatgattgcctctttcaggaagagacatgcaactgctcctcaattcggtgtgacagtttgcagaatggccagattttcgtaggtgttcagattttgtcctgcaaagcagtggtatgctggaaatgcctaacagttggctctccaggagaaagaaaaaatttctgattggtaacgtttgccaatttctatggtgtaaataccaccactgtagctgtcttcaagctaccaacatgatatcatgatatccattgcaaaattctcaaaaatgtaccaggctgctttcatgagccagtacaggccagctccaacaacccagtcttgtattgcctctgcacatccaacctcctaggacctgtttgggcctctctacttctggccaagactgataatgctcatgccttaaggaatgaaaggcagggtctccctcttgagcctcccctggggcaagtcatctgtcgccatggagacttccaaggctgacgggggcctgctttaggcctctgagacctgacttccagggtggtctctgtcccctgttgctacagctcagctcctccagacctaaggcttagctaatctcaggctccctgtctgtcctgtgtccgggatgacccaagtgcatctttcatcagggtcatggcagtgccgctgttgggttccactttgatggtcaaaatgacactctgggtgaaccttgtctttcctccctggagctccatctccccaaggcaggatctgagggaaggtcctgcctctgaaagccctgtgagcaaccccctggatacagaagcggcggcttccccagtctgccctcccagcacacccaagctctacccctgacttctctagggaagtggcttaacctcagcctctctgggcctcagcttcctcacctgtacaacagaaatgagaatagcacctgactcaagggttgttgggaggggaaaaatccctaacaaatgtgaagcacttagcgtgatacacggcacatagtagatgctcaatgagcacagatgctcctgataggaggggctcctttctgacccgcagctggtctgtctcccatctatgcgtctcgtgttcctccctcctgtagcaagtgcatgaaggcccctccacggttatcggctactcttcaagctcctcagttaaccatggagcaaagagttgtggccaccaagagggaactaagaaggcagcactttggggtaagaaacctttactcagggtcaagccccaccccagctctggggccatgcccagctacaccaaagctttaaggcaaagggaaaaatcagtcagactgaccctgtctttatttaaaatgttgatattttgttcatcaaggattcttggattaattttgatattttaaagtattgcactgcagtggcatttgtcttgatggctgagtgtttgggcacctcttgagatttccaccctagtgccagctctgtctggacgtccatggaggacctgcccgtgctctctagcatcccattcagatgctggacctgctgcagcctgcaggtgaggctgaggctgaggatgcggtgtcttctcagctctctggtcccgcacagggcctggcttacagcaggtgctcagttcttgactgaagagcagagggacaagactgcaagaaactgagtgtccccaaaggctgcactttccagagcattcttatcgccccccagaggaagggatcccaggcccttgtctgtccttcaccctgatctcctccatccccttcccctctgtccaggttctttgctgtttctgctgagcccctcggttgctcacgtcacagctctgcctcaggaccccaggccctgctgggagcatcttagccattccccggagtggtgtcgtttgccgccacctcccacacagcctctcaggaaaagcctgcctgcctttggagccaggctctcccttccctttctctgagactcctcccatctactctctgcagtctctctggaatcttgctagagtctctctgggtctctctagaacctctctagaatctctctaaaatctctctggagcctttctggaatctccctctagaatctctctgcaatctctctagaatctctctaggtgcttgatcccaggagctctcaggtgaccagagcctttccagcagcagcgcctggacagggggctggagcagctgtgaggctgggccaagtgtgggtgctcctggtaggatgtgggatggaggcctggagtggccagggatggctccagaccctggtgtctggcaccccactggctccaaggagtcctcattacccccagcttcgctcctggagccccaaggagcaaagggaccctgagaggggctgggatcagggacaacaactcagcctatttctgcccatcccatcacacacacacaatacacacacacgcacatacacacacatgtacacacaatacacatgcacacacatacatctgtacacatgcatgcacatacatctgtacacatgtgtacacatacatgcatgatacatgtaacacatacacatacaatatacatatacatataagcacatatgtgcacacatataaacacttgcatacacacacatatacacataaatatatacatatgcatacatacccatagtacacataaatgtacacatatatacacatacatgtacatatgcacatgcttgtaatttgcaatataaatacacacatgtaatacaaatatgtaccttaacatcacacacatatgcacatgatatacacatacatatatacacacaatacacattgcagacgtgtacatatgtacatttatacacacatgcatacccatgcacacgtcacacacaatacacattcacacatacacatatacatacaagcacacacacacacacgctgccacccccagcgccacatgggctctgacatttctgcaaagagggacacagagcctctgggtaaatctgagctctccccacctcagtcaccttcggcaacagctaccacactccgtggcctcacatgcaagaaaaccaggatggctattatttggggcctcctttgccacaggtgggccctggcctgggaaggggggccatgatgcctgccgccccctagacacactcccatttgtttctgtcccccgtttccagatgctgaaaaagattcaacaacctagataaggccctctataggaccttccagaagagctcaaatcaaatcacagccaagagatctttcgagggtctttgcaggggaaggaaacagctgtcagggcaaggcatggctgatttgaggcagctctttagagagaggctgtgtttggagaagatgtgtgccattggcatgcagggcactggggctcccggcgagcctctgcatctcgttctccaggtgtcggaggaactcactccttaggcatccatgcgtgttaggggtcaggtagtatgccaggtgctagggttgcaggggtgatccagcccttaggaagctcacagtctaggcaggtggagactcacaagggacctggtggcaagttatttggaatgcaaagcattgcgcagaatttatccatttggtaaatacacactcgttaaagtggcacgcatccagcctccccaccctcctgaggctgtagtggtggaggcgatcctcattcctttcctgtccagccctccacaacccctggcccggagcagttcccatgccaggggccttcggccagcatcccatgacctagacgagggtgggacatgtccgtccccactcctccatgtctggccccgagcagacggggtgactggctactggcatcatcagcttgcttctggctgctcagcagatggggtgactttcagcggttacgggagggcacttggatccccgaggaaatgttccacgccgggatattggatctcacaggcctgctctgtggtgacgtcctgaaggtgaagccctccgcggcagcctctgcttcagggtgactgctttctgctacaggagtgactcgggcatcctagttaatgttgcagagtacgataggagcaaatagctcttctccccacatccaggaccagcctgtcctctgggtgaatctggtgctgagcttcccttgctatgcctcctcgcatgggattgcaccgtgcacaatgtggagatgtgctttccataagagatgcagttaggaatgtgcggtcactgccgcgggcatcgattgcccagaacacaacagtgagccctccataaagtcggaactgtcattatcaaaagcagtgattggccgggcgcgatggctcatgcctgtaatcccagcactttgggaggccgaggcaggcggttcacctgaggtcaggagttcgagaccagcctggccaacatggcaaaaccccgtctctactaaaaatacaaaaattagccgggcgtagtggcacgtgcctgcaatcctagctactcgggaggctgaggccggagaatcgcttgaacccaggaggcggaggttgcggtgagccgagattgtgccactgcactccagcctgggtgacgagagcgaaactccatctcaaaaaaaaaaagtgacaaagcagcccctctgccagggagtggccagtgtgacctgaggccttggcacccagccaccgtgcgttaccttttgaggtctgtgctagaaggtgctgctgccgcaggagtcctctgactgggttgtcaggccgagatcctctccttgatgcagaaagtgggaggtgctttcctctctcaggcaggatgctctttcctgggaagactttgggcctccaggctgaggacataaccccaaagcagtttaggacttctggcttcggtagcaaagatatttccttctgtgcttgtctcttccccactccagctccgatccattgactcagcttttgttctgtgaatgtcattttctttgaatttgtgtgagttttgttgtttgcaaataacctaatgaaactccttctgttcccttccaaaacaaaaaggaggctctagcatggtctacctccacatctgaactcctccaagcttttctgatggtgtttgggctgtacagcaccctgagagaccacccccggcctccatgtaccccctgccatcacctgagccgcactcaccaaggcagagccgggaggactccacccaccctctttcctgttcataaggtttctcaaggagcctcttgatgcttgtttacttaaggacgggcacgggtgaactctcacccccacctggtgatttcacaaacacaaaccatagaggggaaggctatttctctcactttctggaaaaggccaaaactaaccctgaatccccccgcccatgtttagagtagacacagagggaagatggttccggaatgttctgcgtgtactgccgattgtccaattgcttaaaacagggcttggcgtgcattgttttggtcattagttaaccaatctgggcggggaaaaaggcagagcgttaaataattacaagcacttcggtgatttttttttctactgactaaggttaaaatgaatagtgttgatccgttgcccaggcagcaggcttgttaaaggaaatggtatttaaaatgatttttgagccaaagcaatttggctgcttcaaggcatcctttatcttttgctttcaagaggataataatgtttaaaaacgaagtcactcataccatttcctgtcgcgaagccagctcagtgatgggcagagcttcctctgggtttgtttacttgctccatgatggaaaatgcaaacttaatgggctcccttctgccgaggctttggtgttccgacgaaacaaagacccatgctgctgccgaatctgtgtccacagctctggccagctcaccctggaagtcttgattgccacattgtggatgtcagaatgtcacctgcttggttagagcttctaaacaggaggctcaaggccactccctggctctagggtggagtcgaggaaacctgtctaggatgggacacgctcccactaggctcagggtgccctcccgtccaagagcatgatggtcaccccagctgggaagttgctaagcaagtcctccttggtagagcgtctttcccatcatcctctgcgaggaaggccagggcgatacactcagcttatagagtgaagtcggcagaaagcacaacttctcagtgaagaggataaaaggaaggcactacgggggcccaggacctgctctgccctgcttagggctgggcagggcttacgggcgtgacatgcatagaggctcagaagagctggctccggccttttgcagtctgggatcctcagctggggtgtgcacatgagcaagggtgctctatgcccctgccaccagcccccgggctgctcaggaggcagcagtgaaggatggaaagggtttccatggccatgaaagagagagagctcatccgctcctgcatagcactgtgagggcttgaacacacacacgcacgcacatacaaacgcaaacctacatacacacacgcgtgcacacacacacacaaatgtacatacacgcgcacacaaacacatacaatcacacaaacacaaacatacgaacacacacacacaaacacaaacctacaaacacacacgcaggcacacacacaaacacaaacctacatacacacacgcgcgcacacacacacaaacctacatacacaagtgcacacacaaacacaaacctacgtatacacatgcgcgcacagacacacaaacatacaaacacgcacacgcacaaacacaaacctacaaacacacgcgcacatgcacaaacacaaacctacatacacacgtgcacacacacaaacctgcaaacacacacgcacgcacacataaacacagacttacatacacatgcgctcaaacacaaacatacaaacgcgcacacaaacacaaacctacaaacacacatgcacgcacacacaaacacaaacctacatacacacgcgcgcacacacacagacatacaaacgtgagcacacaacacaaacctacatacacacacgcgcacacacagacatacaaacgtgagcacacaacacaaacctacatacacgcgcacacaaatacaaacacgcacacacacaaacacaaacctacatacacacgcacacacaaacgtacaatcacgcacacacaaacctacgtacacacgcacacaaacatacacgcgcacaaacacaaacatacaaatgcgcacacaaacaaacctacgtacacacacatgcacacacaaacacaaacatacaaacacacgtgcgcacacacaaacaaacacgtgcacacacacaaaaacacaaacctacatacacacatgcacacacaaacatacaaacacacgtgcaaacacacaaaaacatataaacaggcgtgcacacacataaccatacaaacacacacacgcgcaggggcacacataagaaagtgccaagcacagtaccaggcacgcaacgacggatccacacactttagatccttctctgacctttcttttattcctcaaaagcacagcatccatcccccagggaactgggggggggggggggtcagcggaagagtttgtccttgaggggacattgcccactctgtaaactcagggcaccttctcgaggattccctcaaagggttccctggccacgcatcctacagaagtcagcgaaatgcagttctatgaaatgaggctgttgggagattttgtagtcttgtgggtgtgtgctctgtgttcagcttgggggtcacgtggcacctgtcgggggcgggatgctgctgagacctctgcagtgctggatggccccatggggccatgtggcttcactccccgtctctgcctcccaggctcagcaggccacccgccggcctctcctgcccatctcgggagggctagcggggtaatttaggatggttgccactcccccgtgcattttaaacacgtttccaaactgggttcattctgcctttgatagggaggtggccttctgggtttttctttcaagagatgcagatttcatggactgcgattcttctccagatctgctgttcaaaaaaaaaaaaaaatgtaactcagaatttctatttgttcagagggggaaaaatctgcttgctattcaggccctagattttcctgagagattagtgtacttgcctgccaagatgttagctaaaggaaaacacatttgctatagatcagaaatatttatccttttctgggcaggagatccggagaagaacctcatcagaatgtacagcacctggaaatatgaataaattcaatctcctgagctgcaggcatctgccaggagggctgaggcatggaggggctctggccgtctccggggagttgaaaccatgagcgggaagccaagagcagctgctggggtctgggggatgcagaggtcaaaggaccaagaggggccgggtgcggtggcttacacctgtaatcccagcaccatgggaggccaaggcaggcggatcacttgaggtcaggagctcaagaccagcctggtcaatgtggtaaaaccccatctctactaaaaatacaaaaattagccaggtgtggtggcgcacacctgtaatcccagctactcaggaggctgaggcatgagaatcacttgaactccagaagtagagattgcagtgagcagagatggcgccactgcactccagcgtgggtgacagattgagaccctgtctcaaaaaaaataataaaaaataaaaggccaagaggtctggtccagatagaagccaggggaggaacaagtagggaacaggcagccttgaccagcaagccggcagtgtcctgaggaagaggacgctgacccttccctcctgttctctacgccctcagactggggctgggatcccgagactgtgggtgagtggggccaagccctctcctgcttcttgtcctgagaaaaggatcctaggtctctgttgggctccatgcagttgcccctcagtggctgcccccgtcgtttaaatcctctcaaactcaggctcttgtttggtagctgcagagaaataagagatgcaaacttataaataattaagaaacctaataattatctccaaccagacagcaagcctgcatcctcgtgagagacggaagatctggagagtttcggggggtaaactacaaaccattatttagcaagttttcccactgggctttgtcatgccttgatcttcaacgatcatgattagagttcatttgattcccgcagctgtgttctgggggctttgtgaggaggatcaagtttgggatgtgggtgagcgtagggagaggaggcgatgaattccttgtgacatcagagcccgatctaagatcatttgtctttggggccccatgttccatccccagaagtgatttgccttgaccaccagctggcatctacccggcttgggcatggcagggccccacatctcctggcacagccaggcagagcctgagtcgggttgtcaggactcttgatgcctggcctctcattcctggactggcaaagcctgttagcatcccagggctggaagaaacaccctacacactttgccttcttccaggcaaagaaggatccaccctggagtctccataggccctggccaggtgcggaatgaaaattcctacccccagatttaagtgtttatcagggagatttctgctcataaggactttgttaaccaagagactgtgtcatttaagccagagttccctagatcttgttggaacagagttcctctcagggctcctccaggctaaacccgcccaggaaagcctgcgagtcctgggaggtgacgggcactgcctgttcccagggtcctgtcttggtcttgcccagagcacctcctggccatcgtttcatttcaggtcgatgaaagctccttgcttggccctctgaactggggaaccatttcctctctctatcctggcccagggccagctctctgggctgccccagggagccggaggggagcggcctgtgcagacccagccgccaggacccagagggccggctcagagctgtgtggccatcctctccccgggctgcctttgcctgaggtcagcctcacacaggcagtctgaataggctgggggctcctttgtacttgaaaaatagtccatgtgcgggaggaggtgctggagagggaaagaagtgtgtggctgttgtgggctctctgtaagatggctctatgtggggcacgtgagctcgtgactttccgggtatgggcgtggcctgcagacagggatttgaacaagggtaagcatgtgggtgaggacatgaagccccaaagagcatgagactgtggggaggggcaagtcccgtgtgcactgtctgtgtcccccaacctgtcacagcctgcgtgtgcacatgcgtgcccaggtcctcctgcagcagacagggcggacatgggctctgctggctgcagtgtctgccctgtacccaggtggctgcaacgcctcagatgcagcaatgttcccctgggattaatccccagcatctccattgggctttgcttatctggtgttggctataattaaaaagtggttacttcataaaataaaggcagggagagaggacagcatcccctacccctgtcctgtggtccttggagaggaaggtgcttggaaggtcgtgttgttgatccctctgcctcccagtaggcaggggtccagcgtctcctaagagcaccctggccccaggcacggccagggaaggaggcctcccaggccccaacaccacctcccagggctgctagtcactgcacggtcagcaagcgcaacctcaggccagacacagcccaagagcctccatcctgagcagccaccgagacactctcccttcctaggccatgcaaaagtggcacagcccgggaagggaggcataaaagccaagccacggtccaccccaggggacctagggctcgagaaaaatagctgaggccaccaaggccacggtcttttcagtttcactgaacattaaactcatcacccaagataagcagaaagaaaagtggctgccgcttctcctgaggccactcgctgaatggcttctgtcagacgggagaagctgcccgtctcacacctcccctggagatggagcccctgtgaggccccaatccccacccatcagacacgatggctggtcacagacactgcgctgtccctgaggaggcctggagctagaagccagccacctcccccatgtcaacagctcacgcagggggccaagcccaggccccatcccatcctccaaacctcttggtgtctgggcaggcagaaagcctataccctggctgaaatccaccctggctctgctcctcactctgggcaaccttggacaaggcacggcccatctagagaacaggaatgacatccccagccctgcatgctggcaatctcttttggtgcacggtgccacaaccacaaatcagcctttgttgcttcacccacacgttcctggtgagattctagaatggaaatctctcacgtcacattgcgtggtgccttccatttgtgcttcttgtactctcatgaatgctaccactttcatttttcactgcaccttctcttaagggacttccctgactggagagacagccacacaaactcagggcccagaagagaatatgacagagctcagccatgacggcaggagagagcagacggactggagtgcgccttagtaaggggggcagcgctagacacctgggaggccattttcattctggagagttgtgctaatgtggattctactgtgcaaagtcaaaacactgaggcagagacagatgcaagcagcccacccacaacccaggcaggagagatgacggggctgctcggaagacaggccttgtctgctgggcctcactcgaggccctcagtgctccctgtgggagtctctccttggcatgttgggatgagtccagtccttcctggagagtccttatggaaagagggggtgagagtggggaaggggtgcggggagcatcctgaggagagggggagggaggaaacgtcccctgctcactagtatgagcaacaggatactggagatttgtgagtgtgtgtgcatgtgtgtgtatgagagtgagtgtgtgtgtgtgtgacagtgtggatgtgtgtgtatgagagtgagtgtggatgtgtgggagagtgtatgagagagcgtgtgtgagtgtgagcgtgtatgagcgtgacagtgagtgtggatgtgtgtgtaagagtgagtgtggatgtgtatgagtgtgtgtagagtgagtgtggatgtgtgtgtatgagtggatgtgtgtgagtgaatgtgtatgagtgtgtatgagtgtgtggatgtgcgtgtgtatgagtgtgtgtgaatgtgcatgacagtgtgtgtggatgtgtgagcatgtatgagagtgagtgtgggtgtgggtgtatatgcataggaatgttgtgttgcatgtgtgcatgttaatctacctgtatatgcatgtatatgcatgtgcatgtgtgtgtacgtgtgagtgtgaacatctgtgtgcagtgtgtgtatgagtgtgcatgcatgtgaatgtatgtggatgtatgactacattgagtgcatgcatatgtatgtgtgtatatgtgtgtgcacatgggtgtacatgagtgcatgtgcagagaggatgagtgtgcagaggattgtgtgagcctggtgtgcatgtgtatgtatgtgtgtgcatgtgtgtacatgtgtgtagagaggatggtgtgagcctggtgtgcgtgtgtatgtatgagtgtgtgtgtgcatgagtgagtgtgtagagaggatggtgtgagcctggtgtgagtgcgtatgtatatgagtgtgtgtgtgcatgtgtgtccatgagtgtgtagagaggattgtgtgagtctggtgtgcgtgtgtatgtatatgagtgtgtgtgcatgtgtgtccatgagtgagtgtgtagagaggattgtgtgagcctggtgtgcgtgtgtatgtatatgagtgtgtgtgtgcatgtgtgtccatgagtgagtgtgtagagaggatggtgtgatcctggtgtgcgtgtgtacgtatatgagtgtgtgtgtgcatgtgtgtccatgagtgtgcagagaggatggtgtgatcctggtgtgcatgtgtatgtatatgagtgtgtgtgtgcatgtgtgtacatgagtgagtgtgtagagaggatggtgtgagcctggtgtgcgtgtgtatgtatatgagtgtgtgtgcatgtgtgtacatgtgtgtagagaggattgtgtgagcctggtgtgcgtgtgtatgtatatgagtgtgtgtgtgcatgtgtgtacatgagtgtgtagagaggattgtgtgagcctggtgtgcatatgtatatgagtgtgtgtgtgtgcatgtgtgtacatgagtgtgtagagaggattgtgtgagcctggtgtgcatgtgtatgtatatgagtgtgtgtgtgtgcatgtgtgtccatgagtgtgtagagaggatggtgtgagcctggcgtgagtgcgtatgtatatgagtgtgtgtgtgcatgagtgagtgtgagcctggtgtgagtgcatgtgtatgtgagtgtgtgcatgagtgtgtgtgaacctggtgtgcgtgcatatgtatatgagtgtgtgtgtgcatgtgtgtccatgagtgagtgtgtagagaggattgtgtgagcctgttgtgagtgtgtgtgtccatgagtgtgtgtggagaggattgtgtgagcctggtgtgcatgcatatgtatgtgtgtgtgcatgtgtgtacatgagtgtatatagaggattgtgtgagcctggtgtgcatgcttatgtatatgagtgtgtgtgtgcatgagtgagtgtgcagagaggatgagtgtgtggagaggactgtgtgagcctggtgtgcgtgcataggtatatgagtgtgtgtgtgcatatgtgcacatttactgtgtagagaggattgtgtgagcctggtgtgcgtgtgtacgtatatgagtgtgtgtgtgcatgtgtgtccatgagtgtgtagaagattgtgtgagcctggtgtgcgtgtgtatgtatatgggtgtgtgtgtgcatgtgtgtacatgagtgagtgtgtagagaggatggtgtgagcctggtgtgcgtgtgtatgtatatgagtgtatgtgtgttcatgagtgagtgtgtagagaggattgtgtgagcctggtgtgcgtgcatatgtatatgagtgtgtgtgtgcatgtgtgtccgtgagcgagtgtgtagagaggatggtgtgagcctggtgtgcgtgtgtatgtatatgagtgtgtgtgtgcatgtgtgtccgtgagtgagtgtgtagagaggatggtgtgagcctgttgtgtgtgtgtgtgcatgagtgagtgtgtgtgagcctctggtgtttggcatctagttctctctgcaggtctggagaccttcttgagcaaagctcaggctactgcgcccactctgtgcacgctggtcttgaggacgcggccctgctcccctgggtgggcccgtgggtcctgcccgcttctgtagcagcagcagcctcctctcaagggccctctgttgctcaggccgtgttcctgcctgtggtcgcccagcttcaattaccacggctcaaagtcagaggcgtgggctggctccgtccagatggagggagggccggtgttcccttgcctcagagtctgcgggtggcttcagagagaagggagcagaacctctttcctttgctgccttaaagcagcaagtctcggtgacatcaggcagttccagggcagagcttgtggccgctgtcaagcccaggagacatcagggcttcatgctcaactggtcacacccaactggcaagaggggtcccaggcagaaactctgggaaccgtagcccaggccgagagccatccccaggggactgaggtagggtctgcaggaccaaagctgcctcacacagacctttcaggaaagcaagcacagatcctcggaagcggttaccacccacctgtgccacgcgccacccctcgtccttgacaccactgctggcgaggcagccgagagagtatgctgagtaagcaggttctagggcattctccccagaccctccagggaggctctccctggaaggctgcctcagtccctgcccttccagtcagcagagcaaggcatcaagctgagaaaagtccaacagaagggcgggaggcagattgctgagatgaatgggaagtgcaggccacaggtcctggcaggcaagaggaagggaggcctgagaacggcctttgttcccgggatctccggaccagatgtgccctcacagctgctgcttcaggtttctgtgctccagagcccgctggagggagaatgctcgccaaagacatctcattagggatggccttgggcttggcggggtgtgggttttggtgggaagaggagagagggatggtttgtgctgtcaaccctggaggccctggaggctggggtgcaggcttaccaaatttagcaaatgaaaattgtagatgcctggttacttttgaaattcggataaacaacagttttttttttattttagtctaggtatgtcccacacagtatttgggatatacttccacaattgatttattgtttatctgaaattgacatgtcatcggcaccctccactgtgggctcttctgctgtgggttttcctctttgtgccacctcctgctttcacaccgatttcatccactcctactaaagcaatagagtctgggggttctaggatgcatagacacccactgggatccaaattcctcagctgccggcagctcagtgggggctcacatgtgcagtgggttctccctgagcccctgaggcctccagctgagggctttgggacccctggtgtttgcagcaagcctgagtctctgagactgcagaggggctggggaggaagctaggggatcctctgccttggctgcaatctcaagccccccggaggaggaagcagcaaggcgcctgctggttttctgctcagggttagcacatgtggtgcagcggtgagcagattgcaggttgctaggatgggtccaaggtcaacgacagccccggaaggcagctggttagggcttacagggtggtctccaccccactctcccctctggaggtccagttctccacacccctccagaccctggccaacggcaagcctaaacccagtcttcatgcagagaagcggctttggaggaagtgtgtcctttgctctaggaaggaacatttgcagtcagggctgtgtgtggaatttttattcctctaatacagcctaggcaggatgtagtacacgagttctccagaggaaatgcattcaataaaaatttgatgggctccggcagctcagcagaatctccttacgaattccaagtgtttgtttggtccctggcttgggcaggagctcagccacgttctgcaagtggcctctttagtgagggagcccttggaggaaggactccctccacatctggaaagtcgccttcagcccccggctttcccaagaaggagcaggattgcttcaccaggtcgaggagtgggggggcctctggcctttgaccccaaggagaagcgaagccccagggctctggaatcgggccctcataaatgagatgaggacactgagcactggagggggattcaatgccgacggagatgtgaagtcagcgcaagaatagaaatggcctcgctgggcttagtgggggatgtgtagtacgtttccagagatcacccctgtacttcattcgctcagcacacaagagctcccctacaagggctgaagcgaggcaggcagccctgccctgtggcccctgccccgcaccccctgccccgcaccccatggctcaccctgggcacagatgtgcttggagggaaacacacactagaagcttcctgtgggcaacggccatgtccatttggctctctactctcccctcttagccggggcctggcacacagagtggggtcagtcagcgtcaggacaatggggtgggcgtgtcatgggctctgtggaatgggggagcctgctggccacccctctggcttgtgaggtaaatccaggcacaagccctagaagccttggcttttaccaacagggccagacgatcagaaaagtgccccgggctctgctgcccttggagagtcagggctgggggccgagagcaagggtccagggcatggagggccctcccgcctgggtttttgcttacagatggagaagtgggattattaagccagagggtgtgcttcagaaggtgtgcttacgaaggggctttcgggtcacaatgcagagaacttcctcgcagtgagcagccttgggtcctggggtaatacagccagcccaggtagaggaccatggagttggcctgggtctccctctggcctggccctggctggccaccttcgccgaaggggagggaatggtcgctgccctcccccaccatttccagggtcaggtgccagacctgggcctcatctgcctttgcagggcatttgggaagcacttagccaggcctgacagtggccaggctgcttcataagacgcctggtggtgagtaaaaccccaagtctagggcacctgaaggctctctcagggtagtttcccatttccgtcaggttcagctcagctcgattcttagatgtgtggccctcgggaggtggggggagcctcctgtttgtgtgtagcctgcccacccacagtgatgcccactcggatgctgtgcccaccacacctgctgacggagttccctgcaagtgtgacgcatctggccggctctgagccacctccgctgccccgcacttgtgtcccaggggacagaagcatggaggctggagaggagccagaggaagggctgggggaggggagtcaggagctgggggcctcagaacgggagaaccaggtgaacagtctgaccccaaagggcagccagaggggcctcccgggcaggagagggtggcagcctcagccgagactggccatgcctgccatcccaagggcctctgtgggcagtggtgggttcttaggataccatggccgggggactctgtgtcctcactgcggggaacgggtggggactgactttggacccaggccaagggtctgcaatcagcctcccgggtcctgccaggctctgctgcccaggaggtctcaggtgacaaccaggccatgcagccacgctcaccttcctctactgtctctcacagtctcatggccccgtggaacccccaggtgtggctcctggtacccaggcttggagaatgtgtccagctgtcctgcccccttgctgcctgggcttggcctgggcacagggctctgcttccctttggtatctgaggaccctgctagacagacccctgtccgtcagggaggccttctcagcctcgggcagggagtgtgggcctcacaggccacctgcttccagggccctcagagctgcctggtctttctgccaactgactccaagatcaagcttttggggcttccagcttggtgtggggttgaccccacctgcctgctccacctgcaagagggaagaggttggggatgcaccaaagatgcccacagccatgtactagaggggagaggtgaggtccagaacattctagagcagtggtcctccatgtttttcctaccctagcagtaaaaatgtctaggcccactgggaatagcggctctggaccgttagggcagcagaccagcctttcctagagggcatggacatctcacaagtgcctcttacagtgacacagctggcctttctcagaatgccatgcccaccacctcactgggcagaatcactgggcaggaggagttcagtgtagcgcacagcctccttcacgggcggacatggcacaagcacacagatgcctcatgggcacagctgggcaggaggagttcagtgtagcgcacagcctccttcacgggcggacatggcacaagcacacagatgcctcatgggcacagctgggcaggaggagttcagtgtagcgcacagcctccttcacgggcggaagtggcacaagcacacagatgcctcatgggcacatgcataatattcacctggaggccaagtgcacacatgtttgttgcacagctagctggccagtggcaggaaaggaggccctgagtggcctccaggacctttgcccatgggccacagcaggactggctgcagctgctcccaccacatccccggcagccaagtcgaggctccctctggcttctgagggctgctgcaagcactgcggtcactgagtttagggcctacctgaggggtgtgctgggacgtgggcgtctagtgcaaaagaaaaacagtcctgggcggcccaggacagacagagcgtgccaccctcccccagctccagcccaccctctccacggccccagagctgcctgctggagacagcgggaaaaggagcttgtgcaggcccagatggggccgggaggggacctggacttcagatgaggccacccacccagggctgcagtttcagggacctggcggtgccccaggggcagggtgttcctcccatggtcaggtggggggaccaggccaggagacagcccacccagaggccacatgaggcagcacatttgggtctggcagaagtgttgacagataaccttggaatgtcctcgggtggcacagggggacaccacagtccgctgagcagggtccactgtacctggtcttctcagtctgggacggtcttgggtgtccggccccagtgctcatggtcacctggggtacaggagcgagggctgctgaggtcccagcgggcacagctgacctgtgggcgcttcacctgcacgacctcacctggccctcccagtccgagaggcctcctcacccaggttctcaggcgggcaggtttggtgggggcaggctgcagcagtgtggaaagcagaagccagtggaaggggaggcagagctcttcacatcagtgatgacagaacggcccagaccagagggaagcggagggtggagaatcgcagaggaggaagccggccagaggctgcctggggaacagaccacccccaccctctataacctcgctgtggcactgggcttcagcatgaggacttgggagcaggaactgggaatgaaaggaacacaccagaaccaggaaaatcttccaggtgtggcaaaggagagcaggggtgggactgagtcccaggtgccccagggccctgagcccggttcccagaggagggaagtgagcccagcccagccctgccctggagccccggccccactcccagggggaaggttggaggtttgggcttcctcaacccaccaccggacacctgtgcactcagtcacacacagtctcatgctcacactcaaaattcacactcaaaattcacactctcatactaacactcaaaattcacactaacacttcatactgaaactcaaaattcacactaacatctcatactcacccttataatgtacacatgctcacaagctcactcaaaattcacacgcacactcacacgctcacactcaaaagtcacactctcatactaatgttcaacattcacactaacacctcatgctgaaacgtaaaattcactctaacatctcatgctcacactcgaaatgcacactcacacgctcacactcaaaattcacactagcatcatgctcacacaaaatctcacatgctcacactcaatgcaaactcacatgcttacactcaaaattcacattaacatgctcacacagaactacacccatgcttacactcaaaaatcacacagaattcacactcgctttcatactaacactcaaaattcacactatctcttgctcacactcaaaattcactcacacttatgtactcacaatcaaaattcacacacactcaaaatttgcacttgctctgatactgacactcaaaattcacactaacatctcatgctcacactcaaaactcatgctcacattatcacactcaaaattcacacttgctctcatattgacactcaaaattcacacccacacttacatgctcaccctctaaccctctcacattcacacactcacactcactcccacactcacacaacacacacgctcacactcacatacataacaccctcacagtggcacactcaccgatacacacttgctcacacaaaactcacgctcacatatttgcacactcgcacacaccctgccttttgcacacggctgcacacacccctaccagctccagctctccggctctccctgcctcctggctgctctgatgtgaggagccgtctctgcacaggtgcctgcaggctgcaggctggggagggggcacacgcctggcacgggggtctatcggagctgtttactcccccaagcagctcttggcctcacttcctttctctctcatctttggcacctgaaaaaccccaacattcccaggagggcaaacaggccctttattacctcgtgggctcagaacacagcatcttagtaattgaaagtggcttgactcaaattgcattttccgaggagccctgcaagatggaagtgcaggaaggagggaggcagggtggagggaagctgcaagcgccagcccccgagcaggcaacaggtaggggcccaggccccaggggcctctccagtctgctggcaactttggggcccacgggccacgtccagataagagcagacctggaccccacctgcaaagggagtccaagctctgagcgggcagcctctgccacctgcgccagcctcctaacaagcctccaccccacctccgggtcttcccagctgggcactcggtggcctccctgcctggcacaccgcagctctccagcgtgtgtctgttgaccgaatgctggtccaagccccagggctttgccacgtggctcccactctgtaatgcccacttgttccttcaccaagtcatgacgataccagtggggtttatggggcacttggctgtgttccaaacagggagcgaagccctcgcttatgatctcatcaaatcggttccgtaccctgagaaggtaggaagtggtgctgttgtcacattatagatggggaacctggagcccagagaggtggagctgggctttgcctggggccctgactctgagcttgggcttgaagcagggcagtgccgggcccgggcctccggtggaccctccacagacccctgtcacagccatggggagcaccagtggtgggcagagggcctgactcctgcatcccacacccgtcggaagaggcgcttcagaggcccctggaagctgggacgtggggctggtgaggcttgaaaaagcctcctcaaaaatcctgctactttgatttgtcgctagtcctgacgattattttgaaattccttgcagcactaaagaagactagcaaagcagggggcggactaaagtgggcgggaaatgctgctttcatgcatctgcgtgttgacaggtatgacctccctgctcaccctgagttctctgagtcacctctgtgcccccagcacccagcactgtgcctggctcagggcaaaggctcagagaatatttgttgagtcagtgaatgagggaaggagggagggaagagagaagggaggaggaaagtggggcaagagatgaagaatggaaggaggttaggaaggttggaagggtggagggagggaagggagggagggacagtcctagaataggagagggagcaggaagacaaggcctcccagccctggccctggaggagaggggcatccacacccacttagcctgtctgccaaaattaatgcattctagctccctgcaaaccttctccccctcttgatttctgcaactcactcagctaatgaggaagaaagggaaggccccttcccatacagggctggaaaacgtgcaaaaaaaatgcccatggcctgagaccaggcgctacaggctatgggcaggacaagcctgggcctcccttcccgggtctgtcctgggctccctggctgctgtgggtccccccaggcaagatactcaccccactgggatggctgagcagagagctggaggcagcaaatggaagcaccatctactgggaacctcatgtccctaaagaataagcaggttgcttctgtcaccacttttttcaatttaaaggagagtgtgttggaaccgtcttacaaatgcatctgttacatcaaaccaaagcctgggcgccttttctctctttcactttatcccatcctcacgctaaaaatacagctggaagataaacagagcagcgctggccagatgacagagctgccttccccagagccaggcaacacttgggggtcgggggagccaggattcagaacagagagaaaacaccgtgacacgggtttgatttctaaactgtcggacccagcaggctttatagtccacagacacttgtaccattctttcccctcctggtttactctatttctggattattgtctgtaagtttcagaatggcccaggatccctgagtggtttataaattagggctgtattctgggagcacccagtagtgctgctgtattttaggtggtgtcagagtttccattataaaccccatttctcagaggtttataacttggccgtaaaaacgtactgaggcctgaggctgggaccctacggtgcacagctgctgggtcccttccatgcccccaggtggggacatccagtcggcctacaacagagaacaagaggctaggagacctgggctttgcctcctggtgtgaggggatgtggacatggggcctccccttgccagccaggcgagctatgtggtccaaagtctgctcataaaggattttccatgagttcacaaggccatgaagctttttagcagcccagcgaccaagggggaaaagctaccctgactctcagtgaccacaacctctgtcactcccgagtcatcctgcaaaaacaaacaaacaaacaacaaaaaaaaaaaacactgtcctccgaggccatccaggccccctttgtacaagctcctgacccagtgacccaacagatacatttcagactgattttcacatcaggaggagattccacgcttggtacgacggcactcgagataacactccccgttttcattaaagggcaagctaccaagggtcacctgtttgggatattgaaggggtaaaggccaacagttcttaggtctaaggagtttgtaaaaaatatgcaaatgcctgggccccacccccgggaattctgggtgccccactctggggtagagcccagaatggctgttttgttcagcgattcccaggctggcattggagggtccatcccacctctgacacctgctggcattgatgcaccttgcttcgcccctgggggctcacctgtcccatgggaaggaaggtagtgccaccttcccacttgttaagaggatcaggggcagtgccctcccaatagtgacacataggtcacagctgtagctcgtactatgactgcgatgggcagagcccagtctgccacaggcactggagaaggaagaggatttcacacagaggttccagagtccatcaacaatccatcagaaatgacgtcaagaatctttcaagtgatgaaattcttggggcgagaatgtgtggtttatacaagcagcctttacctccagcctttccagaaactcacataaaatgagtttcctccattgtgtttaccctactggggacagcaggacctttgtcctcctgctccaggatggctctctaccttccaggcatcccagttcataaacacacactgtaattcctacttttgtttgagagcattgcttggggtcccggtggtttgggagtcactgtacctttgccagcgtgaccctgccccatctgcctgtccacatcctacaccctccatcgccccactctaaagccaccttttccagggaggctcctgggagcttcgagcctcccctctttaaactctccgtgtgtgttactccttcggcactcgcccgattgcccgaggcattctttccacagccagaaactcagcacctgctactgggtgtcagccgagcctcctggaaggcaggaactgtgcctacgagcatttccaacccccttcccaattagcagggcaccttgcatagtaggtttatcaactttcagttaagccaggataatgcaggatagcaccaggggacacttcagacttcgaatcagaaagccttgagttcacatcctggagggacaccctagtagctccgtgaccttgagtgtccactttctttcctgtaatgtggggatcatcacccatatattaagtgttatgagaaaaagaaataatgaatgtaaatcacttggcatctttgtggcatttaagcatgtgcaggatgataattatcattatcaccatggacacaagctcctgttctgggagaatagcccaaaggcacaggatcctggggtgcccaggtgttcctgagatatgtctgtggctgtctctccatcacatggaacatctgggaacttttccagctgctgctaggcattccccacatcccggggtccagcagaagggaaggaagccatctggagttctggagttctgaccagtgtattctgaccccaccagaggcagtttctcaccagattcttgctgccagatctcaaaaggctggtgaggtttcctggacctcccctttccctagaatctggccaggtgtttcccgtggctggggctcctgggcacttgggacctgggcagagactgtggagctggcggctttcctggtccccaaactccactttgtagaggaaacacctaatacaccatcccctgggagacaagaacacaggccagaagaaatcgcagtctgcagggagctctctttgttttctcagtttcttctgaggttcctagaatttctaatccagattcaggaaccacaggcttatctggatagatgggttgcctggctctgcgctcagctgccactcagggactgggagccactcagctgcctggaaggaactgaggcctttccttgggagagcacaagctgtcagctcatgaaagtgctttcattcattcattctttcattcatttattcagaaatgtttactgagcacctgctctgtaccaatcactgttctgggtgtctggaatatgccaaagataaagcagagaaccttgcatcaggggcaaggagatggccccaaacgatgggcagaatcatcagttatgtaacatgtggaaggtatcagtgttatgggaaagaaacaataaagccagacaaggcctgtaagggggagattggggtggtcctggagggatgacaagatgcaatttcaaatggtggggcaagggtagcaaattagtcaggtttgcggcaacactgctcggtaacaaacagtctgggaatctcagcggctgacaggaccgcatagttatttgattgtaggcagattcagtggctgtgtccaggctgaggggtggcttcaagtctattccaggggtctcgccctggacctggactggggcttggttttctgagagcagaaggcgggagggccgttggccatgcaagctgctgctcagacacagggaagtcatatccactcctatcacgctggccagagcaagttacatagcaaaacccagcatccgtaacatagagagtggggaaggaagcaatactagctgctgaacagaagtgcatcctcccaaagccagcaggacaagcccctgagaaggtgtctcctgtgagccatgccttggaggctgggagggagggagccaggagaagactaggtaggacagggcatcagggcaaggggacagtcagagagggcagagacctctttgtggaagtgagcagaggctgcaaaatggcagaagaaaaggtactagaaagtgccagaagggaagatggcaggggtcccttgagttgctggaaaggcttggcctcccactgagcaaggtgagaatctggtgggttttgagtgacaggcactgactcccatcccaacaccaccccgtgcccccttcactgcagggacaccataggggaaaaggggagaccagggaggtgcttgtgacgacccaggtgggaggtgatgcggacctccagggtagagctgtggggtggggagaagcggccgattctgggcagattcagaggtcaagccaccggcctgccagatgctaggatgtgggagagaaagagaaacttccaggctgactcgtggtcttgccatcgtaatggcagctgggtggggtcaggagagccaccttggaatttcagcttggagaggcctgtggggacatcagtgtgagtttcccagggcagccatgcaaagcagcgtagactgggcagcttaaacaacagaatctaccgcctcttagctctggaggccagagtccaagatcaaggggtcggttccttccgaggctggaagagagggtctgtcccggccctctcccctggcttccagtgtttgctgcaattccttggctgtagaaagatcactctgacccctgccttcatgttcacatgatcttcttcctgtgtccatggctttttcttaccaaaacaccggttacaggctgggcgtggtggctcacacctgtaatcccagcactttgggaggccgagatgggagtatcacctgaggtcgggatattgagaccagcctgaccaacatggagaaacctcatctctactaaaaatacaaaattagccaggcgtggtggcgcatgcctgtaattccagctaccctggaggccgaggcgggagaatcacttgaacctgggaggcagaggttgcagtgagccaagattgcaccattgcactccagcctgggcgacaagagtgaaactccgtctcaaaaacacatacacacacacacacatacacacacacacacatacacacacaaacaccagttacactggatcagggcccaccctactccaatgaccttatcttaactaattgtatcagcaatgagcctttttcaagtcagatcacattctggggcactggggacttcagcaaatgaatttgggggatgtgaatcaacctatgacaacatccaaggaagaaggacttctccccagagagggaacagtccctcacatctggctcagatctccatgcctcggagcctcttccagctccctagcacaaggaggaaagaggaggattctccttagacctccagcccttcctagccagaccccaccccaagaggaaacaagcaaagagcagttgcccaaacacagggcagacaggcagtgcctgggccagagtctctctgctcaggagccaggtgctccagaagggaagggcatgagtggggaagggcattgacttgttctgcattgagttaacattccttgagcacctatgatgtggcatggcatcacggagcacttgcagatgtgtcagagggagcaccaggggctgggaaggggctggaggtggcctcctggaaagactttgaaggacatatgagatttgtcctaaggagaaaagagagatccttttgcatagaaacaactcatttgggaaatgcaagcagggagagccctgtgcccagactgcagggtaaggccccaaggggcagagacctgtggcagggtgcttctggccaaccagccaaggggcatgagcagacagtgggaagagaggaatcctcttcccactgggcagcctggtcctggtgcagacatccacctggagctgtggggcctggagtgcctgagaatgttccattcggggcccaagaggcccgccccccaccaccccattattcgctgcagagcacctgcttgggatgcagactgagattcaaaacagtcccagaggaaaaacctaaagagcaaatgtctgttcctcctactcccctttgagagccaggtggtcctcctgggctccctccacccaggatcatcaggccggccctcccctgctcccttcacctgggatcatcaggctggtccttcccggctccctccacctgggatcatcaggctggtcctccccggctccctccacctgggatcatcaggctggtcctccccggctccctccacctgggatcatcaggctggtcctccccggctccctccacctgggatcatcaggctggtcctccccggctgcctccacctgggatcatcccaggtgtccccttgctcatgtcactcaccggcagagcttatctggccctggcagcttcctgctcttgtggccttggaagggttcctgagacatcaggaagaaagaggccttaaggagcattgcctaagtctcggactgtggcaccaaaacacctgattcctgtccgggctctgcctctgtatgtgacttcaggtgagtcattcaacctctgggtgcccaatttcctcatgggcttatgtatgtaagtacttagctcacagcccaatgcccaccacatggcccagtcaggggtggctgcacagccagggatgggcacagctgagtttaaacccgggccagggctcttgacaggatttggggctgcctcttagccaggatgacttctccctacaccctattccaccccccgggcagctcatctcggagcgagaggcaccagtgagcaaatccagagtccaggctccaccaggctcccaagttcccctccttcgtcccctgctaagctaacctctcgcgagccctggacagacctggtttcactttttcccaggatctgctggtctgctaagactccacgactcttttccttccttgagtgatttcacagacccatgggcgcagcaggtcgtgggacatgggtcccaaataggcacggtttgtctgatttcagcctctgagtgggaacagccgatgcaaagggattgtggagcctggtggctcttaccccaggtctcagggactgatgtcccctgagtctttgcatatgcccttgccctgtgtcacatcctcccaagctagagaaggtgggctctgcatcagccttcctggaccggcccccaccagggcaggagaacctaccccactcccgcctccatcagcaagcctcccagccggctggggaacgtgcgctgactttgtaagtctccaccgcttaacacagagtcgtgggctccaccacagaggggttttgtttggaacttaaaacacttgctcaaattaatgaccaaaatgtcagatgtgtccacagctaattattcattagatgcttaattagtgtgggatgatcatgacattttaatgttattaatttttatactgtaataggaattaaattgttctgctgtcccgaagcctcctgttggagtcacactgtggaattgggggctgggaggaggaggggccgtggagggcagctggggcagccagggagctcaccggccagagccagtgcacacacgcccctctgctggctgggagaagcctcttcagagctggatgctttggatggctgggctgacagtgggaacagctaagaaagaggcacagggtagaccagatggctccttgaggttccttcctgcttagacatttcaggatttcatgttcttcatttctccaccccaagacaagaggaatgctagggaactgtcctgcaaaacccacacagaaaagaggaagggactgaggtggtcacacccacaagagaccacagaaggccagcagaatgtcacagacctgttttccactccccacaggccagaagaaggggctcactgggaagaaatgttgcatatttttagacaaatggaaggaagccctgtctgccagcaaagggagtcacacaggagaccctgagagggctcttgtttgtaaaatgggcatagctctattgttatttctcattatgaaaataatccatgcccatgtttaaaaatctaatcattaaaaaaaggtagaatggtaataaaaatcgtgtgaaatcccaccttccaaagatagtaactcttcagattttagtgtctgaacttctgagctctttctgggcagatattagccactgctatcttgtaatctactttttttgctgacatgagcatcttttcaagctgatggacatagatctgcataatcctttctcgtggccacgttatattccattctccaaatactccatcacttatctagccagtccgtgagcgtgggatgtttggattattcctaattactcatcattaataaccaggatccttctaattatccttttcatgttggtctggttatacccttgggataaatccctagagatgggattgctgggtcacaggggaacctcacaggagagttccacttctacctgcaaccttggccaaggactttaatttccctaaagctgttccccaacctgtgaaatgggtacacgaatcctgttctgataatggcaaggattgcaggacctggcacagaacctggcatttagtaggttctactaaatgttagctccttttctgagtagttgctgctaactctcctttcacaaagtgctttggtatatatcatctctttaatgttatgattccaaaggaaggaaaaagtaaaacagatatgaagtctcaagaagggttggggaaattcctgggtgggtgactgcaattgagcaggggctgacggctggggcttattctcaaatcttcagggtcagagacacttagagcaaccaacacatcctctgtctaccatgtctgggcatcccccatcagggagagaacacgatatccattcagtcctggcgatgtactttcggagtacacccctggaggatgtccaggcagaggtttgagccaaggtcccttaaagagaagtcctgccatgagggacgatgatccccccaggaggcctggaggacccctcctgcacctggctctgagagcccagggttaagccctttgcttactgagcctgggcaattgactgaaccatcagaaactcttgattttccagcctagataagagggccaagggctcagagaagcttctcccactgggggacaagaggacatatgagtagctaagtggtgtctgccagagctggatgtgagaagtggatgggaccgtgatcccagagtcaggttatatttagcaagcacgtgtcagggatatggctcctatcagcaactctcaggctgcttggagactgtgtcttacacaatttgaaaaactacctggtaaaacgaagctggcagttggattcccagacttctagaagcccctcccggaggtgtggcgggatctctccagaggctgagctgccctatggcttccatccctaatatggctcttctgttccctccaccggcctctccatcctgggcctgacccctatccacatcaacttcaccaggagcccagtgacacccccaaggtcagtgtctccacccatttagaagggcccatttaggtgaaggctgattgcagagcccctgaagtccccccacggggcagttgcctgtgggagaagcaccatccctccctgaagacagccgatgaacagagcgtgttgtcgggccgccttggggtccaggagcctgggccgcccacactgccctcaggagaaatggacctgtgcccacccagcgctggttccaggagaagggccgggctggcctggtgcagggaggatggcatgtcttacagctccacttagctgactcctggaaaggaaggtgcccctcactcactgcctccatctctccagaagccaatgtcagaacaaaaagtcaggaggagccacacatccatcccatgggcagagggagcctggtgcatactcatctcccttctgaggtcaaacttggccataccctcattgagtgctcccgaaaaaatggcctgtgatggctccaggcctgccagccccagtacttgggatggcttgggtccccaggggagggggcccccggccctgtgccaggagcagagccctcctggggagagcaaggcagttctcaaggaaatcttctggccttcctccctgccccatccatcaccagacagcccactccagatggaaagggaaaaggaagaaaaaatgttaatatgcaattaaagttgagatcataaacaggtgctctaattagaagtcttctcaaatcatcaaaagctcatttacaaggtgagatgccagaggtgccctgatgccggctggcacagagctttctgccactgaggaggagtttggggacagccctcacctgtctccttgaggcttcggcaggtgggcaggggccaggagaggtgggggcacaggggaagtcttagccagacctggaggagggcagctcctgctcacggcagctccacaggtggctccccagcatggccactgctcaggctgtcttggcagaaggagctctgcacgcctggagcctggtgtggagggggaagcccaggatccctttggaggcattcaaggagccttggagatgcaggcagggcttctgccaggctttgtggttcttcctccagtgttcctcagccagggaccttccttggccccgtctcactgaatttctcctccctgagccacctctgccactctcattgcccgggccaatgatgccaaatcctgaaatctagcctagagccaaccctgagcttcaggccgcatacacagctgtgtacagacatgccccctccctcagtagaggtgatgctgggctaatcctttgtccccttactcctcctcaggggctccttctctccctgacaggtgccaccatctatctggtcacccccacatctggatgactcaaacctggtcagttctactcctacatgttccgcagtggtccctgcccctctatctgcacagccaccaccctcctggggcttcctcacctctctctttgactactgccttcgtctccctgttcatctcgggcacatcagttgtcccgtgctggcccacagtccacagcaccatcagaacgggagcttctaaaacacatcactccatgttgttcccctacccaaaagtcttcagcacaaaaagcaactcccctagcagagctctctttgtggactccccaccagtccaccagccccccaactcatttccagggctttgcacttgaagaacccaccctgttgctttcagcacctggccgcctctcaggcctcagctgccctggctggactgccgacctcctcctcctcctcctcctcctcctccctcctcctctcccctcctcttccctcctcctcctgcctaaaaaccaaatgagagtctgctctggtgaggctctggagcccacctctcccagggtcctgtggggtctatggaccaccacaacttggggctgagagttattcgatgtgtggacaggcgctgggttacggcccctctccgaagtgctgagtacaagtgtcttggcagggaggtggggccagcaggatacagccttgggttccagtctcaggcgcccatccatcatgagtgccacaggcagacatggatccccacaggaggggtctggctgagtgggagtgtctctcccacagagagggaagagcacatgggcacccgtcatctgcccaccttgctagggtggctgccccagaggggagcaggggccccttctgggcacccagctggggagcactggctgcagagttgggcggtggggaaccttctctcagcagtcccagctaccccaggctcctacgccaaggacctaaagagccacacagcctcgtgcatcttgctgtggaatgtgtgagaaggatgttggtattggcttcttccagtccaagaaaggccctggcacctcattccccaggtatccatagaaccttccagaccagccttcctcagcatggccagacactgcaaaatcccctccagacagacagtcacacaaacacacacatgcacccacacacctcaccttccccataataatatataactagccagcacttgatattagtggttcccaaatacttgtcttcaatcctgtattgcttgtgatgaaactcttatcagtccatggggaaataagaaaaataaaaaaaatgtggtgggcttttcataagctaaatgttcattttcaaaggactgtcctctattctgagactgatcttcccgcttttattacactttaaaatgtcctctcttttatgaaagcatggtgatggtagacagggtgattgtttcttaatgacttatttggcaaaattaaaagatgataccccatcagcgcccccatttttaattgaaatttttagtgagataattgtaggctcatatgcagttgtaagaaataacacagagagctcccaagtactccttacccagtttcccccagtggtaacattttgcaaaatgtcggcataaatatcacagccagaatgttgatacaagccaccagtctcattccgttttccccatttttacttgcatttgtgtgtgtgtgtgtgtgtgtgtttcattctctacaatttattatacatgtaggtttgtgtatccaccaccgttgcatgtccacagttccttttttttttcagatggaggcttgctctgtagcccaggctggagtgcagtggcacaatctcagctcactgcaacctctgcctcctgggtcccagttcaagcaattctcctgcctcagcctcctgtgtagctgggattataggcacacgccaccatgcccagctaatttttgtatttttagtagagacggagtttcaccatgttggccaggctggtcttgaactcctgacctcatgatccgcccacctctgcctcccaaagtgctgggattacaggcgtgagccactgcgctcactccacagttccttcctttttatttctgaggagttattccatgttatggatgaaccactattgtttgaaccatttactcattgaaggacgtccggatgtttccattttttgacaatgacaaatgaagctgctgtgaacatcacatgtgcgttgttatgtgaacttctgggataaatgcccaagagtgcaattgctgggtcctgtggtagctgcagatttagcctgccaaaccgtgtgccagaacaactgtaccatctcacatccccactaacggggtatgacggatccggttttttcacggcctcaccagcatttgatgttgtcactattttttatttgagacattttgataggtatgtagtaatgtctcattatggctttgacttacatttctttaaggctagtgatgttaagcatctttcaggtgcttacatgccatctgtatatcatctttgccgagatatctctatgtgtcttttgcccgttttctaatggaattgcttgtttttactgttgaattttgagagtttgttattatattctcagtacgagtcctttgctgactatgtgatttgcaaatattttctcccagtctgtagcttgctttttcatcttctccaaatgagcttttgtagaacaaaagtttttaatgttgatgaggtccagttttagcattttccatttatggaccatgcttttaggactaagttgcccagtcctagatcccaaatactttctcttgtgtttttctacaagtattataattttacatttaagtccgtaattcattcttagttcacttttgtttaaagcataaggtttaggtcgaggttccttttgtttctggggtttggttttttgtgttttgttttggttttggcctgtggatatccaattgctccaataccatttgttgaaaagtttatccttcctccatttaattgcttttgtgcctttgtcaaaaataagttgagtgtgtttgttggggctatttctgggttctgtattctgttctgttgatctctttttttggttttttgagacaggagcttcgctcttgttgcccaggctggagtgcagtggtgcagtctcagctcactgcaacctctgcgtcctggattcaagtgattctcctgcctcagccttctgagtagctagaattacaagcatgcgccaccacgcccagctaatttttgtatttttagtagagatggggtttcaccatgttggccaggctggtctcaaactcctgacctcaggtaatctgcccgccttggcctcccaaagttctgggattacaggcgtgagccaccgtgtctggccctgttgatctattaatatatgactgtctctcctctgacatcacactgacttgattgctataactctgtattaatcctcagtatcaggtagagtgggttcttatttattcttctctgtcaagcctgttttagctattctattctaatattggtatctattctaagccctgtgcctttccatataaattataggatacattgtccatgactatccgaaatattgctgcagttttgataggaattgtattaaacctatagataaatcggaagagaattgacatcttcactaggttgggtcttccaatccatgaaaaaggtatgtgtctcttcatgtactaggtctttgattttcctccattggcatgttgtcattttcagtatacaaattctgtacacattctgtgaagtgtaggcttaagaatttcatttttggccgggtgcggtggctcacgcctataatcccagcactttgggaggctgagacaggcggatcacaagctcaggagatcaagaccatcctggctaacacggtgaaaccccgtctctactaaatatacaaaaaaaaaaattagccgggcgtggtagtgggcacctgtagtcccagctactcaggaggctgaggcaggaaaatggcgtgaacctgggaggcagagcttgccgtgagccaagatcgcaccactgcactccagcctggacgacagagtgagactctatctcgaaaaaaaaaataataataataataatttcattttcttggccgggtgcagtggctcatgcctgtaatcccagcactttgggaagctgaggcgggtggatcacaaggtcaggagtttgagaccagcctggccaatatggtaaaacacctgtctctactaataatacaaaaattagctgggcatggtgatgcgtgcctgtagtcccagctacttgggaggctgaggcagaagaactgcttgaacctgggaggcagagattgcagtgagccgagatcgcaccactgcactccagcctgggcgacagagtgcccaggagactctgtctccacacacacaaaaaagaatttcattttctttggagctattatcaatggtattgtgtttgtgattgtggtggccacatatttatgatgaacatatagaaatgcaatcaatttttctgtgttgatcttgtatcctccagctttactggattcactaattagttctagattttttttgtagatttcttggaattttctatttaggcaatcatgtcatctgtacagacagttgtatttcttcctgtcccatcagtgtggcttttacgtctttctcctgctttactgcctcagaacttcctgtactgtgttgggtgagggcggtgcaagcagacatccttgccccattcctcatctgtggaagagcactcagtcttccaccattaaattgatgtgagccagagggattttgtagatgctttttatcaagctgagataatttcctgctattcctgacttgctgagagcagttccctcatttgttaaactttgctgcccctgaaatcagaaactttgggacccaccagtttgtaccatacccaggactgcttttcattcacatcctgcccctcacaggatcctggagggcccggtgggtaaggggtccacagcctcccgctcaggtttttgactcgcaatcctgtcctctaccccaccgatccctctccccttggctgagccttctgtcctgtgccatgttcccggcccctcaggaaaaggaaccctgacaaaccagtgtggaccattcacacattcacatatccactcattcattcattcattcagcaaggcctgcaccctgtggtacagaaatcaagggctgcagacctgcccttgagaaatgcagtctaacacccaaactccacccgcccccgcgtcggcccccgtcgcgctgcatgagacttgcatcccctctccagggggctggccagggctggctgaggctccaggagttgctctgctctaccattttccttttccaggaaatgtgtatcccagacagcccccagcacccactcttctccgggccgccctgcagcagggtgggagcagtgtggtggtcctcaggcccccatctcacccccctacacacacataccactagagcctctggcccacagcaggcagaggacaagccccctcacccatcccagctccagccctgactctggaaccttctgcagaggctcaggctccccccatctccacatccgcaggatggtacgctattgatgttcttgtgtgtgttttttttaatcaagggaacaatttctttatatgcaaatctcttcaataatattattattatcagtgtggcctcaggcagaggctcacagaattggagagttgccgagttgatggtttttttcatagcgactctgagcatcatcaggccagctcctgggaggacagcgaggctcattttccccagaacaatcccagctggaaagatgattgcaggtatcaagagatacggggtgatttcatcctcatctgaatatctgtgaaaccacccctgcaccctgctcctccatctcaggtcacagccaagggtgggcagccctgaccagtgggcactccttccacgagcatctactgagcacccactgcccgcatgtcacttagcgcccagggccaggcgggcagctgctcacggtctgaagagggaggcaggcaagacagtgtgggtcccctgatcccacagacccacggcctgtgggagcccccacccagacctgggaagcctggcagggccaggaccagggtgaggcactggcatggggtacaaatttaaggtggtacaaaaaaaaattgtgaagccaaataatattttaatagaatatttttgataatcaagattaatgcaaaaaatccatgataaacacaaaatcaacattttaaagaaaggcaggacacctacgggaaggcttcccagggaggagacattgtcactgcaagcagaaggagaaggataagcaggacagaagcacggggaagaggtttccaggggtgagaagaaagagagatggcactttcccaccccaggggctccaggggctctggaggctggagttccagtctgaacctatgcatctccccgagctcccccaccgcccaccactgcaccaaagccccaggcccacctctgcttctccttcctaagcccgtggctactgcacacccctgccccccaccccacagtctgcacggactggacagaggctggccatgggcctcccctgcagtggaagaggctgaggcctggagccctgaggtctgtccaggccgtggatactgcacacagaccacagctgtgagctggcctcgtcggggttcagaacaaagcagcaagagccattggaaggcggaggagtcctggacagaaatccaagggtgagggacaaaggtgggacaaagcatgagtgtgtggtgattcatggcagagaagggcatgttcctccaggcctggctgaggggcgaggccagccactcacttggagaacaccagcctgcgttctagcagtgagccttctggataccctcagggcatccaaggccaggccagggcctgcccagatgaccaggctgacatgaggaggccctggctctctgttagcagatggggctgggtgaccacccctccagccagggctggccacccccaggagcagtgtctgaagagttcactctatttgtgtctctgggcattaagctacgttattccttgcccagctgctggggcctgtgtttccaagaaagcagcctttccaacagggactttgactgctgagaaggtctctccacccccacggctatcaccggggcatgcagacctgactcttcctgccccaggccagcggctgctcctctcccctgtgaggattggggtacccaggcctgcctgactgtgcatcctgagaaactcaaagccaccactgactgtagccaccatgatcagctttatatctgatgatctcgtttgactcataccctaaccccatgaaggagtgactgtttccagagaaggaaactaaggctccggaaggtgacctaaactgccactgagtgacagatgaggatctgaatccacagaagctcttcaccatgacatcatgttggtcccagcctacagccatcatctcccagacgatccacccctggagagtcatccctgggctagaaagagaaagctggaagacaagcagcgccaggtcaacctctggcctcaaaatacagagcagcttctccaggcagcttgggactttgagacatctaaactcgctcctaagacaggaagtctgaaaaggagctgagaccagaggcaagagtatagcacagagcctgggtcctggccctgcagaggggctggatggggcagggccagggaggtagcagggaaacacagcacagctgacctggggccttgtatcttgagcctaagaggccagaatgctcatcgggcacagcccaggctcttcctcttggaagtcactagaagctgcctcgacccggagatagggagctgaaagcccaggtctagtttcatgcccccaaccagctaaggggaaagggtgcctcacttgggagccccacaagtggctgcggttctccgacctcacaaattcagcctgtacctatctgttctctcccagcctccaccccaatccctgccctttctggaacctgccagaggttgggacaaacagcagcaccaatgctctagagatcgctccaagaagctggggaaggtttggagggcgcagcggcaagagcctagaaagggactctgaagccactagagacggagccctggggttaggaagcccgtgaccactgctgcaccagtgggaccaagaatcccacagcccagacaaaggtgcctgtggctctgcctgtctccccacaccatcgctgccttgggaagaaaaagcttgctctctttagattgacgagagcagactgatcttgttcctgagcttttccacgcatttctttttccttgttggtaatgaaaaaaaacaacaaaagtcgactcagggcttagccctcaaggaaaaaggcctgggggagttagtgtttcactgccttccttagctttgttatgacactagcaatccatgttcattgatgaaaacttagaaccttcagaacagacaggaataattttaaattaaaatagcttcaaggcctgacactcaaagttaaccacagctaatattttggttttttaaaaaaaaaaaatctttctaaagataaatacaactagggatctcctagagggccccggagatctggcctcctttccaggagcctgggttcctcagctctgagtcaggctggtatctgacttttgctgtcagcgtctgcattggtctcggggaggagcttttgcatgaggcctgggatgtgccctcacagtggctggtcctgggaaagatggtggcgtgccctattgacagatgggaataccgaggccaggaaacttgcaccaagtcagtgagaaaggcagaattggaattagaaaaccacatagctattgaatgaatgaactgtttcttggccttttggctaagatcaaatgtaaaggaatgaaaggatggatgaatgaatgaatgaatgaatgaatgaatgaatgaagtgagtgaatgaagaataattatgctgtactccatcctgaagcagctgacaatgtctgtgagaatgtgttccatgccttctgttcccctgtgtagggtagaaactcctgcacagggttggtgccagtaactagtcatgccagtaactagtcatgccagtaactagtcatgccagtaactagtgacacccagggaagtcagctcactgcttgcagcatctgcttcctagcaactaaccaggagtttctgccaagccctgcccatcccacgggtctgttgtggatatggaatgaagggggcctccataaaactcatagaaaggtcaggacagcctacagaagtccaggatagctcttggagtcaagaggacctcatggcggggaggagtggggcagagatgggcatggggcaggcttgctcaaggtccctgtgaccttggacattcctccacctgcttctctgcatggcatgggctgggtctgcatctctcctcttgtgtgagctggggctctctgtcctctcggtgcataccatgtgggaatctggccccagtaatgacgcatacctcctggccttgcactgaccccgtgcgacagtacccgctcgctgagcccccacagaacccttcgaggtagaaaacattgttgtcacagacaaggaacttgaggcacagagagcttaagtaacttaacctgagctcacaccacatggaagtgaaggatctaggatttgcaccgtgcaggcaggccccgagtccacgttccctgctcctctgtgatacttctgctgtctatgggttaaaaacattcacttatgggccccactggctggatgtagctcccagatctgctggctacaagctcttgacctcagacaaggaaccttaacatctctatctgtaaaatggggcaaagcagtcactcccttataaagatgtggttgggtttttaatggaaatggtgtaatgtaaagcccatcacatagtaggtgtttgataaatggcgaccatgaccaggataaagtgtaacccagaagtgaggctgtcctgggaggccacatgctggcaacatatccagaaaaggctggataagaagcttcctgcacaggtgggcattcttggaggggcatctgctgcccgtgcccagcatgctcccctgccaccgaccaggagctgagtggggtctctctggggcccagcagaggttgacttccctgtacctggggagggctcgtcagctccacccacagcccttgctaccctcccttctctggcacctcggcaccctgcccagacccctctgcccacctgtggctgccacccacacagaaagatgcagatgtgtgtgggcacagcccgtgcacagccaccttggcctcaggctacagctggccccagctcgtcctcctccctccttgatacaaacttaaccagagcttcatgaaaggaaccgaggctaataatttaagaagtaatttgttattagtgtggcactgatgcactgagctgaccgaagtgcctttcagcagattattattaaatattaagtctgttgattcgaggcagagcggcactctggtcggtccctagcagctggggacatgcatttgtttcggtgatttatggaaatcaagccactccagggagcctcacaaatgtcgctgtccactgtaacccaggtatcctcccagcagtcccgggggtgggttatagatgagggagggtctgagaagttaaggaagctgcccgaggctgcacagcagctaggtgaaaaaaccaggattcaaacttggatctatctgagtcaagtctctgccactttgaagctgcatatggagcacacagtagggactcatcacatgtgcattattattattatcatctttccctcccaaacgtcagctccatagccatagatcagaatgtggatttttttttttaatttactaaagtatgtccagcactgtgagctcttgttttttttttttttttttttgagactgagtcttgctcttgtcgcccaggctagagtgcaatgtgcaatctcagctcactgcaacctctgcctcccgggttcaagcaattctcctgcctcagcctcccccaagtagctgggattataggcatctgccaccatgcccggctaatttttgtatttttagaagagacggggtttcaccatgttggccaggctggtctcaaactcctgacctcaggtgatctgtatgcctcggcctcccaaaatgctgagattacaggcatgagccaccgcgcctggccagtaacctcttaatatgctcaataaatgttaagatgaagggatggaagcatggatgggagggagggagggagggaaggagggaaggtgggaatagtaaagtcccggtgagagcaaagagtgacctaagagtcacttttcctgccttgttgtcactgtgcctccaccgaagtctcagagtctgtgatgttcttacctctccatgcctcacgctcttcacctgtaaaatgggctgagtcatcacagtgccacctcacagactcgctgggggttccatgagcaaatgcatgcagacctgctgagtgctttgccaggcaaggtgggcctcagtgtcaaccaccatccttactcgaaaaacctgcagaggggactcctgagcacctcgttccccagactccgggagaggaaccccaagtccaggaaggagatctccaggaaggagatcaattctggcccactacgggtctcagaccagaagcaggcctgagagaagtgtgcccggatcccctaggctgggggacccagaggagaggagcctccctctcgccaggtccactcccagcccctccctctacctctttgttccttaaagtcttgaagttgagctgcctccagaagcgcagagcttctgagaacagcatcactgaataaacagtccttccatgccgtgcctgtggtccacagagcggctgagacttcagaggactatgacggggcaggttgccctgtgagctggtcaggtggtcctgttccacttctctgggtgtccatctggggcggccacagaacctttgggctgaatgttggcttttgaacagatagtaatttttttctaacgcacctacaaaatgccccaaactgctggcgttcttgaggcttcacaccatgctagtcctttagatgttcaataccatgaaggaaatgaaagcagtggaagaaaggcagagaggaaggggcaggggcggcgaatgagtgacagaaaaggaggcaggtgactccagcggtacctggaggctcccgggcccacccgagccctaagctgcagcccttgggacgtctccattgagccagtccttcctgtgtggccttcggattcttggtggaggggacattcttgcacactagtgccctcaagtcaggactgccactcaccctccgaggtggccatcttctcagcttctttcatttctttctattttttttttagagacagatttcactctgttgcccagactggagtgcagtggtatagtcacagcacaccgcagcctcctgggctcaagtgatcctcccacctcagcctcccaagtatctgggactacaggcacacacccctgtgcccagctaatttttattttatgtttgttttagggacggggctcttaccatgttgcccaggttggtcttgaactcctgggctcaatcaatcctcccatttcggccccccgagttcagcttctttctttaatccatcacttaggccacagatatttaccagtcaggtattgaaacttacaaaaagcatagggcttggcaacctccctcttctccctggagttgaaggcagtacctgcctccccatcagcctggtagtgactgtttacgatgggtgcccaatcgctgatagaagaatgaatgagtggatggatcaagggagatttaatccatgctggagaagaagaaagaaagggaaggaacacagaaagagaaacaggccagcagggccccacgtgctgaatgtcaaagggtggaatggaccctggggccccaaagagttcaggacagaagactcttattggaccagtgcaggtggcggctttttgggaagggtgggatttcatctggaacaagagatgggaggcccaggtgggagttgagggtcccaataattagtacgttgttttccctgcctgagttctgaacctactgagagaaacaagagtaaggcagttggaggtacactcctgggttaattcctccagcgctgtggtgcccgggtgctgggcagcagtggggatgtgcccaggagtctccctccagcgtccccagtcagtcggggggcacccctcccctgctgcacgtgccggatgggtcccgagcctccctccaggggcaggcccttccctgccgggctccactccaggctccactgaggtagggcacaggccggctgtgccctctgcaggcagctgacagaagagagggaggtgggccagggttacctgccctgccctcaaactaaggaatcaagagagaccctcctggcaccaagcagctggggctgaagaagggctgggtccttactcttgacctctgatagctttatccccaaagaaggaactgccaagagggaccaagggctactccgaagggaggtagaggtggggtgtccctgcagcaggaagcacggagtcacatcctctccctactgagtgtgtcagagaggctgggggtgtggacagttggggtctggggctcctggacttctccagctggactagacattagaaaacgtcggccgggcacggtggctcacgcctgtaatcccagcactttgggaggtcgaagtgggcagatcacttgaggtcaggagtttgagaccagcctggccaacatggtgaaaccctgtctctactaaaaatataaaaattagccgggcatggtggtgtgcacctgtaatcccagctactcgggaggctgaggcaggagaatctcttgaaccctgggaggcagaggttgcagtaagccgcagtcacaccactgcactctagcctggatgacagagcgagaccttgtccccccaaaaaaaaatgaaaagaaaaaaagaaaacgtccaggcttcttcccttgaagccaggagcagggcccttctggatgccgcatggtcaagcctcatctactgtacctggagccttctcctgaccctgaaccctgcccttgcccagcctggctctcctgggggctcatgggactcctgaggcccctcccatcaccggtcaccccgcccgccaggcccctggcagcctcatatctgccaatacaaagccatacatcttggtgtgtgacaaatcactttttaattgcctgaaggaagaaatccattagtctttcctttccgtgagaaacatcataacgttcagcagagcccaggctggctggaggccgaggctgggggccgcggggctatttttagtttgcgtcaacatccccctccaagcatccattctagaaagggaggaattaaatcttcctgacaccccggggccacacggggagagcttgctgcagacccggggaggagaagccactgtggatggagtgttatttgtccaaatgaatttgtgtcacgtttcacaaaaaatctgcttccctgtaaacaagtggcagtcctcaccctcctaggcagctgaggcccagccctgtggggtggcactacctgctccccacctccccggccagcccacaccctctgtctttgtctggcatgtcctcggcggcacgggctgtggccgcagaaggccagcagctgtccagggtcacagcagtggacgttcgggccgaggggagctgaggccacggcggggactcctcactcctccttcctaagaccacagggggcagagttggggcctggggggctgctgctgggtcagtttggggttccactagcagtcctcaactttagagaaaggccagcgaaagtgaggtttatggcttgtccctgaggctgccttggggccagaggaagtgggtttgccttttgcctggtacagatgactctgtctcgattttgaaaaagatgcagaaagaaggaaagaaagtggagggcagagggaagggaagaggaggggaagggagtgaaggagagaggaggggaggggagggctaggaagatcccatccaaaaaaggggagtcaagggagatggctgggatgtggacaccacaggccgcccgccccaccccgggccagccacccacaggccgttgaggcagcaaggccggcaggtccatgccaggggtgagagctgagtccaaaggaggaactcagtgagtttcagtgaatgaatgaacgaatgactctggtgacaaggggctctgattggccagcatgtgtcttctgaagtcaggcacccctggcagggcccccggtcctctggggcgatgcctgctgagggctgggagctcttccttgggctggggaagctgcagtgcccagggagtgccgcccgcctccacccccaggtcttttcctgaagaaagcctgctggtgtgcaggggcaggctcaatctttacgtcagacagagtatgtgggctcaggacctgccctgtgacatggtcctaaagtaaaacttggaggggctctgggacgtctgggctgcgagcatggcccagtcacccgctagagatgggcaaagctgcgctttctcagtgcagcttctgtacccgggaaacctcagcactttcttgggtgcaggactggagacgagtggccacttgcaagctggagaagaccttggaatatgtcactgatgcaaacacaggagacttggctgaagaccacacctcctgaacctcacctggcaggtttaatagacagccacctagtattgtcacctctctgtggccaccaccctgggacacaacctatgaccccaggaggtgatacctcagccagtccctgtactttgagacccacaggcacctttcaaagaggcttctaccccacaggaacctggggcgctgccacaggtgtgaaaatgttttagcaagggaagcccacagtgggtgagctccggtctttttgctgttgttgtttgaatcagaacaaaatgcactacacgattatttctgtgcatgaaatgcaaggttgccaagtttaggttccacctgatgctaataaccttaattgtaaatcctttatgtatagacttgggctataacaacctcctcgtggcattaaactaaacgctgacaaaggtagagtgggccaagcatccctggcagcccccagaggtgacatggcagcccccagaggtgacattccagcccccgtcatcgtgtgtattaagtgacagggctcataaaaccccacagctcctttccccaccccttgcagtctggctcccagaggggcagatagttggagattctcatgcaaaataaattgctctgcactttcattaaaaagtaactgcaactgactcagcactttcagggtgagcggcagggaggggctttgtggcaaaatcaaaggacggggaggaggtgcctgcccctgggttcactctgcgtccctgccgctgcagcctgccctttgctgtgggttcggtttctctgcatcctagtcccaagtctgtgaccattgggtgtccttaaacaggcagctggagatcccagaatttggatcatgattttactggagctgggcaggccttgacaggggctctagcccagggttccctattctggaacaaaactaggaccgggcagggctgctgggggcagggacggggctgggacaccggcccctgggtccagcgagtgtgtgaagggctgcctccatggtgcactgggctgaggtgtggacgcagggctttctgcacggcaggcgcgacgctcatttaaatagcagatccgaccaaggccttccctctgctccacccgcggagtgctgccccgctgcctgcagcctgaagccctaaccctctaaagagtcccctgagctactcccagggatcccagctggccaaggtctcactgaccccaggcatcaactctggtggctcctgcccccattgatctctcgtccccctccctgcccacatcttcctcgtccctctgccatctcaagacatcacctgctccagagagcgtcctggaccaagcatggtcaggaagccctcggcttaggcaggggctccctgtccagtcaggtagcagcctctgagcaggcagcaggtgacattcatctgcagctgtgggctacagcgggcgcctcctcccccacagctgagaaatgcagcattcggagctcgcaggcatgtggcctaagcaggagggacgcattgccccacggtttatggggcgaagcatgattgagtggatggggcatcagggctgtctttggaaaggacacctttcctgtgatcctttgcccgtcggcagccagtccaagcaaacacagcccctgctccaggcagtcggcaaagtggcctcccccacaccatgaaggacgctttgagcccctgggagcagccagcagccaggtgcagccccaccagcttcagagtgggcaggacagagaggcccctgcccgagcaacagcagcaacacagccctggctgccaaggtcctaacaacccttctccaaaaggcgtctgtgcacagcggggctgactctcaggctgccaccagctggaatggggtggggctgagcccacgaggctgccagaccctggggacgctggtcctcaaggcctctctgctgaagggcatcgggatacaggagctggggcaggatcttccctagaagcttctcagcccgtcctcactgatgaatctcttcccttaaaatgaatttaggtcctttagccccagacaaatagacacactctctagcccctggaaggaaatgagattttaatttgggatgattttattcagcaaatgcccccaaaccatgcacttttcaaagggaaactccaggttcagtctcgccttttggggatagaaaaaaagactttttaaaatctttttcattcccagctcaaactgagaagggaaaacctgttcctctcaaaggggtcttttcctattttcttctacttcagaaaacagtctttcctcctgtctgacgtcgtggctctaggtttttctctgctctgttcttcatgggcccctgcctaataaatgtgttacgatcagaggcaagtttaccacggagctaatgatgctcaagcttggagccctcatttgcacgtgcagtgttgtgctggtagctgttgaacaaccagctctctagggggaaaagcctgatctgtggcatttgccaatctccatagtgcgagtactcccaccacggccaattctcaggctaccagcatgatgtcattgagtgcaaagttgagaggaaagatgtataattggctgtgatgagtcagtgcaagcagacatcagcaggccaggtcacaggctgtctccaggcccctgcaactgaatacacaaggagttatgtattcttttcattaaaaaaaaaatacccaggctgggtgcagtgtaatcccagcactttggggggccacagcggggggatcacttgagcccaggagttttgagaccagcctgggtaacataggagacttcgtctctactaaaaagaaataaaattaaccaggtgtgatggcaagtgcttgtagtcccagctactagggagactgaggcaggaaaattcttgggctcaggacgctgaggcggcagtgagccatgatcacactgctgcactccagcctggatgacagatcaagaccaagaccctgtctctcaacaaaaaaaaatgaacaaactatatagacctcagaccccaacaaactgagtctgcctcattacgatgtaggggtgggggttcttaaagaggtagggcgtgtgaccagctgaccagctgcctctccattggtggccctgccccaggctatgcttagaccaggcagcatagagctatcagtgtgggtgaacccacctttctactttgacactggaggagcatggagtttcctggcttccggtcatttgaacttcctgaaaatgtacccaagcgctgaactactagcaccttctagcatgtcctggccagaggggtcccagcctgctttccttccctttcatcctccccatggttcagagttcccctcggagatcacagcctccagatgcaaacagcctgccaccctcagggccagggttgcaagcacagagccctcgggccttccagtgttttatacatatttgaacccacatatagaaatctgggagtttcacatgcaaacccagatgtatgacttttcttgaagaatcagaagacctgacctcctggccctaaatccccacatggctgcaacaggcaggactgatggacagccacagccttgggggacaggacgtgggccatctggcttcccaggccacaccctctcaggctatctccccagtgctcaggctgaagagcagtggccttttcttatggtgtctgcacagtggtttttcttaaagaaatatttccctctacccaggtttcttccaaaagtgggaaatgaaagatagtacaagtgggccatgtgtttcaagagaaagcacgtagcatatttctttgtatgagtgaagaatgttcctcttggggctattgcgctgaaccattccaggggatatatcactccgaagtttgtgggaatggcgcctcctagagttgtgcattgcacagcacatgcagcctgattcctctgtttcctatgcaaactggaacagtgtcaaaataactccacttaggatgctatcgttctcatacagaattggctacatcacacatgcatggtggagtctgcccacctccaagatctcacagaaattccagccaggaatgatgagggcagacataggaaggcagggccagacggcagggccaacgtggaaggtgcctgcagagacagcatgagaactgcctgataggcatctcatgagtcagagaactagcgggccaggtagaaggttggcctgagttgagattcaggcaggggatcaagcagcgccctctgctgggctgtcccttacttttgcatggatcaccttgcagacttctgttcctccttcagagcccagctaggatgctgactcctccaggaagccttaccttctaggacgttagtcgtgccctgccctgggcttcctctgaaccctgtacacacccaacgttgtacatccttctctgtgtgctgtgattctgttgccatgatctggccccactccaagaacagtgcctggttcatgattgtgtacctggtaatggggacagtgctggtgcataagtgcgactcaatgaataattaattaaatgcatgaatgaatggagaaatggatggatggatgggtggatggaagacacgtaggaattccagccctggggacccaggctggggcccagcattagaactggagtacgggcagggtttagtcagggtgagctcctttggggaccagattttaccaggagagaaccctaacctggagtctctccatgagctcctggctgagtttctgaaatcctgccaccccccacccaggaaagcagctcctgctggggagaatagaagctggaagggtagcagtccggcatccaggccccagctcagctccatggctgtgagttcaatagatgtctacactttccaaggacatgggtaactggtgcaggaaatgttgtgcacattcctctttgcacgacagctggattcaccccccaaaaccgcccacctctgtgtctcagggacaccaacctggacgtatgggcctaattgctggcccttccagagtacaagtggaaacacgtgggccagttgagggtaaaaaatgcagtaagttaaaggcttctgagagatagttacatagtcaaaaaaaaaggtcaagaaaactattgccaaaacctgaaactctggtccttgattaattgactcaatcatagaggctttggcctacctctctgaagttgaatgaattagttgattagttgcacaaagttgctgcaccaacaggaggagggaagaggtcattggtctttagctaatggcacgtcccagcaagttgcttacaacctgccctgggcacgtcgacctggagaactggaggttgcagggtccctccgcacactggctgttgccaaaaaagggatgtgggggctgtgctgggcaggacagagtgaccttcctcgaggctccagctgtacatggcccagattttatgcccttcctccagcctcctttctttctcctgcactcctccctcccttcctttctggttccctccctccatgtcctcacgttttgacgctttgggatttgttttctgacccttggcctcactgcatgggcaagccccctgcctgtttctctcctgcctggagaagggagaatgggaaaatgatacctctagacagatctcgtccatgctgccttggctttgaggaaagaaatcaccacccttgtcataattattgatgggaactggatttgctgagttagaggttgggagaagggttgatattatggccacaggacttgatttggtcaataaagcaaattggtttaagtgaaaataaagcagcgctcacaagtatgttagaagaataaagtaattgctgcccaaggtgcacggaatataaatctctgtttgcttgaaattattacaatgtcgtattgattacttagaacctgccattgccttttaagttatagtttattaaagggtaatgtgtttaacaaacattttccccggcatgcaccattgaaacacacagaagttacacgggcgcgttcccccaaacccccactgcagcctttggttgttctgtggtcacgtgattaactttccaggctcagcttgcaggcaccagggtggtcacccacaggggttctggtgaactcaagatcctgccagaaccctgggagaggtgcatggaagggctcagaatgcgctgaccacactgacgtgtttttttgtttactgctctgcctggccaacaagataagtccatgaagtcaccagcaccgtccatgtttctcactgcttcctcggcgttcctccagaaccaagcgttacaccccaacacaggatgtgtgccataaatactggttgcatgaatggctatttttttttaacttcacttttttcttaattaaaaatttttaattacaaaggcaaacaggctcattataacaaatgaatacaattttaaaatatttttctaattagaaaaattaggcgtactcatagtagaacatttataagacatgggaaagtactaaaaggataataaaaaccacctataatcccatcacccaaaaataacctctgtttacattttgttatatttcctgccagtttgttgttgttgttgttgttgttttttgctatactcatgcctatgggtattttttcttttcacaaagttgataatataagatgaggtttagtgttttgcttttttttcacttaccattgtataaaagcatttcccccgtcattcactgtttctcaaaacatatttttttgttttttttgtttgtttgtttttttgagacagagtctcactttgttgcctaggctgcagtgcagtggcgtgatctcggctcactgcaacctctgcctcctgggttcaagcaattctcctgcctcagcctcctgagtagctgggattacaggtgtgtgcctcctgagtagctgggattacaggtgtgtgcctcctgagtagctgggattacaggtgtgtgcctcctgagtagctgggattacaggtgtgtgccaccatacctggctaatgtttgtatttttagtagagacgggatttcgccatgttggccagactgatcttgaactcctggcctcaagtgaatctgcccgccttgacccctcaaagtgctaggattacaggtgtaagccaccacgcctggcctaaaacacagtgtgtgtgtgtgtgtgtgtgtgtgtgtgtgtgtgtgtgtgtttgagccggagtcttgctctgtcacacaggctggagtgcagtggcgcgatctcggctcactgcaagctccacttcccgcattcacgccattctcctgcctcagcctcccgagtagctgggactacaggcgccctccactacacccggctaattatttttgtatttattagtggagacagggtttcaccgtgttagccaggatggtctcgaactcctgacctcgtaatccgcccacctcggcctcccaaagtgctgggattacaggtgtgaaacaccacacccagcctaaaacacagtttttaatggctgcgtaatatcccatcttctggatatgctgtaatttagtcatttcctgttggacatctgtgatgcttccggtgttcagcactataaataatactctgatgaacatccttataaataaatttttcatctcatccctgggtattataaaaggacaagttcttagcccttttcccatttgcactgagaataatccccagcagcacttgtggctgcagcatttaccccgagatagctttgacatgaaatatctcgcttttattattattttcacatggctctagtatatcgactttggaaacaaaagacctcattctatttttagcattctgtgtttagtagtggtatttccatttacaaaatatagcagttcccgaacgctgaaaatgtcaaatcctggaaaacgcagcatttctacatgtgatgttaacattgttctcaaacagttgttggctaaagactcatttgatgaatccgagttttctgaaatagacaattctgatgattcagatgattctgatgttagttctgtttagaaataactccaagaacagtttttatattttattttcacattgaaaatcagtgagatttgcttcatcctcaaagagtgtgtttatgtaaaattaaatgagtgctggcagcgagcagaacttttttttttttttctgaacaggaaaagggttaaagcaacagctcttggcagatgtcatggaaagggacagattctgggtgtgcaacctgtgccgttgtgttaaaccaagcttagtttaatgccttgctgccgtattctcaaaattcttaatagttcttaaaaaagggatcccacattttcattttgcaccaggtcccacaaatcatgtagcccatcttggttggtgtattagtctgttttcatgctgctgataaagacatacctgagactgggaagaaaaagaggcttaattggacttacagttccacatggctggggaggcctcagaatcatggtgggaagcaaaaggcacttcttacatggcggtggcaagagaaaaatgaagaagatgcaaaagcagaaacccctgataaacctatcagatttcatgagactttttcactaccacgagaacagtatgggggcaaccgccccatgattcaaattatctcccgccaggtccctcccacaacatgtgggaattatgagagtacaattcaagatgagatttgggtggggacacagccaaaccacatcagttggggaagactctttcccaccggtgttgaggagtcaggccatctctaaccattgagggtctttgtgccaggtctcacccttcatccccatgaaaatcaaagctcagagcatgatctcctctgtgccctgctgcactgagcctgagaattgtcgtacaaagagaactttctatgcagctgaagtttacccttcaaacactgagtccatttagtgttgctataacataacacctgaggctgggtaatgtagaaagaaaaggggtttacttggcacaggattctggcagctggaaggttcaagactgtgcagctgcatctggtgagggtctcacgcagcttccactcatggtggaaggtgggaggagagccagcctgtgccaagataacacgtggcaagagaggaagcaagagagagaaaccgaagaagccagactctttaacaactcgctttctccggagctatttcattccctcaggaggaagaaattaccccttcgggagagaactaatctgttcatgagggatctgccctcataacccagacatctcccacatggccccacccccaacactgccacactggaaatcaaatttcagcatgggtttcggcagtgacaaaccatatccaaaccatagcaaacaccaaaacttatatattatcgtggtcattcatgcctcatttatattgctttttatttgaaccataacttgcttatgccgttatttttgtttcttctttgaatttccaattctccctttcactttttcttaaatcttgaaacaatcagacatactaaaaagttgggagtacaattcaaagaaacttttttctgaaccatttgaaatttgccagcctgatgtcccatcaccccccaagtattttagcatctatgcaacaaaacattttctctgacaaaaccacatcagaactctcaaatcaggaaacaaacattgatacatgtctatcaactaatcctgtcttcaatgacattttaccgattgttccaatgatgtcagcatcacgggtcacatttaatagttgcgtccttcagtctcgagcagttcttcattttgtcattgacttttgtgaccttgacatttttgaagattacagaccagttactttataaggctgcccctcagtttggttttgtctgatgttttcttgtgattagactcaggtggtgcatcttgagcaagagcctcacataagggatactgagctctgtctggtggcccaggatttccaattttttttttctcttcaacttttaagttccaggatacatgttaggatgtaccctggatgtgcaggtttgttacataggtagacatgtgccatggtggcttgctacacagatcaacccatcatttagctattaagcccagcatccattagctattctttctgatgctctccctccccacccccaccaccaggccccagtgtgtgttgtccccccggacatgtccatgtgttctcattgttcagctcccacttacaagtgaaaacatgtggtgtttggttttcttttcttttcttttttttttttttttgagacggagtctcgctctgtcgcccaggctggagtgcagtggctcaatctcagctcactgcaagctccacctcccgggttcacaccagtctcctgcctcagtctcccgagtagctgggactacaggcacctgccaccacgcctggctaaatttttgtattttttagtagagacagggtttcaccgtgttagccaggatagtctcgatctcctgacctcgtgatccacccacctcagcctcccaaagtgctgggattacaggcgtgagccactgcgcccggcctggttttctattcctggattagtttgctgaggataacagcttccagttctatccatgtccctgcaaagtacatgttctcattcctttttatggctgtatagtattcaatggtgtatatgtaccacatttttaaaatccagtttatcattgatgggcatttgggttaattctgtgtctttgctattgtgaatagtgctgcaatgaacatacacatgcatgtatctttataacaaaatgatttctattcctttgggtatataaccagtaatgggattgctgggtcaaatggtatttccacttctagatctttgaagaattgccccactgtcttccaaaatagccgaactaatttacattcccaccaacagtgtaacagcgtttcttcttgtctgcaacatcgccagcatctgttgttttttaactttttaatgatcaccattccgactggcatgagatggtatctcattgtggttttgatttgcatttccctaatgatcagtgacgttgagcactttttcatatgcttgttggctggacgaacgtcttattttgaaaagtgtctgttgatgcaggatttccattttactcatgactggtgatgttcaccttgaccacttaattcaggtggtgtctgcaaggcttctccactgtaagcttactcattttctgtttgtagttaataaatattttgtgagaaagtactttcatagtatatgcaagtattccccatcagactttcagtttttattcatttgtttatgtataaccttattttattcaatggattataatctattaccattgttatttatttcagtgttcatgttgtctcagatttggttggtggacctccattcaagctggtttctgggtcatttgatataagcccaatcattctttgagcacttccttgctttctgaacaagatgttccaggcatatcttgtactttcctgaaatcaaccatttctccaaagaaacctggtttcttttagtggaaagtggtgtttagaagccaagatctgggcctgagtatgctcactgctcccaggcctctctcagtagatagagctggggaatatatgtatcatatgcacacacacacacacacacacacacacacacacacacacacagagttggccttccacattcatgagtttcgcatccgtggattcaaccaacaacgggccaaaaatatccaggaaaaaaattgcatttgtaccaaacatatttttttcttatgattattccctaaataaaacagtataagaaatatttacatagcatttacattgttactaggtattataagtaatctaaagatgatttaaatcaagcttgtccaacccatggcttgtgggctgcctgtggcccaggacagctttgaatgtggcccaacacaaattcataaactttcctaaaacattatgagacttttttgcaattttttttttttttagctcatcagctaccgttagtgttagtatatttatgtgtggcctaagagaattattcttccaacataatctccctgtacacaaccagtctcacatctctgccaccccatgtgggccccctccaaacccagactctgacaccccttgcaagggcactccactgtgtggaccccccactcacccgtcaatatgcccttatgctgttgtaaggaggattctgaagccatctccaggctcaggggaaacagtgacgtgattgattagtaatgtctgccatgaacagagggacaggaagggttcctgccacacatatgctggccccgacttaagatggtcagtgtgagcatttatattgatcaggtgaccatatcgttttgagagagaaataagaattaacaattgcaaacaataaaagttgacagttatgctgggcaacaggcattaaccaggtcactggtcatgccctgtatgggtactgaggaagcacagttctgggtctgctctgtggttttcgaccctctgtgttgggcacatgtctacagtttccagcagctcctttgccacctcccccaactccttgccctcttctgtagactgtgggagggtctggcaagcctccttaaggaggaagattcccatgcagggtgcgccttaggaatggaggtgcccatggagggcaccccttaagggtggaggtgcccgtgcagggtgccccttaggagtggaggtgctggtggagggtgcccccttaggagtggaggtgctggtggagggtgcccctttaggggtggaggtgctggtggagggtgcccccttaggggtggaggtgcccgtgcagggtgccccttaggggtggaggtgctggtgtagggtgtccccttaggggtggagatgcccatggaaggtatccccttaggggtggaggtgctggtggagggtgcccccttaggggtggagatgcccatggaaggtgcccccttaggggtggaggtgcccatggagggtgcctccttaggggtggaggtgcccttgcagggttcctcttagaggtggagatgcccatggaggtgtcccttaggggcggaggtgctggtggagggcaccccttaggggtggaggtgcccgtggagggtgcccccttaggggtggaggtgctggtggagggtgcccccttaggggtggaagtgcccatgcagggtgccccttaggagtggaagtgctggtgtagggtgtccccttaggggtggagatgcccatggaaggtacccccttaggggtagaggtgctggtggagggtgcccccttaggggtggagatgcccatggaaggtgcccccttaggggtggaggtgcccatggagggtgcctccttaggggtggaggtgcccttgcagggtccctcttagaggtggagatgcccatggaggtgtcccttaggggcggaggtgctggtggagggcaccccttatgggtggaggtgcccgtggagggtgcccccttaggggtggaggcacccatgcagggtccctcttaggggtggaggtgcccatggagggtccctcttaggggtggagatgcccgtggagggtgttttgacttctactcgggactcaccaggtcccttctcattttcttccgggttgaccttgttggcagcaggaagctgaccgtatttgaccttctcctgccaccacagaaccccttggccacctccctcatccttattcccccgattggtgcccacagaacctgtgcttggctgtcagcaaaggcgtcagaaatgggatgactcatttcctctccaatgccctggggcattcagaaagtctacttgtggaaaaagtgctttagataaaatgcagttgtggactggcccagctttagtttaaatcttttcatctcacaaatatttttaaggacccactatcaatcagacaatgtcctcaagtgatatgtgaggttcatgagtgattaaaacaaagacacctgtgggccgggagagacaaacagaaaagaaaaaaatgagtaactcaagcatgtcagaaagtgatatgtgttgtaggaagaagaaagagctcagagtaagaatgggagggtgagggcgggagggtttcattcttcaagaacttaggagagcctcctgtgtgccaagcgcccaggcttggccctgggggctcagagaagaggctggccccatctcagagaccacagcatctatagagagaggaacataagagacagaggttaggggctctggtgctcggaggaggagtctcaaaggaatctgaaagagggaaggaaggaggaggagggtgtgcaaaggaggagaatcccaaggagtcattgcaggggagtggaggagagggtgcagggagtggaggagagggtgagtttctgggaggggctggagtgaggctaagggtgcccagaggcagaagacagctgagctgacctagtaactttggatttaaaaatctgtgaatccacagctcccagagtggtaggaagagaagctgatacagagggttaatggagtgttaaatgcagatctttctttggagaccctggtctgggaggggaagaacaagatgatggttccggagtccagtgagcaagtttaacctgggccactcaccattcctttttgcctcaagagtgtggccctgatccagagtcctgaatggggaagcccagggcctcccactgcctgtgccacccagccactcccacccggctttctcccacctggacctcccctccctggccctggccacctgggcccctcccatatggtaggggcctcgccctctgtcccctccccataatccctcccacctgggcccctcctacctggccctctcctacctgaccctctttaacgtgatcttttcctacctggccccctcccacctggcccctcacctaaccacacctacctggcctcctcgcagctggccctcccctacctgactctgtctcacacagtcctctcctacctggcccctccccctgactcctccccactgaaccctgacacctgcccctcccacccggccctctcctacctgaccgtctttcacatggtcctctcctacctggcccctaccacccggccccctcacctgaccacacccacccagctgaccctctctcacctgggcctctctctcccaggcccagcagcagcccatagacaccccagctctctctgccccctccccacgaggaatctcccttggcctccttcacaggaaggcaaagtacccccgcttcattttaatggatttttgtctaattactgactggaacagatgcagagacaacctcattgaaaggtctgggaaggcgcaggattggcctgggagagccagtgtgaccttcaccctcacagggagggaagcaccacgaggttactcactagtccctcctggtctccaccccagtctccaccctagccaccctggggcttccctgcccagaggggagaagcaaggaagggaggagggtgcttatcacatcctgtgcccagctgggctccggaggtcggacaagagctgcagggccaaaggacatgtgtgcgcaggtgcactgagtgtatgtgcatgtgtgtgtgtgcacatgtatgtatctgtgcatgagtgtgtatgtgcatgtgtgtgcacacacacaggtgtttatgaggaagaaaacgcagggcacagaggaggaaggcacccagctagttcccagacgcttgttccttctctccattcgtaacagagcatgcctgaagtggccttgagctccagagaaccgtgtgtcttccaggcaacttcctgtgtccatcgggtcacgtcctcaccgcaggctcccagcagccccctcccctactggggacactgtggctgctgaagcttcctgacactccagagaatttaatgcaacccgactcccctgtggctttgcctgaatagggcctgatcaggcctgggtccccgtggccctcagagcctgtccctggtgtccagtatctgtggcccttggagcctgtccctggcactgggtctctgctgctgggactgctccctaagaggttctctctggtcttaccagctggctggttcccaggggtagaaggacacctcttaggcttctctccattcctgatggcctcagcacagaaccaagcacagaaaaacccccagggagggagagttaagtaggactgggactccagtgtagacctcagccaggttccaggatatgcactttttaaaatcctctcatttaatcctcaccagaatcctagaagtgggcctgtaggtgaggaaagagaagctcagagaggaccagtgacttgccataggtcacacagtgggagacggtagaacttggattcaaaccccagtctgaccccaaggggcaccagcctcctcctttgacagagcaaggctgatggccagagggactgatgaagtagccttctgaaggccaccacacccccccagtgccacccagcctagctctggaggcaagggaacgatgcttctgccacaagaggctgcatctctggaccgccaagtcccagaacaggacctctgagcccggacctcactcagcccctgcaaggtgccgtaaagtgtgatgcagagcttgctgcacagggtcaggcaaaccatggccccatttctccatccacccaggagccattcccagttgtgttcactgggaacagtggatgtgcctgtctcggccagactctgcttgtgaaacagcattcagcagactctcctgtgtgtgcgcctgacacacaggggtgggacaggagcagagcactggccgacaggagggaaggaaggaggaagtccagaagctggctcgcctgggcttcaggccgcagccactgtgagccctgtccatcccgggtcactgcccacgcatatccaggaggttgctcattaaactgaaagcaggggaggactggctctcctgcttcctgtccaaacactcagggctctggagcagcccgcccagttccgcaatggtgcactgcagcaaagcagggaggctgggttaggggaagagctggtggaggcccctgccacagctcccgggatggcgtgctcagagttgacctccagagtcacagtgaaccaggaggttacagtccaaggagcacggagccgcacggagagcctcttaccctgtttctctcctgccctgtccatgttaagcagtagctgagtggggatgtcattgtggcaaaccttcccccaacagccggtgaggacagagggacctctgggagctgcaataggaacagccgcagtctaactggctttcagagaagctaaagactgtgctaagattggtagtgagaacagggcctggcacacatgaagtaccttgagtgaatgaacgaatgagtgagtgagtaaatgaatgagtgaatgaatgaatgagtgaatgcatgaatgaatgagtgaatgaatgaatgagtgaatgcatgaatgagtgaataagtgagtgaatgaatgagggaatgaatgaatgagggaatgaatgaatgagtgaataattgagtgagtgaatgaatgagtgaatgagtgagtgaattcagggctcagctatgatgaagagggcacactggcagtgagggagagctgtgcagaaatctgtgctttagagaaagtgtagtcatccattcccagagccatcagctgtgtattgagtgctgccacgtgtaggggctgagatgcaggacccatcccacagggctcccctggagggagctcacagcctagtggactgaaagattgaaagcaagagggataagcgaagctcagggttctgtccctgaccctctttggtgtcccccatctgtgcacagaacctggctcagaggtgactgcacagatttcctggaggcccagatgggggtgctgaaaggtgctgagagaaacttccctggtttaagcctcaggaaaggaaagggcagcttcccagacatctccaggcaaagtgtcaggaaccctgggtcctgtagctctaacaagaattctcacctgcaatcaagagcttggattcaaagagaagggaggtcgtgctctgcagggctatctcaacagtgactctgagtccaggcctgaacagccacatgatgcaggggcgtgaaatcagaagtgattgtcaccctgtgctaagatgagaccaacatgactgcccccctgctctgtctctggggagtctgtactcaggtcctagcaatttgtactcaggttctttcagtgggccacaaagtgatgggttctggactctaaaattcctggatgtgggctctgttctagtgcacactgcagggaagtgtctggaagcatgagagaagagggaaataaatgtagaagatggcctgggtggtggtagctgaaaatttcctccacataaaggaaggcaggagtcattcccgggttcgtttcattacatggaagaagaagggtgttttcctgccaggtacctcccttcaagctcccttgctggcccagggcttaggaattccccagaagtggtcatcttcctccatttctctaccctgcactccttcactctttcagctggttgcttggcagatatctgtagagacctagtatgtgccaaatgctgttctaggtgtgaggttgctcttcctcgtcttagttctaaaccacttgccttacatgctgcgataacaaatcaccagctgccaccttcccctcccgtgcccagggcagacattactaatggatcacagcacattttccaaatgcagtctcagaatcctgcccagcctggccctacagctgtcagctgtcagtagaagcccatgaataagagaaaagtaatttgctatccctgctcttgccccctcctgtcactgcctccaccctgatcatctctgacctgttggctctttctgccattttcagcctcacacaaacactgacgatgtccctcccaccctctccttagcgtctgcctttgaccacaagctgggttcttcctcctcccccaggacttgagtttcaatgaccttctgaggttgtcccagttcctggaaccccttatcttggcttgcttcatcccccccaaccccatgccaaaaaaagaagccagatttctgtagggcagaaacaaaacccagcagacttcccaagccagatggtgggggcccaaatctgagaactgaatttttctgactttttttttcaagcaatctgctaatggaggcgagaacaagactcagggagttatcagctgcctctgtcaacagtgggtaatgatgtgtgaatgctggcacctcccagtaaactgtgaacctcaagggtatccccaagtgcctttcagcctgcttgccctccaggagaggggattgctccccagctgccccttcaaagcctgcagcgagatgggtgtgttctgggagccggattggcctgtggctttggaaatctatttatgggacacacagagctcgcccttttttagaactagaggaaactgacagcttcgattgacagaaagctccgcgaaaaggaagggagcatttgtttccatttttaaagtgctcaagcttatttgggggtgcatgtgggtaggacccaggagggcagctgggaccagaatttctcagagccaaagcaagcagcccctccattcatgctccctccatgggtcctgtgggtctgctgccctccacccacctgtggccaccccacagccctgctcctccttctcctctttctctcctgagacccagagctgtgccctccccaaagccactctctcatcattccccagggcagacagagccagggcctggatatcccaagaatcacaagcttggaactctcacccaaggagccgaatgaggtcctgctcctggaacaggcaggagaaaagcccctggctcccacggagctccagggcccatgggtggctctggtcacatttgcagcctggtgtccctgtctcccccagcaccaaggcaagcacctagcacgtggtcccccaaaccaagctcaagcccaggagtcattcattcacctcctctgtcacattccacccccaggtcaccactaggtctgtccacctgttctcctaaatgccccaaacccaaccacgtcctgcatctcacaccagctccaatctaagccgctagggcccttttttccaaatgcgggttgtattaatatgcagccatggtgaggctagcagatcagcaggcggctgcctgtttaagatggtttgttactcatagatcccatgaggagggggcaggccacgtcacacaggaccacttggggaagcagggagtccatcaagaggcagagggagccgggggcaatgtgggcagagcctctattgtggtttttgcaggaaggaacaagtaagacggggtgagcaggctttggagaaattcctggggtaattcctgcgggctctgggcggagaggctgcccctaagttgtccctggcctggggtgactagggcagctagatggtggcccttgggggaaaccctgatagaggaggttgtggggtatgggctctgggtgggttggtctgaaaggtgggttcccaggccagtcctttgctatctctaggaattgaccagccctaggggggcagtccctccaggttcagcaaggccccagaggtcaaagcatcagaaatacagaaaataaaatggcatgacgactgtgccttcttccggaccctggccaaggttttctgagcatgctctcacccttgcaaactcttccttgcacagtggctagcaataatgatcctcatgtggtcattacagccatgcacacgcacatcacctcgccaattcaacaccactgttctaagggtggccactgtggccattcctgctctcaaaccccatctcaaaccttgtgccccaccccacgctccagacacactggcctcttgcaggtgtggaatgcactcaattcgtctgcctgggccatccacctcccctcctctgctcacacccactcagccctgtgacccctgcctaaggatcctcgaagaaccagctcccctccctcactgcttgggcctctgtggtgggaattttggatccaaaagggccaccccactcagagtgagcattcagtggggcatgctgggcaccgatgacagggcacagctcatggcgggcactccagaaatagctatagaagagtttctcaaatcttcatggtgaccctttgaggcaggtgttcttgtttatccccattctttagatgaggagatggagcatcttaacccattgttaacatgttcaacagccaggcgcggtggctcacacctgtaatcccagcacttggggagaccgaggcgggaggattgccagacctcaggagttcgagaccagcctgggcaacatggcgaaacccggcctctactaaaatacaaaaaattagcggggcgtggcagtgtgtgcctgtaatcccagctactcgggaggctgaggcaggagaattgcttgaaccagggacgtggaggttgtagtgagctgagatcacgccactgcactccagcctgggcgacagaacaagactccgttcagaaaaaaaaaaaaaaagatgtgcaacagatcccatcacatctaacagcaggagtgtccagagcccggccaagcggacagaccagctctctccccaccctgagccttcacttcctaggctgaacagtgaggatttgggctggatgcttttccagctgttccccagctgtgacattctaggatccggtatgtttcatagccactttctttagaggtctttattttcttgcagaaaagcaaatgaaaaacataattttcattgcttctaaaagttattggtgaagtaatacacattcatggcaagatgccagaactcagtgggcggatttggcccatttctcccccagctcccttttgcccgtcagtcaattgctgcatatttactgggcacctaccgtgtgccaggctctggcccagacacagacaccgggtgagttagctggacacagtccctgacctccaagacctgcagccatagatccttgtgatgtttctggaggggctggcaggaggcatctcgggatctggggtgaccgcaagggtcttctctgggagcatctgagtggaggaagaaaagtgagggaggactgtctggggctgcagtggacagcggggtgggggcaagtctggtctgtgccaccagccccgtgagcatctttacctcgcggtgtggtgtccgtggggcttccggctctgggctctgtgcctctcgcctctgccattcccggcatcctgaggtaaagtgataaccaggcctcctcctcgcctggctctctgccactcccccagccaccctcctgtgacccaaatcccctccaggcccctcgctccggcagcctcttatctcctgcttcccagagccccgttcttcccagtccagctccgcctcggggccgcatggggcctgtgctgtgcctgctctcctgctcatggcgccagggcccccgcccgctgcctctgctcctgtgggactggattcaataccaacatgctgcggcgtcccccaggcatggcaggaagaggggggtcaaggccgccagggttgaaggcggggagcatggagcccctctggatgggacccaggagccaacacgccgtgcccctccagccatccaggacagggtgccccagcagggcccagacagctgcttccctcactcctgagcagacagggaggaactcggctcccttctccagggaaaagtcttaaaatgtatttagggacccactgttgttccttccaaagttgcctgctcggattaagtccactagggctgatgggcagtgggcatggtcctgaagatgggaaggaatacctcagccatgtacatccctgtccccccagccccgaaacacacggaactcacccgctctgcgggtctggggtgcagaggagaagcaggggcttccgccaccccctgtgtctgcagccccaggcctctatacagtgaaaacccactcgcctgccgaggctgtcagaattaaagaaggatttcagcagctgtagtcattaagataaaagttgcactaatgactccagcgttatttagttctgatatcttaatttaattggatttttttaattaagaaaaagacccataatcctgcaagcactgagctggtgcagccttttcacaagttacccttaaagggctgggtctcggacccccgtcccccctgcctgaaggccagggtcactttgggagaggagggacaaagggccaggtgtctgaactgagaaggaagcaaggagccaccaggagagaaaggccaaggctcccccacatggcagccgctcaggaaggaggcggcagctggcaccggtggtgctgtctggcacggaggccggctgtaggcattgccgccacccgccaagaggggcccgagtggtagccattctccacccccagagcctcccacgcaccccagacatgggccttgtgcctcctgtccctccacccagaagccccgtccttctcaagggcacacggccctcctgcacccagctctgcccaggggaggggaggttctcaagctgaccctcctgcctcctggccctggacggccacagcacctcttgccctccctgccaccttcccctccaggctgtctcagccaggggctgcttggcaacagtgattgatggtttaccaataggagtggaatgaaattttaatagtctcagattaaaggatcagagagcagagggaagcggggagcctgcctgccgacttggtgttttcacgccgagcacagctcggagccctgcagaaggacctgctaatgccacggtttggggaggtgttggaggggtctgcactggaggattcctgagacatcaggcaggctctgagcctgcgcctgtcacagggtgggccggaggacacacggctccttggggtccagagctgagccccaggagcttggcatcctcactgaatcaggatgcaccccaggatgcaactgattgcaccccgatgtcctctgagcatcctcctccctagatctgggctgaacttccagcttctgggaggccaggggaggggggcctcagggcctgactgcaggagaattctagaaggaaacacaagtcagactcgcagcgagtttccggaacctgtctgggttcttggatgagagcttggttctctgctgttcttaggaaaccatgatgtttctgttgtttgggaattctgtgtaaaataaatgggcacttcctccaaatcacatgtgactctgggaccccaaggcccaggctgaggatggatctaaatggggatttgacctccagctcaggagggggattcttctcctctcccccaactgtggggtgattgttcctatccttgtccctggtcccgaagggggaatgagggcagcagggccccctggcacctgtgtgggattctgccaccacttcttgtggccctctaaggtgcccctgcacactctcctttctgcaggccccactgcccttcaggtcccctggggtcgcttgtgtcccctgaggcaggtgctgaggctcaccctgcagcccaggctccaggcactgagccccaggggtgagaggctgagcagagtctaacaggtctctgcggcagcatgggctgggagctggagccgggaacatgagatgtttctgtcctctgggcctcagttttctcctctgtgaaatgagccatgtagaagatgggatggccaatgtctccatcaggccccaaggatacttggccatctgggccatgagtaaggcctatgcatccaaagccagccattaggtcctcagacgtgcagacaggcagggctggctgtaccacacgggccaggggagtatgctgtgatggattgtgttttgaggtcaccgcggccggtgtgcatctcagctggtgtaagaccctgtgtcactgagcacggtaacccactggctggctcatgcgactgcctaggactgctttggtgccatcagcaaagagcatcatgagaacatgggactcggggcaggcactcaggtggggaagagagaacacacaaaggctgggagctggggcctggaagggcagggacaggcagggctggaggtgacaggaaggaacgctggggtatgggcctcactagagcccagatttatccagcagtgccagctgggagcctggaagaacaggagtccctcagtgggggtgactcgtatgactgtgaaggacaggctgggacctagaagccctggccctctgcgctcaggctcagggggtgacgctgggctgggcgcttcccatgaggcaggatcctcattgctgtcctttctgaacaacgcccaagaatccaggcatggccaggggctggccgaggggggccggtgggtggtgaatgaagggctcccagcaaaccacagccgatccaggcaggaagagcccaacaggttcagcaggagcacctggatctgatattgatcatcccagcccctctaccatctgctcagctaccaaggctgaggttggtgctcctggaggagcctccaggagcccagctggggtgatggagggacagagggacaggcagagaggccggcgggcagcaggccaatgggccaggcaggtggggcaggagcctcctcttgggagtcacatggcccctgagggcatgggactctccctgctgggcacaccccagcggcaccagcacactcctcatcctctaggatgagcccaagcagaggtgagagaaagcctcttgcctgtaaactcgttgcaggcgcagggatgggctggttcagggaggaggggagactgtgggcggcttgcgcagcaccctctgcaggcagagctggttacatgcagcagtggcacaggatcagcaggcaaggctccatgatgcccgtcagaggccacccctccccagccccctaggccactgtgttagattcttcacgacgcctgtcagaggccacccctccccagcccaacaggccatggtgttagcctctccacgctacctcccacaagcagaaatgactcggggatggatgagaacgaaccctcatccctgcctgcacgccggcctggaggaggaagccatcctcgaggcagccttcaccagcatgtgtcaccaggcactccatttcctgggctccatttttcccctgacctgcccagtcctgtgttccaggtcagaagagcaaacgcagtctccagagagatcatgaggctttctgcagactttgtccccatcgaagggtcgtggccaagatggtgattgggagatggtgttcagggaagcctttgtgccccaggaaaagccaggccaggcgtgcctatctcctgccagcctcactacccgcaccaggattcacgggttgcagctgcccagtcctgaggcccggcaccccagctccggcccctcccaaatctgctattgtaagcactacacaaaactttaaagaatgtgtgttagacaactgtcactcagcatatttgatggtgttttgccttggtttgaatatgtaaaggcactaagctgtttaattcggtgcttcctgcatcgttgggcagtgtaactcagttgggtatcagggctggtggcagcagcagggcaggccgcggcagctcagctaatttaagctttgtttgctgcgatgctggaacttctgcctggctctccgcattcttcccccaggctggcagacggctctgcccactcccgcccgcctgcgacacctgtcctgctgctccccttgacagctacctggcccctgacaggcagcagtacccgctgtcacgctgcctgcatgtcccagaaatgttatctcctctttttcggagatgtcacccacaaccgtccgaagagatacccaaattgtacgccactgctcagatggtttatctgaccccgcagctggcacggagatgctgggagaagggtctgatatttcccgcatctgccgttaaccctcgccaggccagcagtagcccaccccacttcttgttctcatggtccccaggacccccaagcaaggcggacgggatgacaggccctctaaccccaccgcccactcacctgcagcctgtcaacagccagctccgggactctcccagggccccatgggctgtttagccagagcttggggcccacccaccccagctggtccttgaatctggatttggttgggggctgtgaggcccatcacagaggtgctttctgggtacactgcttcccacattctagagacgactctcaacagccagcccctgctgggacttttgtggcctttggacgcccaccagcccctccccagccccaagctattgtgtccagtgtccagggtccctggtcatcgggctgtagcccccaggcatcggggcagccccatgccccctgctcctttctgtcctggacttttcctcacacatgggggcaagcggccacagagacaggacactaagtacctgccagagtcttccgcgcagctgctagaagcgaacctgcttttggactggcccaactccttacggagaggcagggatgggggtgggtctgtggaaccagccgcacctcaagaagcctggtttggggagatggtcaggactgagacctgcagcacagcaggacctgggaggtcagcgaggctcggtgggacctgctagcagctcccgtgccttctgttcccactcgggccccactagagcctgctgtccaggcccaaggctggcctcctcatgtggagtgggcccagctgtagcaagttttgtcttcagccttccacatcagggtgttagcaacccttggcttggggtggctctgatggccaccttgagactggatggcagccagtgcgtttgctcacggccttgtgatctgagtggtatcagtgcttctgcaaagaacacagcattctgggaccacacatctttttatgcccattggggaaactgagtcctggagagatacagcgacttgttgaatgctatatggctctgcaaagtagaggctcctgcatttacccagcaaatattattgtgtgccctgcaaacaaagcagaccaaatgcctgcccatggaactgcattctggagaaggagacataagaacaggagagctaagcagaacctgcagaatattccatgggggtaagcgctgcagagggagggtaaagcgaggaggggctgggtggggggtagacattcagacccaggccttgggtgtcatgactgatctagaagggtccttttggttttaggtttttagaattcaaatgaggagaatcaaatagaagttgaatcctattctccagaaacatcgttctaggtgctaggcccattggggctctccggatgttccgaccccatgtcccctcctggggtgcacccctcctggcctgtggtcctcccagaccctctatttccggctattgggtagggctggcctttgtcactccacctgccaggctggcttctaaggcaagagtctctccctgaggaggagacgccaactcagctctaatcttccccttcccggagacggcgtgctgtctggattatcgctactgatgtgatttgtaagggccgtgggagggacagcggttatagtgaaccctgaaaattaattagagagggcggcgccttcacagggcaagtggctaagaccttgcttcttcagaagctctgtaagctcccatgccgtgggaaaacgggctcctctgccctctgtttcctgggatggcccatgcaccaaaaatgagacacagcaaatatgagtcttggttgcctgtgcatgcctgcgtgtgtgtctgcaagcttgtgtgagtgtgcatgttcatgtgcgggtatgtacgtttgcaggcgtgtgtgtgtgtgtgcgtgtgacccccagacatggttgtcgtccaggaagctctgcaggccctctgccctcccagtgtccagtggagtgagggctcagggactggaaggagtagaggggtcctgggaggcacgtgaagcagaggaggacaagcaaaaggctgtgaggattagaaggagatggagactgaggcagaaaaaaggagagttgagagggatgagaacaaagagacaatgaacaaaaacagtggggtggaaaaaaatagtcaaggagaaggagggtgggggacagagaaatggagaaggagagagagaagcaaaggaagcaaggtgggagagtatgagagggatgaggaagacagggtgacaaccacgagatcaaggtggatggggggtgggagcagaagggcaaggcccctcagggaggtgagggacccaaagcagaggggctgtgggtgccagggggctccctggggagactcctgccagtcacctgtgctacctggatatacccctcacacccccaccctccacttgccagccgatcactggggcagaaggtgggatctccatctgtccctcctcattccccggagaagcacccagagagatgtagctgccataaagggctggagaagtgggcgctgcctttggggcccacgggcctatggggatgggagtgaggcaggctgtggggcagtggggtgagtctctgagcaggggcagaaggctggtgagggcccaggggagcctactgggacagctgacccaggcttctaggccccagggacaacccaggtccctgaccacgtggtagagtgaagaggccaggaacagagggcttggctgagtgtccacatcaggggctgggctttccgcagagagcctggctctaggctgtccggaacagcaggacggggctggcagagcttgggaccctcgaactccattgggcctacctgactgagaccccaggagagccaggtcctgctcctttggggaggctgcctgggggcctcagccatactgtggggctccttggggaaaggaattcctgggtattttctgggggctgttttatgttgtttgttttgtcctcgtgtcttagtctactcaggctgccatgacaaaataccatagaccgggtggcttaaacagtagacatttacactctcacagttctggaagctggagggccaagatcaggatgctagcgtggttgggggctggtgaggactcccttcctggcttgcagacagccgccttctcgctgtgtcctcacatagtagggagagagagagagagagagagagaatcttactcttcttagaagtcttccaatcctattggattaggaccctggccccatggcttcattgaaccttaattaccttctaaagctgtatctctgattacggtcacactggggctttgagcttcaacatatggatgtggcaggatacaattcagccatagcaccttgaaatcactttggaaaaaaagatggaggttttcctggatcctgcctgtgctctctagagactggagacaagggatctggtgcgagccgggctgggcccctgggtgacccccaggcactcactgtccctctctagacctttctttccatttataaatggcaaagagccatcgaccctgtctctggaggatgttgggagagatgattaaggttatttttaagtatggaaagcagcctttggagataggcctagtgtaaataaggctggttttgttactcgtaataaacatttattaagcacccaccgagttgcaggcaggcactgcacagaataccaaagagaacccagcccagcccctcaaacttcccaccagcccctgcctcgcttcctttcttccctccctcccgtggttgttgatgagcagagagaacctggcctaagcaggcaggcagccccagctccaagaaaatcacatgaccatggctttgcagatctcaaaaccgatgtgacacccagacctcagcctggctgggccacagagccctccacaggcacccagaggcctgagtccctctgggctgtgtcacacttagaaggctctctcagcctcatccctgcacatcaggagggaagacaacgagatgtccagtctttcccttctatgcccagtgggcttcatcgtgcggggagggcaatgagaccagcccaagccccagattggcactaggagcatttcacatgctgccagactcccgagcaccccctctgtgcccacacggacacagtcttcatgggccagtcttcatggaccttgcctgctagtaggaaggagctaaaacaagtgagcgtagcagatccatgaaaatggggacttttgtgtgtcccaccctgggtcagggtctgggatggaggaggctcagagcagacagctgttagggaaataagtgaggccagctgagtgaccttggggacggggacctcaagtgtggataataactccagagcaggggtccgttcccggaatgtggttctggaaggcactctgaggaggcagcttggctggcaacctggcagagtagaaggggcccatggtggcagcggaggaaggccactcaccatggaagcatggagggcaggccctgaggtctgaaccacaggcgaagtgtggtgatgaggaccagggcaggcaggactgctcacagggaccctgaaggacaggggagggccagctgcaggagagcctccacactcgacatgcaattgcagacatacacctgaatggcaggcagaagcagaggtaagggacaagtctgagtatttgaaagctctcagccaagctgtagcagtgggacagggaaatggtggcgtcaacacaggtggtggccgatgacagggaaagcagtggatggatgggagacgtgctttggagacaggccaataggcccaacccctgtgccagcccagcttcctggtgggttgtttgcactggtgggtcccaccttggtcctggattatccacatgtgaatcacccaaggaccttatgaaaatgcacatcctcaggcctgggccacagagagcctatagtggctgtggaatatgtattttcacaagatgctggggtgattcagatgggcagtcagtctatggacttcaagtctgtgccatgtattttatcctgggctcaatcaccacccattgaaaggtgaagagagaaaactccggtcccaaacaaactgagatcacagctgggctctgccactgttaaccatttgtcctcaggtatataacctaaactttcattgcctgtttccacatagtaaagtgaggataatactatcacctacctaactgggttgttgccagaattaagtgagttaataaatagcatgctcatagaatattgcctgacagatataaggtgatcaataaatgtttaccattaccaccgtcatcactaccaccaccatctccatcatcatcatcatcaccaccaccatctccattatcatcatcatgatcactatcaccatcatcatccttatcatcaccatcactaccaccatccatcatcaacatcaccatcatcatcaccacatcaccatcaccaccaccatccatcatcaacatcaccgtcgtcatcatcaccaaatcaccatcatcatcatcatcatcaccacatcaccatcaccaccaccatccctcatcaggatcaccagcatcatcaccacatcaccatcatcgacatcactgtcatcaccacatcaccatcaccaccaccatccatcatcaacatcaccatcatcatcaccacatcaccatcaacatcatcaccacatcaccatcaccaccaacaaccatcatcaacatcaccatcatcatcaccacatcaccatcaccaccaacaaccatcatcagcatcaccatcatcatcaccacatcaccatcaccaccgacaaccatcatcaacatcaccatcatcatcaccacatcaccatcatcatcaccatcacatcaccatcaccaccaccatccatcaacatcgccatcatcattgtcaccaaatcaccatcaaaatcatcaccacatcaccatcaccaccaccatccaacatcaacatcaccatcctcatcaccacatcaccatcatcatcaccatcacatcaccatcaccaccaccatccatcatcaacatcaccatcatcgtcatcaccaaatcaccatcatcatcatcaccacatcatcatcatcaacatcaccatcatcaccgcatcaccatcaccaccaccatccatcatcaacatcaccatcatcatcatctcactaccaccatcaccatctccattatcatcatcaccaccactatcactatctccatcatcatgatccctatcaccatcatcatattattaccattaccatcatcaccaccatcattctccatcatcatcattaccaccaccatcatcaacatcaccatcatcatcagtgtcatcatcaccaccatcaccatctccatcatcatcaccacgatcatcaccatctccactatcatcatcgtggtcactatcaccatcatcatccttatcatcaccattaccaccatcatccatcatcatcaccatcatcatcatcatcaccaaatcaccatcatcatcatcacatcaccatcaccaccaccaaccatcatcaacatcaccatcatcatcaccacatcaccatcatcatcatcatcactaccaccatcaccaccaccaaccatcatcaacatcaccatcatcaccacatcaccatcatcatcatcatcactaccaccatcaccatctccattatcatcaccaccactatcagtatctccatcatcatcatgatcactatcaccatcatcatatgattaccattaccttcatcattctccaacatcatcatcaccaccaccacatcaacatcaccatcttcatcatcacatcaccatcatcatcagtgtcatcaccaccatcaccatcttcatcatcatcatcatgatcactatcaccatcatcatattattactattaccatcactaccatcattctccaacatcaccatcatcatcaccaccattgtcatcaacataaccatcagcagcagcatcaccatcatcatcaccaccatcatcatcatcactaccaccatcaccatcatcaccgccaccatcaccaatcaccatcattattattactgtaccacccaggtgcagacagtgtgtcctggatcccagcccctgcagcctccatcctagctgccatcgtcaggtccccttagtcaggaaacacccaggaagtgagttttcccataagctaactgccctgcctaatcctttggactcttagtggaaaaggttctaaaatcatgtgtccatttccctgccttattaaagactgtatcaatttaaaatggcttttgctttgatcattaggggtcctgggaggccttggggccgtcttgcttaattctaccgagaccttgggtgggagatcagggatcccttgctgggcactggggggatccaaaactccctgcaggactggttgcccctcacgccacctccttcctgtgatccaatcctgaaattcatccaggagagttcttttccctggcttctgcttttgatccctgaggagatgcaacccttcctttaaaagttcctacattccactgtaggtcaattacactgtaacctgaattggggccctttcagagagggccggagaacttattgcttaagctggaagggtggagggaggaagcacggggaggaggaagccaggggcaaacccggaccagcccgtgcatgtgccaagggctggcccaggatgtcggcagtcaccagcaggagtttggctgcacatgggccccagccagagacctggaggctgttctgctatcaacttttaattaaggaaagtcctctagtgccattgaactttgtcctgaaagtggaaggcaggggtgccttgctggttggttcatccagtttgttctctgagcctggcactgccctgttcaccaaggccaaggtcctgtcagcctcctgctgtgtcagcacagaccctgcctgggacccctgcttccccaggtgggtttgaagggcctcacctctgctctccatcaccccccaccgcagagggaaaatcagtgttatcatgcgaggatggggatagggtacggagactggagagagcctgggagtcagaatccaagcctggcctcccccatgaaccagctgggtgatgtcaggaggctccttaaccactctgagcctcagttgcctcaagatgggcagcctttctgtgtcgccggaggttgtgaggattaaaggtggtgtatctgtaaggtgtaaggtgtccctcccagagccaggcctgtgcatgctctgcaacaatctgtgcccaactgccttcaccttcatggaaaacaaagtgtcttagtccattgggctgctatagcaaaatgacataaactaggcagctttcaaaccaaactttatttcccacagttatggaagcagcgagtccaagatcaaggtcccagtagacttagtgtctgctgagggctttctggttcatggataaccatcttctcactgcgtcctcacagggtggaaggggcaagggatatctctcaggccttttttctaaggccattaatccagtttatgaggattctttttctttacactttttatggtttattttaggttcggggtacctgtgcaggtttgttatgttggtaaacttgtgtcacaggggtttggcctacagattatttcatcactcaggtactaaacatagtacccaataactatttttttctgatcctttccctcctcccaccttctgccttcaggtaggccccaatgtctgttgttcccctctttgtgcccatgtgttcttgttattttagctcccaattataagtgagaacatgcagtagttggttttctgttcctgtgttagtctgcttaggaaatggcctccagctctatccatgttgctgcaaaggacatgatcttgctctttttttatggctgcatagtattccacggtgcatatgtatcacattttctttatccagtctatagttagtggacatttagattgattctatgtctttgctattgtgaatagtgctgcagtgaacatatgcatgcgtgtgtctttatggtggaacaatttatattcctttgggtatatatccagtaatgagattgctaggtcgaatgggagttctgttattagttctttgaggaatcaccatactgctctccacaatagctgaactaatttacactcccatcatcagtgtataagtgtccccttttctctgcaacctcaccagcatctgttaccttttgattttttaataataggcattctgattcctgtgagatggtatctcattgtggttttgatttgcatttctctaatgattagtgatgttgagcatttttcatatgcctattggccgcatgtatgtcttcttttgaaaagtgtttgttcatgtccttttgcctatgttttaacggggttgtttgtttttagcttgtaaatctgtttatgttccttatagattctggatattagacctttgtcagaagcatagtttgtaaatattttctccaattctgtgggttgtctgtttactctgttgacagtttcctttgctgcgcagaagctctttagtttaattagatcccatttgtcaattttggcttttgttgcacttgtttttggtgtcttcatcatgaaagttttgccagttcctatatccagaatggtattttctagcttatcttccagggtttttatggttttaggtcttacatttaagtctttaatccatcttgagttgatttttttatatgatataaggaaggagtccagtttcagtcttctatatatggctaaccagttgtcccagcaccatttattgaataaagagttctttccccattgcttgtttttgtcagcttcgtcagagattagatggttgtaggtgtgaggcattcccattcatgtgagctccatccccgtgactcaatcatctcccaaacccccacctcctaataccatcacctgggggtttaggatttcaacataggaatttgggggaagacacacatgttcagaccagagcagaaaggaagcttgctaaagacagaagggaaatggaagacgaagataaaaggctgccagggctggccaagggcccagtctgataagaaaccgcacctgtgatccagctatctgtatggacagccacccccttgcccatccctctcagccccagcccagccccagctcttccagaaacaggcagccggcgcctgaactcaccaaagccttatgcctggcctgtgttctaccaggaagcaatgtcttattttaagccatatttgtttttctggttcagaagggtttactcctggacaagactcaagttcttgcactgggcaaacctaatggagtggcatgcaggaacagggttagcatgctaaggatcgatggaaactggggaaagaaaaacctggcaaagcaccctacttaaccctcagagtgccagggccctgctccccagaaccccttgcacctttgcagctgggcacaccatggagtttacacagattgacaaaccctcttgggcagtgggactatggttcccattttagggtcaaagaaactgaggctttggagagtgaactgctggtcagcctgaggtttgcctgtgctcagcggggccacagctgcttccgtgccatccagataatggtgtttctatgaagggaacagtggtccctggctgccctaataaattaccactgaccgggtggcttaaaacagcagacatttatgctctcacggtgcaggagtccagagatgtccaaaaccacagcgccagcagggccagttccttccaggagagcctatgcccggcctccccgcctccgctggctcctggcaagcattggtaccccttggcttgcagctatgtcactctgatctcggcctgtgtctttgcagggccttctccctgggtgcctctagtgtgtctctccagctattgcatctaggaccactctaccgcagcatgacatcatcgttttttgggtttttttgggtttgttcttgttgttttgagacagagtctcgctctgttgcccgggctggagtgcagtggcgccatcttggctcagtacaagctctgtctcctgggttcaagcgattctcctgcctcagcctcccgtgtagctgggattacaggcgtgcaccaccatgcccggctaatttttgtatttttagtagagatggggtttcaccctgttggccatgctgttctcaaactcctgacctcaggtgatccatctgcctcagcctcccaaggtgtgaagattacaggcatgcatgacctcatcttaacaaattacttccataaaggctcaatttacctgagccaggagagggctctcagggcttccctgcaggtgtccacccgacaggcggcagcatgtgggccgtgcagggagtaacaggagaaagacacaacaccatgtgccgagctctgagccaagggctgggagctgggagctgcgagctggtcctgtgcacctgccaaacagaccttccaagcagacactgccaggcgttatacatgactgtggaaatggggcggtgcctgaacccacccaggaaggaagggcagcccactccccttgcccccatcagggagccctggcaagtgagctgtggtgttggggaacacgtggcacctcgtttgcacagcccaggatgtgcagggatgctccctggccagctgagtggaaaaataaattacctgaggggctgactcaggccggtcattttgccagtgaagctctgctaacgctcactgggcacgggccacgatcaatatgcctctatttttaactccaggatcagcagggtcattttccagagaacacgggctgtttatttagcttcctctcgacgcgatgcagagaggtccgcctggccagctctgtcccgtgccaagccaaccggctaacctcagccgtctgtgccttcctggggacagtctttagactttcaggggtcaggtagagagaggccaggtgtcaggctggctgagatggaagaaaagttccaggcttcccacctccagccaacttggcttccacctgccagtttcattttgcaggccccagacccacaagctcttggcttactgagaggtccgtgccccaaccccagcccagtcccagagctccaccagggaaggacggacatgtcgaccagcaatagtgctaagcctagtggcagccgcatgttgagctctgggctgctgcttcatgcacattccctgcctctgacgcagcaggattctgcttctgtctgtgcctctgtggtctcatctgtagaatgggctaatattgttgccttggatagtggtgaggatcacatgaaataactcatgttgggtgctcagctctgtttctggccaatgataagtactcaatagatgtcagctgatgcctttgtggttattctttgctgaatgccacaacacctcaagctgagagtcaagcccaagggactcagtagcctgagctgtgcctctgcactgaattcctctaccccacactgccccgactctgtctctctggatagaggcctccttgttttttagtgcatcaaaatcactcccaccaaacagagaggcagggaggtgggtcagacgtcctcccagaacacaggccccatatcaagctaagttcctcctgtttcttaggggcagaatccagtttacagaacatggaaccagagtttgcagatggcctgtcatgtgtacagccctgaggcaggagaaaggaaatgagatctaagcctgcctctgcctcaaatgcccatgtgactttgggctagtcacctccctgcccagggcctcagtttctgccccagcaaaaccatggccaaaagggttcatcactttaaataacatgtatcaaggaggagtctgagttctggctcagagggaaagagtgcagtgattgattagtaatgtctggcccaggtgtaggcagggaaagatgaggcacacttgttacttacttgtcatagagctaagtggtaacaccttattggatgagaccctggggaagaggaaagctgagggaaatccactcggagaaggaatttgcactgccaggcaaggccattctcagtgatttctgagggccctccagttcctgcttccctggagacgtcagggagggaggtggcagaggggcgatcaaggaaatggagcaaggaggcgggcctgactgcaggaggctcagcactggggctcagttttgttttgttttgttttgtttttgagacagagtcttgctctgtcacccaggctggagtgcaatggtgcaatctcggctcactgcaacctccacctcccaggttcaagcaattctcctgcctcagcctcccaagtagctgggattacaggtgcccaccaccacgcctggctaattttttgtatttttagtagagacggggttcctccatgttggccaggctggtctccaactcctgacctcaggtgatccatccgcctcggccacccaaagtgctgggattacaggcgtgaaccaccgtgccaggccaattaagggccttcctgttacagaccaaatgtttgtgttgtctccccaaaattcatacattaaaatcctagcccccacagtgatggtattaggaagtggggatttggagcgttgtttaggttatgagtgaatacaattagtgcccttataaaaccttataaaagaggcccaagagagacacctcagaccttccaccgtgtgaggacgcaagcaagaaggcactgtctaggaaccaggaaggggcctcaccagacactgaattgatggtgccttgatcttggactttccagcctccagaactggaaatccatttctgttctttataaaccacccagactatgatattctgctatcacagcccaaatggactaagacatgtgaggtgcagaatggattgagatgccacacggtggagagtgatgggagcgggtgctgcagctgaggggagcagtactagggagccagcaaccatccttgagagagtgcatggccccaggaaggtcggattgtaggaaagattgcctggcaggggtgtgcaggatccaccagagcagagaggtaggaggacgggggattggccatcacagatacagggaatttgttaatgaagatctgtcttatggctctgaaagtggagaaaggggctgaatgcatggggtgccaagaataggtactcaatagatgccagctaatgcctttgtggttattctttgctgaacgccacaactcctcaagccgagagtcaaacccaagggactcagtagcctgggctgtgcctctgcactggggagatgggactgattggtgtgagggatcaacaagccagcatcgtcctcccccggaggcccagtgtgcttggctgtgagatcagaggcctggaggagacgttcctcagatccctgtcacctctgtttggctaggactgtggcctccctatgtgctccagaaactcatctggtgtgtagaacgaggtgtgccatcactgaaaagggcccccccttgtgcttattttttgcagattaacaaactttaaggagtagccccaacctctcccagcccctcaggagggaagcaaggccacctgtgtcagcactccttctcaccgtcacagaccatggctccctctaacggttgcctgtgactggtcgggaatttcacaggctctgaccattctcactcaccagccggcctggaaggaagtcccatctagacacgtgcccagggactttgttttggagatgcccctacaaccctttttttttttaagcattgaatttccttcctaactgcaaacgctcccggtggtgtaaaatgggttgatgttcttcacactcacaccgtcctgcatgtctttacagtggtctcataaggttttatttaaagcaatggtcagccaattttttcttaaatggtcagatagtatattctgctttgtggtctctgttgaaactacccaacactgccattgtagcagaaaagccaccagaggcaatatatcgatgaatgcactggctgtgttccaataaaactttatttacaaaaatagatggcgggccagatttgggcctatggactatagtttgccaacccctggcctagatcatcattttcaaaactatagttgaaggtcaccgttatttgctgccccacaaaaacaggattctgccgtcagatgagttcagggaacactgggtacaacaaaggttgatgggttttcccagactgtttaatatgttaatctcacattgtgagtccccatgatgggagttactgtgcacatgttcctaacgcatttgactgtgagccctgatttccgagaggacctgggaacttttttttctccctacacacccctgttcatgtctctcttgaaacacagtttaggaaagttcactaaaagaatctaggtggtcacacccaggtgccctctgtggatcctgttggaggggaggacaggggccgtggcctgctccagggtcatgcacatcaacaatccagtggcttctccacaaagagaaagccgaggccctgggtcctccagggagccgggagcaccaaggacaaagccacgtgtccctccccgccaggctctcacagcagcttgctcgggaagaccccttgttcccagggcaagggccaagcggtgtggaggctgggtcccacagatgccactggggaagggctggctcacctgccctccgcccctaccgacagggtcgccggaaaggacacgtgcatccaagcggctcccatatccgtggcaatggatggccgtgccctgtggatatggagctgtcttagtctgttttgtgctgctctaacagaaaaccgcaggctgggtaacttacaatgagcagaaatgtatgaatcccactgatctagagggtgggaagtccaagatggacagatggccccatctgtgagggcttcttgcttcatcatcccatggaaggaggcactacgtggcaagagagagagcaagaggcccactctctcaatagtggcacgaatgcgtgtatgggggcacagcccttgtgacccagtcacttcctattaagtcccccaaaactgttgcattgggaattaaatttctaacacatgagctttaggggacacattcaacccacagctgtggcaaaggcattcataccatccccgtgggaggctctcccaccactacccctgctccagggagcacagcctccccgctttactgagtgcagaagcctcaggcttatggagggattgacaggtggaaaggtctgtcctctacatcaagaggccacattgagacctggggcaacagacgggcagtggctgaggccacatggagagggacgtgcctgggggagattgggcactttctggtggcaccaaggctgcccctccaccctcacagtcctcctagccctcatgcccaagcctttggacactttgaccattgcatggttgccgtccctggcctggcctggagaagtcttgccagcctggcgaggcttccaagcagatctgtgccacagcaacaaccgtcacgatggtggcatggatggagggccctgggcatggcagcgtgggcttggggaacctcatgacagccctcaggtgctgttattacctgccgttgtgtagacaggaaaagctcagagagttcaggaatgtcccaaggtctcggcacctggaggtggcaagccaagaggtccatttggttttgctctaaggtccactttcttttcttttcttttctttttttttttttttttttttttttgagatagagtctcactctgtcacccagactgaagtgcagtggcacaatctcggctcactgcaacctccgcctcacaggttcaagtgattccctcacctcaacctcctgagtagctggcactacaggcgcccaccaccatgcccggctaatttttgtattttcagtagagacggggtttcaccatgttggtcaggctggtctcgaactcctgacctcaagcaatccaccagcctcggcttccccaagtgctgggattagaagcgtgagccaccgcgcccagccttaaagtccactttcttaagtttctggacagaactctagaaaaatatgtccttctcctgcgtcactgggacagttctgagatctgggtcgtggcacccaagtgacattcactgtgagaagtgggggctccataaacttggggcagctcagctgaatccaccctctctccggtcaactcacaactcacacatgcattctggcctctggcctgtgccaggcacacagctaggagctgggccttgcggaccacagggagcatccctgcccacagcgggctcacagtccgagaggacactggtatgtgaactgaggcagcgggaagagctcctggccaaggtctttgtgttcagaccagaagaggaaggagggctccctccccctggggctgtggaggctgaggctcctggggggttgtccacatctggaccgtgggagctgttggggggaatgggggcaggtggagaagaggaggagctttctggaaggaagccctgtgaatgaggggaacccagggaggaaggggctcagatgaagcaggtctgggggagaggaaggaagacaggtgagggggctgatgggagccatgatgaggtcccaggggtagtgtgccccactttgggcatggaagacatcatggagacctcagagacacacagccctcttcccatgagccaggtggcagacaggacacccgcacatggaggaaccactaacaagtgccaagccctcccacgtttggggacagccgtgtcagagactgataatactgctcattctcggtggcaccaaaggtccctgggcacctggccccgaggctggctgtgcccagcactgtgcaaaatccctcctgtgctggtcttcctggatgggctgccggtcggagggaacttggcatttgactctggctttggagggtttggttatctcctccccaaccaagatctcctccaacccgtgcccatcacaagcccatccttagagggttcagagtcatatggtgtgaaacaccctgtcctgactgtgtgacctcgagaaggtcacatgacctcgctgggcctcagtttcctcatctgtaaatgggataataatagaaaataccctaaaaggttgttgagaaaatggaacgactgcagagcttagtaaagtgccaccacacatacgtggtttttgataactcggtgccaggggcactggggagccatgggaagcgtcagatcagaaaagcagggcctgagggcccccgcccctcctcccacatctgctgggcaccgtgttgcgagaggacaagtttgaggggtatctcttggaatcatcccctttccctggcaccaaccagctgcagccccaagataggaagtttggttgtcattccaatatggctggaaccccagaaactttttcctggcaatcatggctgcctccgaagggcctgcagcaacgttctctgaattgctaagcaacagtgtccgttctctcacatggagaaaattgaaacattgattcatctatttgttttgcaactagcactagcggcttcattactctgttccctggggacaccctcccacacactcgaattgaaaattaactctttttacctaggaacagccacaatgggtttttaatttggagaaagtacagaaacaatggtggggctgggtgccagaaatcaggaggcaaagctgacctgtgacccaggggccctagacaagagcaccctccctccactgggccgtggacaagctctttggaggtgggaccggccaagagtgggccttgcggtccttgaggccattaggggcaagtgttcacacctgccacgtgtggcctaggtttctgctcctcaccggagcttttgcggttctggcactgggaggctgctagcatcctcttgctgggaattttctggaatggaaggagcactgtttctggagttcaaacagctcagttctagtttctaactctgtactgaggggctttgagctcctcctttaagccatgtctcagtctcctcatcagtcaccagagggcaggaatgtgtctgtgttccttgcatggctgttgtagggtttacacaaagctgcacagcccacaaggatggtgtgatgatattcgtgtgccggcgaagctctctccgtcttcttgtctctctgctcttgttggctttctggggatacgttcccctggaggacagaaggcagcatttgttgcttccgtaactttcacatcacgcgtaggccagcagcaggaggagctggctctgatccctgagctggagtctgtgctccaggaggctgtccccagcaacggcagggtcctctttagctaggaaacagcaacagccataaatgatagcccacgtggcggttgctcagagaaaggagctctctcctgtcagtttgcagagagctctctgtccttctgataatgcaatgcgttactgacctgatttcctaaatcctctccttcccccactcctgagggcctcagtgccctgattcacccaccccctaccctgcatccttgggtgtgtccatgaacgagtctccagcaggaagatctgcctgggctctggattctctggggttgggttcagctgtgagtggcagaaaatctaagccaacagaggctcaatggataaaggttctcttttctctgtaaacagacacagtcaagggctagtgtggtgactgcacaatttccaagggacccaggctccttctagcttgttgctgtaacatccactccagcagcttctggtccagtgtggctgctctaactccagccatcgtgtcttcatcccagccactacaaaggagagaggcacagcccctccttttaagaacacttcctggaactcacacatactactttcgctcacaaaccactggccaagcagagtcacatggctagctgcagagggagctgggaagtgtcacacagctgtccaggcagctgtgcacccaggagactggggactgaggaaccagaaggaaatgggccctgggcacaatagcagcctctcggtgggtttcatggctgtaacccagaccttaccctggcccgtcctctctcagcacagtatcacctgtctgtctgcccctagctgctgggtgtaaaagagccctcttctccaagtgtggtctccttggcctggagtgcacacgctccagaaccttccagtggccatcagctaagaaggaccagaaggtgaggctgaggactgggcacatcccagtggtgaggcagcgccctgtctttatcagcagggagcagggggcgttagcagggggcctaaaggggatcccttccccaacctgcccatcatcctggggaagagaagactcagttccacattgcatgggggtgtgtggaaggagggaggagccaagcagaggcccaggtgtgtggaaggggtgcagagactgaaccaggcctgtcctgggaagccgagaagatcagccccctacacgatgggaagtaaggcagcctgaggatgccggacacactgtgggctgcagggtactctgagctctaggaagcagagctggggccagcaggtgggggctgcaggattttggctcaatgaaaggaaggtgtgactaactgctggggctgtcctctggtggaccgggctgcaccagaagagagctagatgtgagcaggcagaggctggccctgcatggaacgaggtgtggggtaggacccagcagtcttcccctgtgtggaacctgctctgagcatttctgccaggacaaaagccacatcccagagcttatccctgacactctctgccgcctctggggggcagtgaccagactctgagggtcgtctggaggctctgtcccgtcccaagtccactctgatccacaaggtctgccctggtgcccagacctgcacaggtgcacaggaagacacaggggggttcaactccacacggtgagtgggtgtccagccacttagaaggtgccgtctcccgggaggtagacccagatcactgtcctcaccctagggatcaatagtctgaggttggccacgtgagagtggcatcagatctgggctctgggaagctcccctgggaccctgagctctgacgggtgctcttgcatccccaaagatgagctgggatggagaatggggcgtccatggcattctgctcagagagggggtgtcacggacattctgataaacccttagggtggggactctgctagaggaatcatataacactttctttctttgtgccacaattctgtattgttaaagaaaaactttattcatgatgcttgttaaagatgataaggcagacgttattccaggggcgccatgactgtaggttcagggaccaccatggggtcttacagtaggggagagagatcaggctgaactctgactccagcaaggagaagtggggatttatcagcaaggagcagggggcatcaggggacggaagctgactgagaggatggccaagggtcgggggcttccggctgaactgtctcgctcggattaggcctgcaggcaggccaggaggagatgatgtggagggtggtcagatactaaggtgggggtttctgctaagctgacggcaggattgtggctcacactggattctcccacgacagagagggaagcccgagtttgggccgagtcaagcagaggactcagtagaccctaactaaagttttagtcaaaggaaggaatctttgtcagaattaagtacccgctctggggtagacaccactggatgctgggtatgcagcagagaacagaagaacaggggttctgcccccatggggtttatatttcatgtaagcagataaataactggagagaggtgcacagcccctcatctgaaacccctaaggccaggtgtacttagctagaccagaggtcctcacatggggcaatctggcagtgtctggagatgctatcggttgtcacagctgagggtggggctgctagtggcatctggtgggtggaggccggggacactgtaaacatcctgcaatgcaccggacagcccccacggtggagttatccggcctacgacgccagtactcgtgccgaggcttagaaacgtggcttgagacttcagactttgcattttagaaacagaatatggtacatagaccatatattatgtaatgtccccggcgggatgtggagtagcaccccataatcagatgcattaatatttctgcagcaaaatttatgaatattcacacaaagagggatgaactgagactataagtagcctcacatcagttcaggtcacgttttgccaccaaatgagttatgaacaagctgtggcttttagagctttatggattttggaattggattgtgggcctgtaatataatttaagatagtgataaatgcagtaacgacagccaggcagagtaaaggaaggggtacgggagggttgcggatagagtagccaagaagaggcctctgcggaggggcacctggcagagccctgagagcggtgggatgggctgggagcagatctagggaatggcagtcctaacagagggaagagtatgtgcaaaggccctggggtggacataagcttgaagtctctgaaaaacagccaggagcccagcctactccagtgggttcccataggagtgacgaggctacagaggtgaccaggaccagatgggtccagcccatgggcattgtaaggacttggggtttcaccgtgagtgtggaggggagccagtgaaagaacgtgaacatgggatcacgctggctactggtgcagagggcaagggcaggaggctgcaggaggacaatgggccatgggaggacaagaataggtagcctcaaggggcaggaggggaatggccaggatgcggggtgcccagttcatacatcctagaggggggctctcttgtggacagacaggccagagacacggctcatctgtccctcatccacctccagcttcctgctgcggggccttagtagactcagcccccacctcccctgcctcccacctcccctctcgatgcggctttcattatgtaaacctgtctggttcccagctgggctgagccttcctctctgtgtcccccaggaccctgggtccagctcctcacatgcactcacagggcagggacaagtttgcggtagaaatccccaagattgtgggaaaaggctggggtagccagggcagttcccaaacagacaaggtggtgagaacaagctggaatgagaaccagaggagcctggaggaggaggaaggcgcccactcccagccaggctccactcccagccaggcacctggctgcatccatccctcagggccccgggcaccctccagtgtgggcggcccctccctgcagctgcatctcagggcccagcggtggggatccgcacttgagtttaagcctcgagggctggctgtggacgcactctgaagacgaaagtccagaaattagggaaatgtccttggctcaaatgtcggagtcctccccgttatcgcagaaggcgccttatctgcgctccccagaggcccgagataaagcccatgctgcaagccaagggcactcttcagcctccagcctggagttctaaaccctgcagccacaccgaacctcctggcagcttccaaacaatactgacacctaggcgtgacttgggcgcccaggccaggctgtgaagccctgctccagggcccaggcctaactggcaccaccccgtccccatgggcctgcagcctccctcctgccccagcactcctctgccctcagctcaccagctgggcaacaatacctggaaagggtagaagcatacccccgcctgggcacaccagccgacacggtctcctcctggtcccactgggtcctcaccacatcagggatcaggggtgggggactgtcgacagccctgagatgtgaccaggaagataggaggggctcagaggggccccatgctgtgcaggggtcatgtggctcccacggtggctgcggtggaactgaggtgccccttgctgtggggcgggcagagaagcacaatagcagtgtggatggggacgtccccaccttgtggctaggggaggggttgtgccactcaagaggggttggtggactcaaagtagcccagatacaccagggcaggggtctgtgatgtccccaaccacccccgcccccatgaccacctgcacccaccaccagctcccccagaaggggaggggtttcaatgcctagaattgttcctattccccagtcattctatctgtctgtctgcacgccttcccttccccactcccatcccagaccaggtgagagggaagaggcctctgtggcaggaggtggggggcccacacagccgccacgaagaattcatagcctattggagttgagcccatccacccgccgcccctgcaggcggccctgctgtgcctggcagagccctggccagacagatacccccaccctagacccccaccctttccccacttctggaaagggtgaatctttccttcctaaagggctttgctcacagatccatctaaacccaattaccgggagtgtggggcctgcgtctgcggtgagtcggcagcacgccctccactctaaccgcccgtgatttcagcgctgaatatctttcagagttatttaagaggttcttcccttttttcccattttgatgatatgtttctaaattatacattaaacttatcagggtgagtaatacctcgcagcttccccatgtcaggcctaatgttacttactcgtctgctgccttgtgtttacatggttgagggggatatgctcctttcagatccatttatcttcatctgaagtgtttagagatgagaacctcagatgggttgcagacacctgggctcccccgagcgcccagcttctgcaggaacctctcctcctgcaaccagggtctgcagtgtcatgtctcaggctggcaggaacctggaggcaccccttccccatgggagggtcatggggaacagagaagcccccagagagagcagacctgagaggtcaggctcagagatgaaatggcttttcctggaaggaaacgtaaagcaccgggtacctccccagaacccgcctccctcggcccagatggcagctgtagcttctgggagaacaggtccttgatcccctatcggtgcctggccctggccattcattcctcgttcaagtgcgtgtggcagcctccaccgtgcaggtgggcactgggctggcctggcagtggcccagggtgctgttctgggtcactggggctatgggactagaccccagggctgggatcccacagaaagtcacaggccctgcccattggcaaggtctctctctgcctctcagccaggaaaatccctaccccaggacaagctcctgtggccagacaacccccgccccagttctcactgcctctgacacccacgctggtgtggccctgctggggaccccgggtctgtcaggtctggtgagaggtggctctgcagtctggagccctttgctctgccacacacagtcgggatggtccgggcgggggatggccccaggggctcaggaggccctgggcttcgtaatcacactacactaacgcctctgcaagcatcgttttatcaaaaccctcaccattgccatcaccacctccatttgacagctgagctgaagagcttggtgtgcccaaggccacgaagtggagcccaggtcttgcagactccagaccttggactctcgggtcccatgcagctccaggccagggcgatctgagcagccccagccacagtggcccatgttgttccctcccttgcagggcaaccccagggccacgactgggctcctggcagcacggccagatggacctctgctctctgccagtgaggtacctgcccctggagcgggaccaacagctccaggcaggagattcacccaaagggaagtgacggggcaatttatcatatcaataaacttgcttagagtgcactctgtcttctgtaatgaaatggggatgcagtcccaccatgttattgggcaccagggcaaccccgcatcaggtgcttattattttctgccacgatcagggaagactgatcgtgcttggataagtgcagcttaaaattgaaaaccaagcaatttaccttcaatcgcttctcagaattttgcgcagccagaaaaccgactccctttccattttaactgcttccattagcattcgtttcctccgtgagaagagggcttagctgggaagggaattgtagtgccatcacatttcccccttctggagaaagacgcttgccccaggctcctctttcttgagggccgacagggtcagggtgttgtggtccctccccttcctcctggcagagccaggcctttactgggcactgggctgggcattgtgcctgtcctcaggtctaccaaggagagggtgcccaagtaggggtgggtgttgccctcttcctgggggctctacacaccccggccgctgtggcagggttccccacatgtcccctgcatttgttcaggtgttgaggagcagatgtcctcaagtcaattttcctgtgacattttcgtgtcatttccaagtgaaggaggacagcttgactgtgggatgcttggggacccaggggaggcaaatcctcttggtgagagcagtcagcgcttgtggcttgacggcttgacgcatggtgtccgtcattctgtgcaggcctgcagttctgaccagcagtggttgtctccgctggctccagatatccttccctcgacctctgtcgctcagcatctgcggggtaaatcctgcaaggtttgctccacgttctaggaaagaaattctctactctagtgatattgacagggaggctggatgaggcctctggacagacccccaaagcccttgcctcgatgttccttttatcccaggaataataagaggagggttttctcagatgcaaatcatcctccacttgtaaatttcacagttacctcccgaggcccctccatcaatgctgccaagataaactgttgtgatagcctcaaaccccggctgcccttctggctgtgtggcttcagccctggcctcctcttgtttgatcagcctccctcttgctggctgcacaaggcggggttgtgtgcagatgggattttaaagccctttgcacaccctggcttggtacgatcgcatggagcttgcccctgaaagaagaacttgagggccaggccctgagtttggatccttttcctggaagtctccgccctgaacttcaacattgcctatttgcccgtacagggtgtcccagggctagcatctccctaaggcaggggtgaggacataagcccccaacacggccctcacaatcaaggcagctctaggaggattcatgcacagctccgagtcatcaaggccctgctgctgctatgagtccctggccagggctgatcctgagcctcttacgtggaagcagtgagataaagggaaggaaaatttcaggcagatagagcagcacattccacagggtcagagcaggtgtgggccctggtgggggcagtttggatgagtactgggaccctgtactcatctacccaccacaatataaccaggccccgctggctcttcaggattaagggccagggaacctgcagtggccccttgggctggcatctctgatttgagacagtctggctttgctgcctgcaccttggagggtggttcatgagggctacagctggaggtgcccccacccactagcatacttggggtgggcggttggctgacagccagccagcattccaactccctcccctccaccagacagcgctaattttggggagaaccttagaggtgtcccaaagcacagccctggtcactttatggtcctgctttcaaaaggaccggcacctttgcccaccctcagagagactgggcagtgggtgtcagactctggcagcatcagagaagagcccagagagagaggggagtttccccagagctgacggcagggcttttccaggaggccgtctgagaatcaggatcaccagacaaaacctctctaattatttttaagtatatttttactttcacatttgctcttgtttttatcgtcatatatactgtacctacagaaaagtgcacggaacagataggactggtgattccgtgattatcaagtgtgtgaccacaacccaggaccagaaactgacactgggttctctgcggtctgccatttcccccataatgggaagagtaacctgggactagaccctcactccgaaactgaagtatttctgtgcagttcccgggcgctgcagcaaaccctaacccaccattgattcttgttccttcctggtctctgagaaaggaccgatccaaagatgacaggattcaaaagagattaatttgttattttagacctttagaaagtgcagttgcacaaaatcggaggccctgggtcataacgaagttcagatcaattaaaacaatttactttgctgctaatgatttcagaccattgtaatttattggtaagtaaatgacttcaaaagcccattcctttgtggttgcacagagggaattttaacaagttcttggataaattaagtctggaatttgttaacagactgttactgtaaaacattgaaactaggcctttgcacactgctccaaggcctcaaagtttccaggaataattaaaacttctaatcagttcttcattgtttaagcaaatcaaatggcaagaaagggcttgtgataacaagagggaaaccctcccatttggagggtcagtggccactagaatccctcccgtgactcctgttctcagggtgaaatccaagttaccactctggccagaatgcgccctgcactgtttggttcccacctgccccgcgggtctcagtttggatctctctgcccatggtccaccgtgctcaggccacgctggctcctttccttcctgcaaacaagccaagctcacagcttttccctggcagctccctctgcccgccacgcctccctagacttgtgtggctgcctggatttcacagtttgtttgtttatttatgtatttatttattattttgagatggagtttcgctcttgtcacccaggctagagtgcaatggcgggatctcagctcactgcaacctccgccttgtgggttcaagtgattctcctgcctcagcctcctaagtagctgggattacaggtgcatgccaccatacctagctaatttttatatttttagtagagatggggtttcatcatgttggccaggctggtctcgaactcctgacctcagatgatctgcccgcctcaacctcccaaagtgctaggattacaggcatgagccaccgcacccagccacttttcacagtttagatctcagctcagtggccctctttgaaggccccttccccaaccacgcccatcactgtccttgccatcactgtccttcccctttgtgctagctcaccggactggcagcagacagcatctggtcacatctctctcgccagtgcgcctcccctgcggcacattcggtaggctgggggtctgttggatcctggcaccttgcagtagtgttgcccgcttcctaacaggaacaggacagatattcatggagtgattgaattggtgatgattccaagcatgagacataggtagggtcctattggaatgggccagcaccctctgggggtcctctgatgaccagggcagggactcttagggacacagggccgtgggaaagacctgctgtcctgcaagccacctaccagtgcggaatgagtggggagtgtccaggcgttgctgcatgagttgcctctgggaggctttgggtcaggtcggaagcttgtctgtgccctgaacataggacacacagtgtcctcatggagtcaaccagcatctcctgcatcctctaccttggaaaatgaggattctccgagagctcctccccaccctcacacacctcagcctctataacagtaacaacagtaatagctatggccatgtgttaaacattagggcgggatcaggcatcatgacctcatgaaatgcaatattgcattaaacctcagcagggccgagaggcagaactgctgttccaaggaggaaactgatgctcagaggcttattaaggaatgtgtccaagtcccacagcatctagatggtgggattgggcttcaggtgcctacatcccaaaagccattatgccatcctgccatctgagcctgttaaagctccttcatgccactccactctggggcagtgatttctcatccaggcctgaaagcagccagagatggctcggtaaaggtccgggttttgccagtcaagacattccagggggagaaacagcatatcttgcacagtgaatcacctgggacaggtcctaggtctcacttatgcattcctcaagatttattggagagtgtgtgccaggcatgattctgggtcttgggcatttggagtcctggagtctctgctctcatagagttggtgacccagtgggaagaagtagatgataagcaaataaacaagaaaatgctatctagatgcgtatctagatacacataaggcctgtgggctttcctgatcaagggtcgaggaaggactctggccaggtgaggtggctcatgcctataatcctagcacttttttttttttttttttgagacagagtcccactctgtcacccaggctggagtgcagtggcgtgatcttggctcactacaacctctgcctccagggttcaagcgattctcctgcctcagcctcctgagtagctgggactacgagcatgcactatcacgcctggctaactgttgtatttttagtaaagacaggggtttcaccatgttggccaggctagtctcgaactcctgacctccagtgatccacccgccttggcctcccaaactgttgagattacaggcgtgaaccactgtacctggcccctaacactaggaggccaaggcaggtggatcacctgtggtcaggagttcgagagcagcctggccaacatggtgaaaccccgtctctactaaaaatgcaaaaattaacctggcatggtggcatgtgcctgtaatctcagctactcaggaggctgaggcaggagaattgcttgaacctgggaggtggaggttgcagtgagccaagatcgtaccactacactccagcctgggcaacagagtgagattctgttaaaacaaaaaagagaaagagagagggagggagggagggacagagagagagagagaggaaagaagaaagaaagaaagagagaaagaaagaaagaaagaaagaaggaaggaaggaaagaaggaaggagaaaggaaagaaagaaaagacaagaaaggagggaggggaaggaaggaaggaaggaaggaaggaaggaaggaaggaagaaagaaaagaaggactgtcagaggaggtggtatttgagctgcggcacagaagcagccttttaaggacctaggggaagaatgttccagacagggggaccagccggggtaaaggcaccaaggctgggaggaaggaaaaagaaaggaaacaggggcagagctggtgagcaaagggacccgcaagccctgggcacagggcagagtgtgtgggttttattcaaatcgcaggggatgccttggggcatttcaagcagggcagtgacatgatctgattgatgtgttttaaaagctccctctggctgctttgggcaacatggttgtttgcaaagtctgggctggcggcctgcagagctactggaaggccctctcagggtccagacaagagagggtggtgactgcaccagggcagagcagggtggggagaggaggacagaggtctgggacctattttgaggcaaggttgacaaatatgctgatggtttggatgtgaagttaagacgaagagaggacttcagagcaacacatggattcagagcttgaagagctgcatggaaggttcttgtcctcagaaagggaggcccagcggggaacaggcgggatgaagagctcccctcgggtcatattgcagtcgaggtgcttgtcggagatctgggtagacagatccagcaggcagtgagcactatgggttcggaattggtgaagttggaatgtgattcaggaatgaaggagtcaagggtcaggcgatgggggatcacccaataaaagaggagaggcctaagactgagctgggataccccaacatcttaggtcatgagacaggaagcggagggtgcttggatggagctgatgatggggactccataaactaagaagaggggtctttcaggataggggtcctgggtggatctctaaacaaaggggtgcggtgcgcacttcgaggcagccctggatcatcatattgatccaaaagagcgcctgtgtctcagatcaaatgtgatcagctttcagattatctgaagcaagttggcaaactcagagccaacaaagtctgcatttgagtaattttcatcgtatttttggcagctgcagagactccgaggcaaggcagagagccctttaatggagcattgagaagcagtttttaaaaataccttttagaaagctatttcagttctcccgtctgtagcaaaattaatgtataaacttagtgccttaatttggttcttctttaaacgaagaaggtgggaagctgtttcctcccgcggctctgctgaatctggaggctgattctgcttcagcaccacggagcccggacaccgccggggatgccctgcacaggccaggcacagctccagaccctggaggctgagaagccactggatcttcacaacaaccctctgaggtgacaccagtgagattgcccccattttagagatggggaaactgaggcccaggctggttaataagaagctacatggagttagccttgtttcagagatgaggaaatgcaaaaggcttgcctgaggttacagagctcaagagatctgagtgttgaggtctgactgttgtgttttcatggccctggcggaaccccccaccccacctgggcatcacagttacttgtggccactttccacaaccacacctcccaatctagccaaaaggatgacatcccaaggaacgtgcagcctcccaagcttccaggatgagattaggggcctgacacttgaccagcctcagcctctgcctcctcttggcttcctggggaccccggcttcagcaacagcaagctgggcaatttagcttcactgtccccatccgtcttgctccctctgtccttgaagatgggtggaaagtcagggaggggccgctgcaataagtgacaaggcttggctgcctgcagatgagggtgggaggaagcagagccgagtggctggtgcaagtggggcatcagtgcccaggagccagcttcaggggaagcaggaggctctctgaggtgacaaagctggggcctgtctgccccacccactgcaatccagcatgctggctgggtgacccaggcctggatagaaatggagagggcagctccatgccaggtgcagctggatcttgggaacaagggatcagctcagaagatatagtttgactcaggcttcttggccccgaatctgcccagcatttctcccacccccatgcctgctcctactcttctgtgtgtcctgtgctggccgcaggtgcccacttccctgtccaaggggccgtgaagcactccccatggccactcacagccctgtgctgtggccttccctccactcagggccatgcacaaggcctgctcccacccaggctgacaggtgcctgctcctcagatgaacgatgggtgccaggcttctcagggtcactcgctccctggactggtttgctctgacttccattttcctctgtggttgaattggccatcacccgctggggacagccaaatccgtcaagccccacggcacttgcttttattggttctcctagctttattgcctttcctggagcagtgaggggcagtgagccactgcacaatcactcaacttgacatggctttgtagatttcatccccccacccccacccatgtctctatctgcaggagagagtgacaagatgacagacatgcagtaactcctagcatgagcagaactgatgcccttgagacaggcggagccccctggcagcccaggagactgaggactggtccagggtaccagtgtctccacctgtaatccccttgtggccccaggccttggacattgttggcatcttcatcctttctattgccccttgctgacgtccaccaacctgctctccccaggcacccagcaaacacgagcccacttacccagtggacacgagcccactgagtaggcaagggtcttggacaaagctgggtgcaagtcttgaccctaccagctactagctgcacatgaccttgggcaaggtgcttgacctctttgagttttcatttcccctgcttccaaatgggagcaatgcctcctagaactggtgcgaggacaagatgagctgacgcctgtgatgttcactcagtgttttgcacagagtgaagccttgataagtagcgggagcactgcgagtttttcttcttattgactggctgattgattgttgactctggccccgaggcctccacaggaaggaaaagagagcttggccctgaacttcgcaacccctgagtattccatagggttgctgcagcagaagatgtgtttcctgggtgggaactgtattagtcagggttctccatgtaacagaactaataggatgtgtatatatatggagagagagagagagaggagcatgattgtggggctccaaattctacagagtaggtcaacgggctggagaccaggaaagaaatgatgttgtaggtcgagtctgaaagccatctgctggtggaattgcttctttcttggggacctcagtcttttttgcataagaccttcaatgattgattgaggcccactgacattatggagggtcatctgcttacccaaagtctagtgatttaaatatattttttaaatttttttaaattttactttaagtgttgggatacatgtgcagaatgtgcaggtttgttacacaggtatacatatgccgtggtggtttgctgcgactatcaacccgtcatctactttttttttttttatactttaagttttagggtacatgtgcacaatgtgcaggtttgttacatatgtatacatgtgccatgttggtgtgctgcacccattaactcttcatttaacattaggtatatctcctaatgctatccctcccccctcccccaaccccacaacaggccccggtgtgtgatgttccccttcctgtgtccatgtgttctcattgttcaattcccacctatgagtgagaacatgtggtgtttggttttttatccttgtgatagtttgctgagaataatggtttccagcttcatccgtgttcctacaaaggacacgaactcatcattttttatggctgcatagtattccatggtgtatatgtgccacattttcttaatccagtctatcatttttggacatttgggttggttccaagtctttcctattgtgaatagtgccacaataaacatatgtgtgcatgtgtctttatagcagtatgttttataatcctttgggtatatacccagtaatgggatggttgggtcaaatggtatttctagttctagatccctgaggaatcgccacactgacttctacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcttccttctctgatggccagtgatgatgagcatttttttcatgtgtcttttggctgcataaatgtcttcttttgagaagtgtctgttcatgtcctttgcccactttttgatggggttgtttgtttttttcttgtaaatttgtttcagttcattgtagattctggatattagccctttgtcagatgagtagattgcaaaaattttctcccattctgtaggttgcctgttcactctgatggtagtttctttcgctgtgcagaagctctttagtttaatgagatcccatttgtcaattttggcttttgttgccattgcttttggtgttttagacatgaagtccttgcccatgcctatgtcctgaatggtattgcctaggttttcttctagggcttttatggtttttggtctaacatttaaatctttaatccatcctgaattaatttttgtgtaaggtgtaaggaggggatccagtttcagctttctacatatggctagccagttttcccagcaccatttattaaatagggaatcctttccccatttcttgtttttgtcaggtttgtcaaaggtcagataggtgtagacatgcagcattatttctgagggctctgttctgttccattggtcgacatctctgttttggtaccagtaccatgctgttttggttactgtagccttgtagtatagtttaaagtcaggtagcgtgatgcctccagctatgttcttttggcttaggattgatttggcgatgcgggctcttttcttgttccatatgaacttcaaagtagtgttttccaattctgtgaagaaagtcattggtagcttgatggggatggcattgaatctataaattaccttggggagtatggccattttcatgatattgattcttcctacccatgagcatggaatgttcttccatttgtttgtaccctcttttatttcattgagcagtggtttgtagttctccttgaaaaggtccttcatgtcccttgtaagttggattcctaggtattttattctctttgaagcagttgtgaataggagttcattcatgatttagctctctgtttgtctgttattggtgtataagaatgcttgtgatttttgcacattgattttgtatcctgagactttgctgaagttgcctatcagcttaaggagattttgggctgagacaatggggttttctagatatacaatcatgtcatctgcaaacagggacgatttgacttcctcttttcctaattgaataccctttatttccttctcctgcctgattgccctggccagaacttccaacgctgtgttgaataggagtggtgagagagtgcatccctgtcttgtgccagttctcaaagggaatgcttccagtttttgcccattcagtatgttattggctgtgggtttgtcatagatagctcttatgattttgagatacgtcccatcaatacctaatttattgagagttttcagcatgaagggttgttgaattttgtcaaaggccttttctgcatctattgagataatcatgtggtttttgtcgttggttctgtttatgtgctggattatgtttgttgatttgcgtatgttgaaccagccttgcatcccagggatgaagcccagttgatcatggtggataagcttttgatgtgctgctggattcagtttgccagtattttattgaggatttttgcatcgaggttcatcagggacattggtctaaaattctctttttttgttgtgtctctgccaggctttggtatcaggataacgctggcctcataaaatgagttagggaggattccctctttttctttttctttttttttttttaattgatcattcttgggtgtttctcgcagagggggatttggcagggtcacaggacaatagtggagggaaggtcagcagataagtgaacaaaggtctctggttttcctaggcagaggaccctgcggccttccaaagtgtttgtgtccctgggtacttgagattagggagtggtgatgactcttaacaagcatgctgccttcaagcatctgtttaacaaagcacatcttgcaccacccttaatccattcaaccctgagtggacacagcacatgtttcagagagcacagggttgggggtaaggtcacagatcaacaggatcccaaggcagaagaatttttcttaatacagaacaaaatgaaaagtctcccatgtctacctctttctacacagacatggcaaccattagatttctcagtcttttccccacctttcccccctttctattccacaaaaccaccattgtcatcatggcccgttctcaatgagctgttgagtacacctcccagatggggtggtggctgggcagaggggctcctcacttcccggtaggggcggccgggcagaggtgcccctcacctcccggaaggggcggctggccgggccgggggctgacccccccacctccctcccggacggggcggctggccgggcagggggctgacccccacctccctcccggacggggtggctgctgggcggagacgctcctcacttcccagacggggtggctgccgggcggaggggctcctcacttctcagacggggcggttgccaggcagagggtctcctcacttctcagacggtgcggccgggcagagacgctcctcacatcccagacggggcggcagggcagaggcgctccccacatctcagacgatgggcggcctggcagagacgctcctcacttcctagatgggatggcggccgggcagagacgctcctcactttccagactgggcagccaggcagagaggctcctcacatcccagacgatgggcggccaggcagagatgctcctcacttcccagacagggtggcggccgggcagaggctgcaatctcggcactttgggaggccaaggcaggcagctgggaggtggaggttgtagcgagccgagatcacgccactgcactccagcctgggcaccattgagcactgagtgaacgcgactccgtctgcaatcccggcacctcgggaggccgaggctggcggatccctcgcggttaggagctggagaccagcctggccaacacagcgaaaccccgtctccaccaaaaaaatacgaaaaccagtcaggcatggcggcgcgcgcctgcaatcgcaggcactcggcaggctgaggcaggagaatcaggcagggaggttgcagtgagctgagatggcagcagtacagtccagctttggctcggcatcaggaggagaccgtggaaagagagggagagggagaccgtggggagagggagactgtggggagagggagaccgtggggagagggagagggagagggagagggagaggagggagaggagggagagggagaggagggagagggagaggaggagcctttccaattttctttccttccttccttccttccttccttccttccttccttccttccttccttccttccttccttcctccctccctccctccctcctcccttcccttcccctcccctcgattccctctttttctattgattggagtagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcgaggaatttatccatttcttctagattttctactttatttgcatagaggtctttacagtattctctgatggtagtttgtatttctgtgggattggtggtgatatcccctttatcattttttattgcgtctatttgattcttctctcttttcttctgtattagtcttgctagcggtctatcaattttgttgatcttttcaaaaaaccagctcctggatttattgattttttgaagggttttttgtgtctctatttccttcagttctgctctgatcttaattatttcttgccttctgctagcttttgaatgtgtttgctcttgcttttctagttcttttaattgtgatgttagggtgtcaattttagatctttcctgctttctcttgtgggcatttagtgctataaatttccctctacacactgctttgaatatgtcccagagattctggtatgttgtgtctttgttctcattggtttcaaagagcatctttatttctgccttctttcattatgtacccagtagtcattcaggagcaggttgttcagtttccatgtagttgagtggttttgagtgagtttctgaatcctgagttctagtttgattgcactgtggtctgagttctagtttgattgcactgtggtctgagagacagcttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtctgtttggtgcagagctgagttcagttcctggatatccttgttaactttctgtctcattgatctttctaatgttgacagtggggtgttaaagtctcccattattattgtgtgggagtctaagtctctttgtagatctctaaggacttgctttatgaatctgggtgctcctgtattgggtgcatattatttaggatagttagctcttcttgttgaattgatccctttaccattatgtaatggtcttctttgtctcttttgatctttgttggtttaaagtctgttttatcagagactaggattgcaacccctgcctttttttgttttccatttgcttggtagatcttcctccatccctttcttttgagcctatgtgtgtctctgcacgtgagatgggtttcctgaatacagcacactgatgggtcttgactctttatccaatttgccagtctgtgtcttttaattggaccatttagcccatttacacttaaggttaatattattatgtgtgaatttgatcctgtcattatgatgttagctggtcattttgcttgttagttgatgcagtttcttcctagcctcgatggtctttacaatttggcatgtttttgcagtggctggtaccagttgttcctttccatgtttagtgcttccttcaggagctcttttagggcaggcctggtggtaacaaaatctctcagcgtttgcttgtctgtaaagtattttatttctccttcacttatgaagcttagtttggctggatatgaaattctgggttgaaaattcttttcttcaagaatgttgaatattggcccccactctcttctggcttgtagagtttctgctgagagatccactgttactctgatgggcttccctttgtgggtaacccgacctttctctctggctgcccttaacattttttccttcatttcaagtttgatgaatctgacaattatgtgtgttggagttgctcttctcaaggagtatctttgtggcgttctctgtatttcctgaatttgaatattggcctgccttgctagattggggaagttctcctggataatatcctgcagtgttttccaacttggttccattctccccatcactttcaggtacacaaatcagacgtagagttggtcttttcacatagtcccatgtttcttggaggcttgtttgtttctttttattcttttttctctaaacttcttttctcgcttcatttcattcatttgatcttccatcactgataccctttcttccagttgatcgaatcagctactgaggcttgtgcattcatcacatagttctgaggccgtggttttcagctccatcaggtcctttaaggctttctctgtattggttattctagctagccattcatctaattttttttcaaggtttttaacttctttgccatgggttcgaacttcctcctttagctcagagtagtttgatcgtctgaagacttcttctctcaactcgtcaaagtcattgtctgtccagctttgttccgttgctggtgaggagctggtttcctttggaggaggagaggtgctctgatttttagagtttccagtttttctgctctgttttttacccatctttgtggttttatctacctttggtctttgatcatggtgacgtacagatggggttttggtgtggatgtcgtttctgtttgttagttttccttctaacagtcaggaccctcagctgcaggtctgttggagtttgctggaggtccactccagaccctgtttgcctggatatcagcagtggaggccacagaacagcggatattggtgaacagcaaatgttgctgcctgatcattcctctggaagttttgtctcagaggagtacccggccggctgtgtgaggtgtcagtctacccctactagggggtgcctcccagttaggctactcgggggtcagggacccacttgaggacgcagtctgtccattctccgatctccagctgcatgatgggggaaccactactctcttcaaagctgtcagacagggacatttaagtctgcagaggttattgctttcttttgtttggctatgccctgcccccagaggtggagtctacagaggcaggcaggcctccttgagctgcagtaggctccactgagttcgagcttcccagccgctttatttacctactcaagcctcggcaatggcaggcgcccctccccaagcctcgctgctgccttgcagtttgatctcagactgctgtgctagcaatgagcgaggctctgtgggcgtaggaccctctgagccatgtgtgggatataatctcctggtgtgccgtttgctaagactgttggaaaagtgcagtattagggtgggagtgacctgattttccaggtgccatctgtcacccctttctttgactaggaaagggaattccctgaccctttgtgcttcccaggtgaggtgatgcctcgccctgcttcagctcatgcttggtgtgctgcgcccactgtcctgcacccactttccgacactccctagtgagatgaacccggtacctcagttggaaatgcagaaatcacctgtcttctgcgtcgctcatgcggggagctgtagactggagctgttcctatttggtcatcttggctccaccccccaatttaaatattaatctcatctaaaaaggaccatcactgtgaccgccagaagggctgggttctgtggcctagtcaagctgacacatcacagagagggacaacaaagtgctctcaggtgacactgtcctcccttggatctgtggctccatccctgccctcctgccctcgggggagcttgtagaaggcttcatctcagagcccactgcccctgagtcatgtgatccaatcaaggcccctgagcagagaataaagaggtcactctggcaagtctgggaggagactgaccagtgtagtcggtggaggcattggtcaagcccccagccctggtcctgaagcaaaatcctccccaggtccagactctcagcaccttcttcccaggcaggggctgacagatgcctctgtgggtgcttaggaaacagccagaggatgccagcggtccaaggagtggctggggcagggcctgagacccagcagctgccggccatgatgcaggctgggaagtggttcatttaagatggcacttgttgggcagcaatgtgtgacactccctctagaggctcagatcaattctcgtgcttttatcttttcttgaggctcagcatgatgaaaagtggcctatatctacagctgataaataaccagaaacttgctgtatctgttttcattttattttcttgaacaattaccgccagcatgccttacattcagaggctgagattttaagtggccaaaagaacttcccaactgagcctgccagggactcgtttgaaatgttctttgctgcatcgaaaagcaccagacatgatctgtgaaagagctgggaggaaaatgttgcatgttcacagcacaagcgtgtcctcctctccaggggatgggaacatggaggatggttcccacctccaacctcaaaccctaggagaggcctgtcccactgatgagagaggacagcgccagcccaggagccatccaaaggatcatcagggtgaggaggggtttggagcccctgggatggctggggaggaaatggggagtgtggagctgcaggatccttagatgctgtctacattcctctagttgagcactcaagtcattgtgtgaccctagtcacatgtctgcctcagcaccaggagagttagctccttgaagccaggaactgcttcttttaatactcagagtggtatcagcatttaacaacaggtgctcaatacatgttaaatagaagggaggacggatgcatggatggttggatgggtggatggatggaggagtaggtgggtagatggaaggatggatggatggatggatggatggatggatggatggttagatgggtggttggatggaatgatgagtggatggatggatgggtaggtggatggatggaagataggtggatgggcagctggatggatgggtgaatgggtgggtagctggatggatggatggatggatgggtgtgtggatggttggatggaatggtaggtgggtggatggatggatgggtcaatggatagatggaagataggtggatgggtagatggatggatgggtgaataggtggactggtggatggatggatggatggatggatgtgtagatggaatgataggtgggtggatggatggatgggtggatggatggatggatggatagatggatagatagtcaatagatgagtaagtggaggggttgatggatggaagatgagtggatgggtagtgcatatatggaggggtgggagaatgagtggatagatgtgtggataggtggattctttggaggatgatagataaatatttggatggataggtgggtgggtaggcagatgggtgaatggataggtgagtaggtgggttgacagatggactgttgagtgaatgaatgtgtgaatggaaaagtggcatgaatctttcctcaaatctttgaaagactgtcacatcttaaagagtggagtcgtatcttctgtggatccagaaaacaaaatcatagtagattctatagagaagcagatttggactcaggctaagaaagaactttctactgaccccagttggcttttgttggagtagactgtgtggaaagggagcaagtcatggtccctggaagtgtcaggaaaaggaagctgtcaggtgtagtagaaggtgtccttgtgctagttgcagggagaccccagaggtctttccatctctggcctccatagttcctcctgagcccctgtcctcaactgggtcaaggagccaatttttctggcccctgcaggagacccatgctctgctagtgcagctgctgacccatggcaggggtgcactctcctggcttcagaccttggctctcctgcccgctcctctgactgagctctcagatgctgcccaggtgacctgaggaagctgatctgcagagaggacaggaagcatgtgacagtcaagcaggcccagacctgaccaaggtcatgcaggtggtagatgggagaggcaaggaggtgctgccaggaagcccctacagagacaaattggacagagccagggcagagcctcccaggcctagttcctggggaatgctcagggccagggaaccctcctctggagcaggcacatgtccttagcactcaccttccctactaagagccagggcctgaaaggagacaaaaaaggcctgagaaagaagctggggcccaggactgcataacaccagtgcctgtttcactgtccccagcccagggaaagggattggggctccatgagaggctgatggcagggaaggagccatgcaggagccccatttggcttgtgtctgtccccttggcatctctttctccttagaaaatctgattgcttgtagcttccacactggccatcagtttgatctgagctcaagggtgcagcagaggctcaccttgttctgcttaaataatgcaggtagtgaagttattgacaatctgtcatctgcttgaaagtggcttcgacagagccagaagcgtgggagggccccaggggcctcagccggccacaggtccagtctctggctgaacaggggctcttcaagaagggccaggcccttggcatggtccaagatgaatggatgggagcttgagccctacctggccttttctagaaggacattctatggggaaattctaagcagaagtgagggcaggagctgtctggctaggaggcctgcgttgtggattggaaaggagtctcctgatgcaggctgggccccccgcaggggtgggggcagtgctgagtcacttcctgccagaggacagggtctgaactcccaggacattctggccccttcccactaccggcctagccctgccgcctgtgccttgcctcctggcctcctagccacagacaggggtttatgatgagccggcttgctcatccttgagcctgggttggatttttttttaatgtttaaaaattccccacagcatggcaggtgcccggctgctgggtcaccccatcggctgttctgtcatcagacatcatgtttacccatcagacgctgttttcctgacactcaacactcaaaataatgatctcgctggagcaccttcatgaatgattcatgaggctctgctcaactttgggtgttaacagcaaatcaaagcccctcagtgagggcagcagagcagcagccagaaggcaagccctggccccagcctccaggcccccagggatgctcagggcctgccacccctctctcaggctccagtccagccctgcaggagtgagccagcctcagccaggccatggcacaaaaggggaggggagcagggtcctggctgtcacccatgtcctggtgaccttgctgaggacattggagctccagcctcaagtcagatcccctggaccccagatctcttccacccacaggtggtgtgaccttgagcaggtcactttgcttctctgagcctctctttcctgtctgcaaagccaggtgggaactgccctcccgcagggcacctgtgaacacgtgtgagtgccaggaactgaggttcctggcatccgggtagagtccaaacatggaagctcggattattatgtactgctcttacttcacctctcctggtcttcattctcttatttgtgaaatgagagggtaaactgtggggtctccaagtctctttacctgaaatacagcacctgccgggtctgtccacactgtgtgtgcactcacaggagggagctgtgcagcctgcaaagggggagctgcttctcagggacgtttctctgccagattctgcaacggagaagcatggagggcacagcccagccaggggttgtgcaaaaacacacacacacacgtgctcacatgtgctcacatggcagtggcagcagccaaacatgacctcataaatacatacacagcctgttcagcacatagagacattaaaggcaaggctcagcgagaagagctgggatatctgggtcctgttctgtccctgtgtccccaaaccggtggctccctgagggaaaggccaagtctgctccatcaccaggacctgcctggctcctgcacattgtgcttggcactgaacttgcacttaataaacatgggtcaaatgaagggaattcctagtgttgagcactaggaatgcaatcccaaacaagaccagccacagtcaatcagccccgtgaccctccccccagcctcagtttctcctctgtggcctagcaggttaaatccctaatgccacaaatgttctagcctggttctgccattcaaaagtgactgggggcagactccgtggcccctcctataggcctgtcagcaacagttgcaggggggtgcccatccataaccctgaccccagggaagggagggagtggagccacaagaccagaagtggcctctgcccctccctagaaacaagatgcagccccagctgggaaggcctatggctttttctttcttccctaaatggcctgggagcccctaaggcaaggatgggtccttgccctgatggtgcagccaggcccagcagcagcacagagtggaggtcaaatagcgcctcagagcaccagatgaacctcaagaaagcagcatgaggggcaaaggccagggcttcccagtcctggtaactacgggaggccaggtcccaggcccccaggcagaggggaagctaagtggccaagacgcaggcccaggcctgagacccctagctctgccctttgcaacctgtgcagtcctggacaaatcaccttgcctctcgaagtgtccattttctcctctgtaaagcaggcagagtgaaagtacccacctccgggactgtggagaggaaggcgcggggccatgcagaagagagctgggccatggtgcgggcctagtccatgctctcggtgcagagttggggataagagaccagggcccacagcctggggggctgctgagtctgtgtttatttatcacgttgatattttgttcattgtggatttttttcacaacagttccaactttttagaatattgcactaaacattatctccgttactgagttttctggcacccccttaaattttgtggccaagacaagtgcctcccttgccttccctgcacagcctaggcctctggccaaagggcttggaccaaagtatctgagtccaggaggaggccaggttagaggagcaggatgctgggaacaggtttgagcgaggaccaggaaggagaggattccctctagcccgagggcctgagcctgacccgggtgggtgtgagagagcaggagccaagtggtgcctgatgttggaacatgccacctgggctgctggggggccaagcttgccaacaagagtctgacaagagctgtgtgcagcaggaggctctctccagccttactatcagacccttactgtacctcccaggctcagccggcctttcccacctgcactcgctgccagggtaaggtgggggcagctgctgcttcaggctgcccctcactcccacctctgcccaggggccagtgctgggggaccgcctggagcttctctgtgccttgccaagccccctgtcttgacctgagaggtgctgacctgacccactgaaatgggagagttccctgaccccgtcaagagacttgcaacggggtatggctcattttcttggcagctgccatgcgcccactgggagggggtgcacagagatgggcaggggcaggagcctgggcaagtgcttttgggctctggccccatggtagcatctagaggtgtgttacaattaatgctgttttggcagttgccatccacggacagctaagtgttaaaccagctcagtggagagtcaggatgacagccttttacaccctgccctcttggtacccagcttcttgtccggtatcccagaagaatcaggtcacacggacttgaaggatggtgaatgtggggatttgattgagtggtggaggtggctctcagcaggatggatggggagctggacaagggatggagtgggaagatgattttcccctggagtttggtcatcctgaagctgatctcctctccaactatccccagccaaactcctctcgacgtttagacactccttctcttttctctttctctgccgtgccactgtgccactcttctgcccctctgctcatctgtctgtggatcctggagcttggggtttatatgagtacaggataggagggcacggtgggctaaaaggcaacatttgggcgcagaaacaggattgcctgttcccatttagggctgcaggtttccaggcttgagggcggggcctttgctggggaactgccctcttctacccagtatttccttgcctcctgtccgtatcaccactccgagctcactgggccggaagggcaggggtcacagtgtgcatggagtgatggctgccaggcacagccattctgacatttcaggagactgtggaccactcagagacagggctctaagcaaggccagcacacagatggctgaggccatcccactggggctcttggggccaaaaccaccctttgcaggttaagagggcatttcaaagaaaaaggtttgggtgagaggaaggcggtgggagtgattctgcagaaacagattctgggcctcaattccctcctcttggagggcctgctccccaggagtccccatcaccctgtgggttggtcctcgccaccagaagggcctgtgttcttcatgaacctttccatgtgcaccagtcttaaccgggagtgtgtttcccaaagacaggtagctcaccttagcagttttatatccgtaccccaggcatcagcaggtgcccaccaaacccatgacccaaggattgcagggaccaggagagaagagcaggaagaaattgtgtctaatccatgggaaccccgggatgggatgtagatgagtgtttggccacacagttggcaagtcgccttggaactggaacatagagcaaagccagagtcctcactgaccccctcccgacacctgcctttcatctgcttacgttttcaagcccagctgtgtgcccagcactgtgctgagtgagatggacagacaagtagggaggagggtcctgagtggtgggcatggactggtgcagagcacacaggagaggcccagcctggcctgggtggtcccccaggccgtaaagccagagctgggttttggacaatccctggagctgagccaggctgcagggaaaagatgcacggaggcgcagaggcagcaaccagccccctccaggacctgcgggagtgtttatggcatggtccttgcccacaaggaggtggtgacaaattggggacaagttaaatagaacaagatttaagtcccattgccaagcagggaatgggagccggggcacaggaaagctcgtgatgaagtgccagatgaatcacacactgcatggctctcagcctgaggagagcgatggcgggggcggggcaggccggacccggaggagtagggggagcaggcgggacctggaggggtgggtgggagcagagcgatgggtattggggcaagctggacccagaggagtcgggggagcaagtaggacctggaggggcagatgggaggagagcgatggtggagaggggcaggccggacctagagtgtcaggtgggaggagagagatggtgggggggcaggtcagacctggaggggtgaggagaggagagcaatgggtggggagggcaggcctgacccagaggggtgggtgggaggagagcactgaggggagcgatgggtggttggggaggtggaacccagaggtaggggtgggaggagagggatggtggtgggggcaggcctgacccagaggggtgagtaggaggagaggagattttggcaggagaaatgaggatgtcagcaaaggcccgaggcctgaaggctcaggctgagtccaggtcaggtttggctgcaatggatgagttggggtcaaaggcggctgagagggggctcctcccagagcctgagctggcctatgtgtccatcccctcccttgttggagctctggcgtggagcttcccattctagcctcagccacctatttatgtccatctcctgctcacacaaaaccagattccagagacaaacagggagacataaaaaggagaagagatgaagattcattgatgccagaactgactctcttctggaaaattgaaatattttgtacgtaatgacaatcaagtcaccgtgcgaccttcccggaataacttcccagatatatgacagtgacaacaaccgccccattggcgctgacacgctgaaggctccccaaagccaccacttaaaaaatgcctcccgcgttattaacattcctcacttgggaatgtttatggctcgtcactgttatcaacagtaacaaatttcgagaacctataaatgacaccacccccagagacagcccgggacaatccaccatcagcctgcctggcccaggctagactgtgaacatcaaatcaggctcatctgatgggcccccagccccgctgctcccacctcccgaggctcctgtcctcctcactcaccttgacccctgaaagccctggctccatctgcatccacttaacctccatcagggcccttgcccatcagatactgctggggggagggtacaggggtctcctgttcagaaccagggctttgagccacagcaggtgttacatttcccaaccgctgcttcttcctgctgcagagccccactccacacacctacaaagagaccctttttctcttcccttccttcattcattcactcattcgttcatgtgtgtattcatccatacgacgtgtttgctgaagtgattggaatgttgcacgaatgccctggccatgcatcagttgcagtctggtgacttccatcttaaagggcaaggtcagtgccaggcagaggggcagccttaggacctgcgatgtcagaacccacagtgctgtggtccccatcctagcagcagcctacaggaggcaaagaacctagccgctggcaagaagggcaatgcaggcctcataccccaccagtccctccctccaactgatgctaaaaactgtccttggagacaaacaggaagtatatatatggcatagtgacaggcagctcgggctttggagcaggctgcttgagtgtggctgcagctgtgacactgattagctcgaatcttctgaacatcagttttcttggccataaaatgggactaaaagcattcccggagctgttaagagggtcaaatgaaatagtgcatgtcaagggtacagcacgcttcttgatgcaaagccaatgctcagcagatgaagactgttgccacttgtacagattctctctttttgctttgggctttaattctcctacaagggtagaagtccaggtgagggggttttgtggccacttcgtttggaggatgtgtgttccatgagagaagagacaaaggtcactttggggccatgggggaggtaccagggaggaggcagcctgcaagacggatggctggcatggccacctcctggctttggccagctctccctggcttggccaccatggagtgaccttaagccagtcactcaccctcccccagcctcagtttctccatttgctgagaaggcctcctcaggcctgccattcacatccagcacctacaatagctctttgtggaatgttttatacaggatttctgtgaaaacctaacaagataatgaatatgagagagctttgaaaatactcagtgttttgtaaatgtaagagattattattcccatttaccacccttttaaaaggatgtttttcctccattcagccaaatttaacttggatgatgaagaacccagcctgggcttccccagctataattttcctgttccttgtgcctctgaatattaaaacacaaaggctcacattgctgagagaaaccaaaacagcagcctattagaggtgccattgcacaaacggaattcaaagtgatatttcaagcagggcgttctgtttatgtaaaccttgagagcacttgatgaatgtcagcagaactttgaaattaaaatcacttctttttttcatacgctgctcactctgttcttgagcccacgtcttgggtagtcgtggaggttaagaaaccactcagggtttaccttatactgttagaaatgctaagagatgaggcagggaggcatcctaaatgcctccgaaccggtcagcccaggactgcaaggcgaaggccaagtctcttaaagcaacagcctccaggagcgctgtccagagtgctgaaaaggaagccgggcctcgggggtgactggggggcatttggaagagggtccttccccagggacacattcctgctgctccctagaatcctgagggggaatggagggggaccctagggaggccaagtcccctgtgtgagctggagggaatggaacactagcaggcagagggagaagcgtgacagggaggagagacggggcccccccaccagagtgacaactgcagtggaaatgaagaggaggggtgagcgcagaagctggaggaactggcaaataaagtaataaaacagagagatataccctatgacagcagggagataaatggagcaagttataccaagggctcatttttgtgcaaatatttggggctctataaaataaggctgtttattataaatctgtctcccaagtaagtcttgccagtgcacaggtgtcacccgcagggaagttttccctctaaggcacagagggttgagctcgtggggtaaagtgtggctgcaactgctctttctgttctataaatagcccttcccgcgggggaaatgagactgctgggagccaagagaaggagccaggttcggccacgggatgcctggtggccttgaccttcacttccagccaagcggctgctgtggctgtgcagtgtcccagaatcaagatgactgacacacatggtcgtggctgaggagtctctcagtcctgtctttaaatatcaggagggctctgctgccacattctctctccagctcagcgggggaagagatgacagagcacaaaagtgtagcagcagagaaccagctgagaccggaggaggacttcagggttcatccactccttcgaaaactttgaaagtatagacaaccctctgcctgaaatggctcgaggcaattcttcctggaaccaagggaaggattggaagacttcaggagcttggggaaattcccaggagaatttgagtcctctaccctcaggctctagggccagcatatcagcaaagcaaataaggcctcaaagctgatgaggtcctcaatctcagagcagcccctttccctgctaagcagacacttagacacccaggaaaggacacagcaggggtgccagatgtctcaatggtagggtcacctgaaggactttggtcatgcacacccacccccccacccccatgcatacacataaggtctaaggtactatttccagaggaccaggattcctgttcctcagaggaatttgctcttgggtccccgatcttcttgattgtgaaatagtccagtgaatggagaatcggggtccccaacttccaagagcccatttcctcagctctaaggtggggctgatcacaataaggttcttaggagaattcaacacaggaagctactcaaagcctgcagcccaaggcctggcacagatcgacattagttcttagcatgctctggacaagaagtcacccctgtaccatgcacacagtgggagctcctgaattacccagatggacttgagtctgcttctaagatgtggtgctcccacagcagcctgggcaggttccttgggggccatcatcataccttcatcccatgttgtcattttggctggccttgatcacatcacactggcacatcatctgtcttcttcacctcgaccctgaggacactgactctctcttcttccatctccatatctctagtgcctgtaactcaagaaggtgttagctgagtggtcagtggagagatggcatctcagcctatatcacctcccaagccagaccagattccaccctgtgccaagcctcagcagctccccacccaggagaaccactttctaggatcgggaggccctcttttcccaattctatgcccactcctctttatcctgctttgtgtgcggctccaggctctcaactctgcacctttggaaaagacgtcagctttctccctggcttggggcctctgccccaaagactgactctgtactgtttatcgtctccctcgttttcaaggctttggctggaaatttggctccttgggccggttccgatgatattttacagtgccttcttaatttactgtctttttatgactatagtaaaaggccacacatcagggaaggctatcaaacaggaagaaacatcccctctccttgtcagctcaagttgagcattgtaatttacatgaaaaccttgtggcttagggtgtttacctcccatggaaccagtttcttctcccattatgagaatgagataattaaaaacttccctgttcctttgatattgaattaggttaactcagcccaattgcaaatgccagtttgaaggctgttatgtcatttggatttcaatgtagagccatccttttttttttaatccagaaatgctttattcttgtctcttatcctgatcccaaattagacatagggaagggaaataagggatttattcacatttgaccaaaaaatttgcatctcaaacagaaattttaaggaggccagggccagggaggcagctgaggctgtgtggcttccccctagtcaacaggcttcacagttcacccaatgtgagagagggaaagcatgaagaggaaagtatgagacccagtccataggaggaaaaccacagtccaacttctctccacctgccatctaccatcaccacggagccatgccatggcaagctattcctgcccctagggagacaaaccccaactcaaattggcctaagcaatgcagaatgtattctatcacctacgcggaaagccagagagagtgcgaactgcagggtcagcctattcaggggttcagccatgtcaccagccaactctgccatcttgagtgctggcttcgtgtgcctcctgggagccaggtgactgcagtccaggttcacatgacacatagcaggtgtcacaaggaagaagagtgggatgttctgcagctcctaccagtgaaaaaccctctcctggaaaccttcacacttctcttacctcatgagccagaattgggtcacatacccattcctaaatattcccttatgaggaagatgggagaataattggccaatgagattcactcgccactgccccctgccaaacacacacaatgacaaaattgaggagaaattgatttttttttttttttgagatggagtctcactctgtcaccaaggctggagtgcagtggcatgatctcagctcactgcaacctccgcctcctgggttcaagcgattctcgtgccccagcctcctgagtagctgggattataggcaagtgcaaccacacccaactaatttttgtatttttagtagagacggagtttcaccatgatggccaggctggtcttgaactcctgggctcaagtgatccgcctgcctcgggagaaatgaattttgatggggaataaatgctgtgcagacaatgtatgtgatgctgtcattaaatgttgcacacattcaaagcaatgtatatgtacacaagcaaaagtaacaagaaaatgggccctcccagaatagaccagaactagacccaggcctttgaagttccctctaaggacaggctcactcttctccatccttgctggagtcttgaaagttgaacatcgtggtaccaggagagtgagtggaacgtggggccactgtggagcccagtgattctcaaacaggggtgattttactccccaaggacatttggcaatgtctgaagacaattttttgtcatcacccttcgagtaatttagtcgtggaggccagatgtgctgctgagcatcctctattgcacggcacagccccacaacaaagagttatacagccccaagtgtctacagttgtgaggctgagaaacctcatggaagcctggctttcatccaggatactcccatgatgctttgccccctgggaaagggagagaggaggtggcttaccaatgagatgtgactggaagctggagaacacagaactggtcttcacccctccttcccttctctcacagaactttcctttacctctggcaaaacaaagaaaaagagagagagagaatatattctatgctgccttgttctgcacgagtatcttactgggaggctgtcagcatttggagagcagggcccagttccaccatgtctgtatccgcccagcactcacagagcaggtacctcataaatgtgggttagaaggagggaggagagatggagttggaggagaggtctgggactgagtagagaagctatgatttagaggcaggcaagtcccctgaggcaaattttggccggggctgagatcagctggttcttagctggggaacaaagaccattcaagagtgggtcagccagattcaaaggtttagctcgagaaattgaacctgacagttcagaccaagccagaaggtcctttgacaagagaagcagggaggaggtgttggaggaggcagccctgaggacaggtgcaggatgcatggggccagagcaggtggaagcaggagagagaaagagagtgcgagggaaaggccgtagggtcaggggagtaatccatcaatgttccgtccaatgctgggaagagcagggcccaacagtggagaaaaggccaggaccttgagaggcattgcaccctgattaggggctggtgaactggagggagcaggcaggggtccagccaggaaaagaggtcctctcataggggcaactagagggaggctgccacagaagaggggccactggcccaagagagccaagggctctgggaggaccccccatggtgggtgctggagagcccctgagcccttttatttcacagtgacaggccacagccagaatacgttgtcaccgtcacctggctatgtcagcagaattttcaacaggggctgtggtctgggatgccaggaatttccccttggctcctgagacatttgctaagccaggcgccaactggagacagtgacgggagagtctgagcatcgtgcctcggtgctgacctctgatattcaaattcctggaagccctggtgcaccttgtcctggcagtgcagctcggtagaggtactcccctcaaagttaataagaaactaagaaattaatttcctgtcaggtgcctctgcccagcagtggcagcccaacactctgtgtcattgggagtgtacttaaatcgcaaggaaagttataacaagggggctggtgaggtgccaggtgcagtgctcgcccttctggaagtttcctggaagagggatggagacgtctgtgcaatcccgagcaggtcgggggtgccagcaacacagcctggccctgggaccattgcttccaagaaggtcactttggtttttacttgaccatggtttgttgcaaaattcctggcaccagctcagctcggccacgtctcggctccctggcgcctctagagagaacgaatatgctaaagatagtgaggcgtcttctctgggtgacctcgtgtgaccttgcaatcccgtcaagtctttggttctgcagaaacaactgtcagatcgggagttagtcacctccaaagacagaaaccaaaaaccaaaacagtgaccttgttctttctgttcatgaccctggaggtatggggggaggaggaggaagcggagattggttttgctcgttaactcattatcagtgactgagcggctactcatggctgggaacttgttgggtgccctccattacacttcccttaatcctctcaatggcttttgatatcctcaggtagatgggaggatccccattttacctgggagggatacaaggccaagaggggttaagtaacttgcccaagatcacacagcgtttgaagtggccaaggtgaaatttgatctaacttccacttggatgtgtgattccactccacatccaagttctttccatcatctggctgcaggcaagataacagattggtgtattctttctatcttatttgaattccaaagttagtatccgctattgaaaacagctgacttcattataacccatcattgactcctttctttaacaaataaccagcaaaacagagcgttctttcggagtaagccttccaccacctgaactttgacaactttctccctaatgggtttctccctgtgagtatttgatcttggccaccagcatgagcctatcctggtgatctcaaaatgctgaggtttttcttctgttaagagattgaatcttctgttccatgtggaggcttattcaacattaaagcgttcctgaaccatttcatttattcaacaaatattttccaagcccagctctgggccagatgccaggctcaaggcttagcaagccagacagatgtggagccgccatcatggaactcggccctcacaggccattgtccttggctttccagactgaacctctgtgctttcttgtttcacggctgttttcctgaatgctccctgtgagcccgagtctgtcctgaggtcttcgtccctattccctgtgcctgaatcctttcctctcccagagctccccacagctggcttctttttatcatctcagatacagctgaaggttccatcctcagaggccttctcaagctcgctggctaaattctccacccacccccattttttatgctcataccacttcatgccatccagaaccaccttattctttattccaatgtttatagctcgtctcttccatgctctttgagggcagagtcttagacttggtcacagtagaccccaaatgtaggccagtccctggtatcttgtggttcttgagagctaatctgttgaatgaatgaatgaatgaatgaatgagggaattaatgaacaccctgcaaagcaagtgccacagttacccctactctatagaagaggcagctgttcctctaaaaggctgagaatcccacctcagagctacctgcaggagagtgggtgagctgggaccccagtcatttcaggttaactgaagggaaagcctgacttcccatcagctccacacactgagtcctttctcctagaaatgaaggaaacacaaagaagtcactaagaaggcacctcgccctcaagcatctgaaaccctcagttggaaatttgactgcaacctctgcctcctgggttcaagggattctcctgcctcagccccccaagtagctgggactacaggcatgcgccaccacacccagctaattctgtattttcaggagagatgggatttcaccatgttggccaggctggtctcaaactcctgacctcaggtgttccgcccgcctcggcctcccgaggtgctgggattacagaagctctttttcaacattgccttttagatcccctttcccatcagcttcctccaaaggagctgctggcttgatttacctgcagccaccgcaattaattgctgtcccctggtagctaacatctcttaacagctccatagcaacagtggtttccaaatgccagaaagtgttttttccaaggggactctatcctcgacgcaaaatagaacattttgagtgaaatttaaacacagtttttgaacggtgctgttctgatttcttcacacttcacaaatgctttctttgcaaacatgggtgtcccagttaccctgggctggtgccaaggccctcagcccagcttctgttttctcagcttcaaggcagccgtggtaagacctaaaaacaaacagggagcgagtgctgtgggtctccccgctaaggggttgccttgcgcctgtgcagagatgaggaccacagtttgtctcccacaccagctgtgatcaattggtgatgacaacgcagaaccctgcctatgcgatttctgggaccccatctgagcttagtgggaaagagtgccatccgccatggttccagtgcagaattccaagggccaagatggggagtagggatttgtgtatgagtggttggttggaacaaatcatcctggtataccactgctcccacaggtggaaacagagaaactgggttaaaatgaagactccagtaaattcgcatgcagaagtacccagaaaggcccttgccatgtccttcactctgccttggtgaaggtggaagagatgaagggagagggtgatgggtgggtggtgggtgtgctggccaccgactggcacagcccccagcacaggggctgtctctagtgaccgatccaggatgagtgtccccattcagatgcagtcaacccaccactgattcaaccaacacttgctgactgcctatcagggaatacatttccttctgatgcacactctgctctcaggaagtctggggtccagagagggaatggaggtgccagccagcctgaagatcagtggaaagagtgaggctggctgatgctgcaggagagacacagaggactgtcaggggagtcccaaagggaatgaaattattttggttggaaggataaagggaggctggaaggacagtgtgacgttggatctgggtcttgacaagtaggtggaatgtggagagattccaggccttgggaacagcgtgggcagggccagtggcagagcaggctgaatggtctggttgactgagccaagaggggtgagaagggtgcatgggaggtggatccagccgatcatggaggccattgggatcaggagtggggttgcattcacaggaaatggggagccaggaaaggttagcagtgggtgacgtcatcagagctgggacttgggaagatggctctgagagttggatgggagtgcctggctcaaaggcagaccagtcaggaggctgatgccaaggagcatggggaaggcagtgaggggagactggggcggtggcctcaagggccaagaggaaagcaggatgcctgcccgtctctcccctccttcagctctgctggcattagcagcgcctcagacttggtggccatggagtcacagtggcaggactgctctgtggcctgattctgcccccatcgggctgacagggtcttggcctctaagcaggatgcttagagttgcccctgccctgaggaagctggatgaagccaggccgttctgtcgcatcatctgaagaggagtgagtggggttgccagctccctgctagcacagatgcccaccccaccgttgtcttcagcatctgccaggagagggacagtttgaggcagtgtcggggttcacgagcttgctctcctctgccattcgcaatgggctggcatagggcagcctcactgcttggctccagccagcgacttcaggatgtggcgatgaagatggggtctggatgggcgttggtattcaggatgtcgagccccactggtctgggggaccagttggcgcttcctgcaaaggcatgtgctctgggaagggcctggcctgctgcagcagctctgcagaggggccggccccagacttgcctatgtcattagtatagcaggtcccgttattacccgaggaggcttacaggttatcagcgagctccaggagccactggagaaaggaagaagataaagaaggatttaaaaagaaaataacaaaaagaaaaactgtattttctaatccaaaccttgccctgcagtggctttgttaacccccagtcactccttcaagacataaactgttgagagccacaattacttcagtgattacacgttatcttgtcctaccaaggtattaaagaggaactggggaacacattaaaaaaacatacagcccaatttaatcatgattccctctaaaacaattgctggaatctcaccattacagatgccagagcataaaaatcctgtagatgcttgatggaccgggcacaattcatcctctgctgcctccacggccagcccatttgtcagtcaagggagagctttggggtttaggtctttaacaggattgagtgcaggggctccccaggtgctcctccagagcagaggaagggtggccccatcccaacctcccagatttccctgcttggatcacctgccctgccatcactaccaccaggaagacactaaacagaaagcccaccaaacatctcgggaccctactcatagtcaaggttgtgaagaagtttgctggccgggaagcagccttgttctgaatgccacttgtggtgaacagcaaccagctctgcttttctgcaaattctctctgcaaagcgagggaggtgtaatcatttgcttcagaaggttctgaacatcaggaagaggcaaagctgagagacagcagagggtgggggtcgggtgcagctccctgtcctcactctctacctgtctgctgcgtgacgttcaactcagagtctctcttgcttcagttttcccaattggagatggaagggggttgataagttggcctggacaatccctaagtttcctcccaccttcactactctctgttccaagaggagtaaacagaagggtttaggagacccctgacttgcaggaccctggaggatctttcatgcacaaattaaaatacataaagcatccaggaagaggacagtgcttactagagaaggggctggaggcactggagctcctcaagggcttgcaggtcacttgatgcctgtatcatctggatgaggactagaagtgatcccattggcccaagggactcctacctatccaatgtggcaggatgtggatggggtgtctgtctctttaattcatggagagttatgggatatttttcgggaaaatggagctttgttttcttccagagtttggaagataaccaagaattgtctcagagatcctgtttttatgtttggacaagaatggctggtgtttagctcatcgtctgttggagatcatgatgcttcctcgatgtttgaaaagaatttaactttacctagatgggctcctatctcaaagaatcacgcttcccaaataagcaatatctgaattaatttgatgttgctccacatggaagttccatacgatcctagggaaactttgtccttagcaatagtgtgagatgacataacactggttagagaggtcagtcagaataatacctggcccttctgaaggtttcccatgcctcgggcactgttcaaatgctgtatcttgtttagtcttcacaactacctcagggagcaggcactactgttctctccattgtatggatgagaaaactaaggcacagagatgtgattgcccaaagctcacagctaggaggtagcagaacccagactcgaacctaaggcagttgtctctggagcacacactctctaccactctgcttcctcagcatcagatagacctgggcttaatgggcagggctttgatggactacttaattccttacgttttagattctttatgtgtaaagcagatggggccataaccagttctaccttgtgaggttgtagtgaggattaaacaagctaagtcccgggaagtagttagcactcagcacctggagcatacaggtctgaagaaatgctagttctcagcaatcatagcggtgggggttattgacaccagagggtcatctgaattgtgtggtggaaagagtgaccggcttagccgaaagaagatgtgatcattttttaggaactaaggctcatgggcgatgcaacaaaaaactcgacttgaactgactttgggggaggaagagatttgggggctggagttgctgaaaagtcttgagatgtgctggcctgtgttccatcagttgcatcgaggctttgtgtcttctcccctcagccctgctcctcgcaccagctcccttctccttctccatgtgctggcaagagatggcttccaggagcactagatttcattctcccaggttcgagttcagcaggaaagagcacccctgcctccaagtgactccaaccaaagcctagtgattagcactgattggctctggtggagccatgggtctctctctgagccagtcgatgtggcccaaagaatgcggcttggccagcctgagtgacaagctccacccctggactgagttggagaggtggctggattgctaaagaaaacttggaaactcttatcaaaagagctagtgcaccagagttgtgtccagctcagcctcccatgagccacgtggccgtgagcagatcatgtagcacctctcagtccagcagggatggtggcacatgcccaacttccttcagagctatggaggggagcagatgggcaggaaaggctacagagcacatcagtcactctagagatgcctcaatgactgtttgctgccattgtcatctgatgggcttgattcactgcctaatggggcacagttctgagcaggcacaccagctctgggagcagaagtggggcgcacgtgcttggagaggatggaagagacaggggagggcagcaggcctggcttccagccatccaggaggacatggccagtctaggctgcaggcaagacctctttgaggctggtgaggaggccatgtgcctatggatttagctcctgggagggacaggaggccagaggtatggtgactgcagccctctgagacctgattgcccagcatctgtgctgttccaccctctgtctctgctgggccagggctgcatgccctgaggaggacctttgccctacaggagttccctgtgcccctgcgaaaggcccatggcttcttgtcccaggggtggtcggagcaactcttgcagcattgctaataaatcaaaaattagttcaaggtgagagcaggagacaaacaggacaggacaccaaccaacaatctcatccaagctcaggctctgccaactgcaggacgccagcagcctgcatccctgacaggtccctggcaagagagagaaggatggttggacgctgaacagtccagctgacactcgcagccccagattccaccctggtgggggcaccggccatcatggtgtctcctagattttgtggtcccaaagagagatggcccccagcatcccgatctcttgcacaactccttatggatcagccatccgggaactaatgtcacccattttagaaaaagctctttatatttttcagcccatgtcgccttgcaataatgagtctcatacgttgactgcccgctgtgtagtttgattgtgctaaaattacctccctgagctccagagtgggggaacccgtattcttagctttcatggatctagagttagaagcaactttcacctcttctcccctttctgaagactcgaatcacatttcctctccactgttatctttctggaccggaaagcccttatcttcattttcctggagctgcctgcccctcctcagttggtgctccctcacccctgcactccctagttcagacccagctctgcagcaaggacgcctcggccattctgtctccagttcccaggtcctgccctcctctccaggctgggccctttctggtccctgcaacaactgtggaccagtggcttctgtggatcctgggaggtcctctctcggggggcctggcagtggcagctcgagctgccagcctccgttgccaatttgctttactcatcctgagcctctcgccctgcacgtcactgccctgggatacatctgtagctcccataccctctgacactggctctttttcgttactcattaaaatttagtgtcatctgcaaacgtggagattttatcggacatgtcttcccccgggtcatttataatgattttaaataaggccagcccgggcccccacgcatacgtgctgttgggcagccaggtcttgctgcgcaatgaaaagtcctcccctcccgggcagcgcccctccaggatggcttgacccccctctcagcctttgggtgggactgtttcagaggcctctggaaagtgcaggcagacgggaccctctgtcccctcttgaggtacatgcatctttatctgctcagcgagagtggagaactcccttcatccagcattctctgggtgtctaggatgtgcccaggattgtgtcaggcatgatctcccaccataaatgtgtttttcctacactacctttgggctaaaggaggcagggcaagccagcccctgagccggcatggttcccggaaccccgcaccaggtggaaattgtttaactatattcccatgactggaaaattctggtaattgtgtaacagcagcagcactcagcaattacccagggtttttcatcttcagaccactttacccacattaactaattaagtctcccagcctccctccaaagcagggaagggctgccggcctgactcctgctggcgcacaggcttgcgtaatgagggcagccatgggaaggtgctgcagggcccccaagggcagcctacctctgccctcgcctgtaggccctctgaagcccttgccagccatcgctcagaatcctccagccctgctgagcactgacaaggaagtggggaggtgttctgtgtgcctgccacactcggccgcagtgggagatccctgggcccagcacagattgcaggaccaagcccccagaagagcacagttgactactgaccctgcctattactggggcaccagggcccctctttcagttcctactccctcccttctgtttttgcttatcctttaatagctgccaactttggggacctagatctgtaccccagttaccgggtgctcagctccagggtccctgaaggctgttccccactcccctgcacaccccacagagggtgttctaactactgtgggcccttgatgtggagacagggacatctgcagcctcggtcctgccctgaggagcttacagaccagccaggagccttccagccacatccttggtcctcccagctccccacacctcacatgacccaaccgggctccctggacctacttttgctctggcatagacatgaactgggctgctgccacccggggcactgaggctgagtgcacagccctcccatgaaacatccagtgagccccacagagccctggggcagtggtctggaggtgtgagatcatgacttcaagcagggctggcacccagagactcagccctcaaaggcactctcctttctgtaaacagggatagcaataccacttgcacctgtgggttgtagaacttgaatgtggagcccgagacacagctgacactcagaaagcaaactgtgaaaacagaaatgcccactgggaggtatgtgctgtgggtccaggcatgctcccacccctgagtggccgtggaatgccacagtactatgcattggagccatcagaggcagggaagagagacccaaggagacagcagcctgcaggggccggcagatcctgggagacctgagcagcaggcgcccgcgtgccctggcccttctcagggagcatccttcttgtgcttccgtccatcctccaggcctctctgatcctccccctgcctcctggctaccctcagtgggtgacagtggggatagaacccaagcctgccaaggccttcatgatcagcctcctttctagtggaaccatcgtcccacctcacactgctacccagagcagagaggacaggggcccagctacctggggcagccagaaggtgggtgagaggattttgctcagtcctgcagcctagtgacaccacagccctgtgccacccagtgtcgcccagtgtcgcccagtgccgcccagtgccgccctctatcccgtccctaataaaccctgcccttctccctcccagccttgcacacccgtttcacaggctcctaccctcgttgttcattaagcatccaggtgcagggaaggctgtgcctctgatgatgaggcttatgggacattcggaatatgtataaatggtgctaatatgacaaatgcaaagatcgaaggagcttgtgacgcaggcaatgctgcttcctcgcccgtctccctcctatccggctggcggcaggcaggcccgccccccgcgcccccagcggcaagtggggaggtgtgtggcactattacatgctattatgactttctgggtaatgtatacattttcactatcacacggcctctctccttcatttttcatgagaactggcacgagattaatgactgagccccagaagaaacggaacgccatgccactctgatttattgaccacttagcgttgatgaagctgcaaacaagagtcaaacagatgttgcagctgcatttttctttatcaaaaccaacagctttttgcatttttaaccacttcttgcatcaccaccctgcttactccacagaaaggggtcctggctccaggcctcctcctcctcagcggagatggaggagccgaggccagggcggtgggaccctgctgcctgacacccattggcccaggatccacccctggaagcggccaggaaaaggatgtgagatccccaaggctcttgctgtgggtgacttgagtcccctccgtgggtctctggggaagagctcactgctgcatcctcaaccaactccaagggctgattgcgcacgcccaggcgtgggctcagcatgcgggaggtgcagagctcagctcccctctgcagcctggagcacctcccccacctccgcctcatgcccatttactagccagtgtaagtgaccttacacatgagcgctgctgggggccaggcccgtcctgagccctctgcctgcctcaccccctcctggcaaggttcaggctagcactaaagggcctgcttaacacagagcaggcattctctgcagaatgttcttagcctctcctgtgcttttggaggaaaggccctcagcttgtcccccgtcctctctttgtccctgcagtttgggtgaaaggtgccatctagaaaaggttctcaaagagattgactctacctcaggctcccgggagatgcccttccaccaccttcagcctgagagtcctgtgcctggcagggccctgggagtctggaactggggaggtcagcagctccaaatgcatttccaggaggcacagctgggttaagggacaagctgaacttccctcagagaggaagagctgcagaggggcagagagctcgtggacccccccagatgccacccctcctgggccccttctgggggagtggaccccctcctcttccagcccatgcctgggatggacaccgactccttccccgcaccctagtctctgtctgtccctctagaagacatgcctgggggttctccaggattggtcctgagacactgagtctccggagaggagacagccacccctgcaccagctcccccagccaaggccaggtgccccctagcaggcttgttggcccgtgtgctggagcagcttggcggcaccccgctatgcccccggttttcagtaagtaggatggagcccctgccatgtggctgccccgcagacagagtcccagccatccggagctcacattgtggccaggaaaacaggccaaacccgagtagtaattgagcggaaactgagagattagtgctgcaaagacagcgaggcgggaaccaggcaaggtgggcactgttgtcaacggggttgctgaatgaggtttccacaagaaagtgacctgggaccaatgtggcatggagcgtggcagccagagaccacagcccagggagagaagcggcagatctggggaatggggtggcgggagccaggtgcatgaggcaggcagcggccagcaagaagcacaggtggcccggcctggaaccgtggcaggagtgtgggcctgatctcagtgccaaggagccgtccggaacagcccaaccacgcctgctgctgtttgaagggtgggttggggaagggaggagcagacgtgaggacacccgggaggagggcacactcccacgtgcgcaggagagcaggtggaggatcagacttggtcattgcaggcagggggtatatgggaggattaggcttcctggggtgggagaaatggcagaactgggtgatcgactggccgttgagggagagggagggaaaatgagaggatgactcctgggttccagacctgggcagctgtgggaagcctggaggggccaagggtgctgagcaggaggtcgggaggcgaggtcggccatgggaagtcatggggattttgaggccttcgaggggtgccgtcaacaggcaggtaggcaagagaggagaggtaggctggagagggaaatctgggtgtcctgggaatctggtgggtgtgaggtcaggacactggatgaggccactaaggagggagagagggaaagagggagaaagagagcgagagagagggaggccagagccccaggctggacgctggtggaggaagggcctctgtacacagcaagaggagagctgggacaggctggggctgccggaggaggaagggggctctaagcagcagaagtgcccgctggaggcttaactctgctcaccctctcaggaagcacgtcagggcttttttctgtctgggtttggttttggtggtggttggtggtggtagagcggggcctctgtctctcctgacgacattccagctgttccgaggcctgaccctgctccctgcagcagccccagtgagaaagaggcgcagcttccatgcttatgggtgaggagcctgaggcaccaagagggaggagggatcccctcgtccacggctcttccagaaggctgtggaacttctctgagacttttacttatccttggcttcctctaccaccaccacagtcacagaccatgccacggggctctctctccccagcctttggcactgaccaggcctccaggaaagcaagggctcatctccaaaggtcacgatcactttggggggtgacccctagcatctctcatgaaaactccatagcccagggaggggcttctgcacaagctcttcttccctccctgaacccacagggcctgacagggtggtgaaccccacggaaacatcagggcagcctgggcaagacaaaggcagcttcactccacaactgtccagaatcaaggatccgggccgggcgtggtggctcacgcctgtaatcccagcactttggaaggccgaggcaggcagatcacgagatcgggacaccgagactatcctggctaacacggtgaaaccccgtctctactaaaaaatacaaaacaattagcggggcactgtggcgggcgcctgtactcccagctactccagaggctgaggcaggagaatggcgtgaacccgggaggcggaggttgcagtgagccgagatcgcgccactgcactccagcctgggggacagagcaagactccgtctcaaaaaaaaaaaaaaaaaaatacagggccctggcggggtctgtcccctgccgtgactctcagatccaggcccaacccgggcattcctgcaggccgccctgctgagctggtccacctgagcccatctcgccaccagcaaagcagctcagcaaggactctgacaccgttatgagcactccatgaaactgatacattaggactccaagctaatatatttttctgccaaaaacacccaataaaatgtacaactaatgaataaaattgcaacattgccaagaagcgatgtgtgccccaaatttccaaaatacctccatcagcccatgtctgaaaaccagccccacgccaggaaatcgttactactcaactctgggcattccaggtgcaagagctccaggccctgggatggaaaccgggaagctgcctgctcctgcatctcctgagcctccacttggtctcctggaactgccaggggctgggacactctgctaattgtatcaaaacaagggagaaaggcaaggcccagcatggaggctcccgggaagggaccccccacccccggtgttgggcaggtgccctgagttgaaaggggtagatctggatgctacaatccctacatttgtagttactgaagtgggatccactgaccactggatctgtgagcccttgaactgaagtgttgatatgccttggggtatgttggaggatggggtgggtatccactgcctgcgtcaggctctcaaagagatctcatacccagaaaagatgaagaaccagccttgcattgtatcttaccttcctagcaacaacctgtgtttagaaaggcttcccggccgggtgcagtggctcacgcctgtaatcccagcactttaggaggccaaggtgggtggatcacctgaggtcaggagttcaagaccagcctggccaacgtggtgaaaccccatctctactaaaaattagccgggcatggtggcagatgcctgtaatcccagctgctcgggaggctgaggcaggagaattgcttgaactcaggaggcagaggttgcagtgagccgagatcatgccattgcactccagcctgggcaacaagagtgaaactccatctcaaaaaaaaaaaaaggaaggcttccctgccctttgtggacccagaaaactgaagccagatgtcaggagaacacaggtctagggagggcacaagcaggaggtcagaattcagcctaatttgattctacaaacctgaaataagcaccggtgattgttggactgtcgtagctgcagggcattgtccctgaggttgaggaaataaagttgatgttcagacaattaaaacacaaagccaaatgccaccctactatggtagaggcagagagggaatcagggaaggcttcctggaagaggaggggatcctggcatctgacctcaaagaataggtggaggctggttatgcagatggaggctgaggcctgcaggcagagcttcctgagatagcagcttttggggtgctctcatgcaggaactccacggtttgggttcatggtgagagagggcctttgccccacaagaccctgtctgcctgcccgccaccttggcctcccacgggtcccaggctggcccaggctgtgcccagcacgactgtggggcaggatgcggcagtcctttcctctcccaggcgtctggcatctccgctccctcctgcagggccgggcttctgctccagggccaggatcagaggcagccctgggcggcctgctggcccctgcagtcctttgatctttactcatcttgctcagcagctggcattgctgcctggccgtgcccaggcacaggcaggagccctcagcccagacgcggtccctgggaggccactatgttggtctgtaggaagaacacggggcaaggacacagtgaatcaccccgtctctccgccgttaccccctccatgcaaagggcatagcagatctacccgacccacctcttgggcatactgcaagaatgaagtgaaatggagatgagacagtacttaggccaagcaaaaagagaggccagcagatgtcctggcaggacccgaacctggagtcagagccccagcttccagctcaggctgtgccctgctggcacatagctttgggcaatcacaacttcttagtgctacaggcacctctctatagacagagggcaccctgccctgccctaccctgcccagcccgcctccttggctagcaggggcaccgaataagataatggctggaaagtgctttgaaaagaataaagtgctgcgcttatgtcagggattatcgtgattattaaggagcatgattaccgcaatccagaaaagccgccattaaggagaaggctcctgttcgtgttgattgagtttcctggttaactgagcgttggcaggaaaaaatctgtttaattatgccagtctcctttcttacattggtcatggtgtggtcttgagtctttatttattcatggattgattgattcatatattcatgtatgactctttccctgacaacattcaaaaaagcagttgcagacccagctctctcctgcctggggtcctgcctgtcccaggactcatggttgagtctcagtctatcagctggggaaagcagaggggaaagcagctttcctctatcaggaggaaaagcacaggatgaggcctcccacgtggctttttccattgttccctgcagcgtctgatatcctgccatgtttccttaggagaatgcaagaaaaaaatggttcaggccaggcgcagtggctcacaccggtaatcccagcagtttgggaggccgaggaaggcagatcacctgaggtcgggagttcgagaccagcctgaccaatatggtgaaaccccgtctctactaaaaatacaaaaattagccgggctgtggtggcgtgcacgtgtaatcccagctactcaggaggctgaggcgggagaattgcttgaacctgggaggtggaggttgcagtgagccgatattaggccactgcactccagcctaggtgacacagcaagaccctgtctaaaggaaaaaaaaaaggttcaagaaataccctctgattgagatgggagggtttagctaggcttttctggcttatccagatgcatctagaaagtgacaggattgctttttctttaacaaacttgtcagtattgtcgtggccagataagcagcgctgccttctggggggaccatgagaaagccaccgaaggccccatgctcatcccagggacactgctgccttacacaggcccctgggcatgtcctatctgagctcggggggcagaaagcgacagaggacattcttaataagatgtgatgagaaggcgctgactgttaaatggaactgatttgagacaaactgggcctttttatttttgagacagagtctcgctctgttgcccaggctggagtgcaggggtgcgatctcggctcactgcaagctctgcctcccagattcacgccattctcctgcctcagcctcccaagtcgctgggactacaggcgcccgccaccatgcccggctaatttttttgtatttttagtagagatggggtttcaccgtgttagccaggatggtctcgatcttctgacctcgtgatccgcctgcctcagcctcccaaagtcctgggattacaggcataagccaccacgcccggcccaaactggtccttttaggtcttcagactgagagatctttcccagaatacctgtgggcagctggtgcccagaagtttgggaaactccgccccagaaaccaacaagaaagagtggacgagctggatggggtgacagaagagctcttccagggaggagtttccagagattctgggcaccaactgccccctgggtattgcttagatggaaagtgccagctgggtgcggtggctcacgcctgtcatcgcagcagtttgggaggctgaggtgggcggattgcttgaacccaggagttcaagaccagcctggccaatatagtgagaccccatctctacaaaaaatacaaaaattagccaggcatggtggtgtgtgcctgtagtcccagcctcaggaggctgaagtgggaggatcacttgagctcaggatgcagaggttgcagtgaactgagatcacaccactgcactccaacctggacgatggagtgagactctgtctaaagaaaaaaaaaaaaagtgcttcattgcagggctgtttgtcaggggagaagaccacggctgaaggcagaggggctccagccctcagcaggaggagccttaagccctgggagctccttttccccttggggagaagcgggtgaccatgcctgtgttgggggcatcccgcaagctgtgagggggcaacgcgtgttgggcgtgaaggagggagagggcagtggctgtggtgcgaggtcagggatgttgggctggagggaatttgacctcatgcccgtggttcccagttacacacatatcagcttatgtgtaggtcagagtttctcaaccaggggtgatcttgccccctaggggacactgggcaatgtctgaagacttctccaggggtcacagccggagggggaggggcctaatgacatctagtgggtagaggccagcgagtctgctaatatcccacatgcgccggacagcccccaccacagaaccatctggctgcaaccgtcagcagtgtgaggtcaagagagccgggtgtctggggcctcagtctctgcctgcacctgcggggttgggggcggccctgaccctggtgggctccatgccaccctcatgctgccagtctctgctctccccacagaaccccgacatcgtcctggtgcactacctgaacgtgccggccatcgaggactgcggcaagccttgcggccccatcctctgctccatcaacaccgacaagaaggagtgggcgaaatggacgaaagaagagctcatcgggcagctgaaacccatgtgtgagtggccttggccggcctggcgcccccacgctgggaaccaggctggcatcaaccaggcggggccaggaaggtcctctgtggccttggggatgcgggtccggagccccatcttgctggaatgacagtggcaccgtgagcttagcttttgccccaccttcacttggccccttgtaagctccctatacaacagccagggcacaaaatgccaggcccacgtgacagatgaaaagagtgaggtttggagacacagagcatgtagaggaagaagcaggccaagagtgggccaggaccgggtctccggggccacagacaggagtggaggccggctggggagggaaagtatggaacaggggaggggtggcgggagcggaccctgcctcctgccttgcccatccacgtgggatctgggcttagccaccacctcctggactcagggcctgcctcggctcccaggctgggtggcaaatagatgatggtaattgagctggatttcattttgtcagcaaagtggtgctttctgaagcatctgtcaggtgcaaatcacagaatgcaaaacaccgagtgaggcagggaagctggggctgctccgtactttgttgccgtggccacagctcccggcagccgctggcggctctcagtggcttctcctgccccctgttcagcggggctcgggaaaaacaaacatgggtctggggctttcctgacccaagaagagcatgggggctgtttagtggtggacacgtagcccacggggttcagggacattgatggccagggctcagggcaaggacctgccatcagcagggcctgagggggtgggtcagtggctcactcagaagcagaactgtccctggagctgggctggagggaggaagcagctgttggtcaccatatacagcggggggactgaaatattctttctgcggctgggaggaaaggtgaaggtcctgtgcctgggagggcccaggctgaggctacgggcacctgcggtgatgctaatcctgagagtcccctgggtgctcggatttagggatctgctcccagcctcaaggttggggatgagggtcaggagggacagaggggtctgtgtggcaagggaggccccccagtgggtgacagccctgcccgccaagggcaggaccacaagactgagcttcctcacgtgtcgtcctttgagccaagtaccccgtggggaggtttggaccaggcttgcctcagtgcttctgcctggaacctcgaggcaggcagcccagggacctcctgagctcagaccacacccagtggcaaccttcttaactgcagccctgaccacatccctctctgcttaaaaccactcaatgcccattcaatgcacgctcaatgcccaagctcctgagcacagcctgcagcccccccacccgcagcccccggcctctgcaggactctgcgccctttccacctgctgtagtccccactccccagagcctgctgcctctccacctgcccctctccctggctctgcctgctcaccccacctttccctcagctctcagcctctccacaggccctcccaccacccagctgggccttcacacccctgtgccctggcctcctcgagcccccacgggggagatgtcagcttcccgcgcttcatcaggaggggcctcgtgagcctcttcaaaatgctgccgagcaccgggaagcatggggaaatggcacagctgcccttgggaagccctccggctctctgcacagtgctgggtgtgcacaaggccctggaaatagccctggaatggtgggggggaagggacctgcccagggtcctgagcagaggacagaagctgcagtgtcctggctctgggagccggggctgctgagtggcactttcccaagggcaggccagaggctaggagtctggggcaccggtgctgcgggccctgctgtcaggcccgcctgcctgccttcgtactcagtacatagggggcacctcactatgcagggctggcaccggacactgggtcctgcctagaccccgccccagggggcctactgatactttctctgccgcagagcctcagctgggccagcgctatgactgctgaccaggaatgctggtgccccctggccagggcggtagaaagagtcagggctggcaagtcaggaggcaggtgctcatcctggcttcatggctgcccctctacacagccccagaccaatgccccaccctctctgcaccccagtaccccttctataaaggggtagcaagaatctagcagcctctgccctaagaccagcacttccagccatctcagggggcccggctcagctcctccacccctgcacaccatgtccaaggggctgaggctgccagcctgtcccatttcttgggaggtggagtcactccagagggctcagcttggtcctgcagaagctgccatggctgagtgcactccaggcctgcaggaagtagcctggaacctcctttctggggcttagtcagtgctttcaaaattagggtcctaagtactcttgccttgaaagggtgaccagggtccaggtgcttctgaagctcctcccacccctcagtgtttacatttagaggggagttcctgctcaaaacaagtcttcagtcaggaggaggagttgccttcctggcctttctgagccttctgtctgcttcttcttaggtcactagaaggaattcctcttgtcagattccactggaaaatgagggcccctttgctggacagaggccccatccatatggccggggagcagccccaatcccctgggccccagcaaaagttccaagagattgtgtgagccagagattagccaaggaggttctcccaagggaaaagatgcctttcaaggtggctcctacagtcagaggctgctagcctgggccttcccaaattcttctcgacacacacagacagcccttctccttcagccatatgctccccatttttcctggagctgcccatccatcagacaggaatgccacctccaggctgggtgggaggaattaggctttatgaactccagggggtggaaaccagtccggagccagcctccaatgctgaactggagggaactgtgaatgcctgctcaaaaatctgcagtgcatcagaaaattatgtaaaactacaacaaactccccataaatctaataacactcagctctctggtgtcttgggctgggggaagcagagccgcacacaattccttggctcgggcgtgcgtgtgcacggctctgacagaaacacagcccgagaaacagccctggaaatgcggctgcaggagaaggcgcagatgacgatcaggcttggaacacacagagggcaccagctaagtgtgtgtgtccggggacagcagaggtgtgctgagagccaagaagacctcagatttgattccagaatcaggcgggtcacccaacactggagccaaacacattagcttcatcccattttcacataaatcgcgtgccttcgaagacttcacagtttgatttcctgatgtttccaaatttccctgcccgccagcggagttgtcagcggtttaatcacaatgtcgtgctccccagggctgaagggagatgggtctgcagccttcacctcacctgctgtgagatgggggctccgtgaccttatgccctgggaatctcaccaggctgattcagagaatcccatcctggtccttgcagctgtgccctttggtcagaagggggcttcccttccacctgcaatctgaggaatgcttccttcagatgaaaaaaaacacacacagaaataaatgaagatagctgataggaattcccaggacattcccagagatctttcctgtcttttggaatcccttctgtaatcatgagactatgggtcctgctgctatgaggaagaccaaaataacagtggcttcaatgaaagggaagctcctttggctttcatgtcacagttcagggttgatgtggcagccccagggtcagggatcggccaccctggctccctccgggtggctgctccccattcctagggctttgccttcttttacatggtccaaaatggctactccagctcctgccattgcaactgcattccaaccagtggaaagaggagaaaataaggtggagggtgagttccttccctttaagcccacaacttgcatacatcatttcatctctggtgtcgttggacagaattttgtcatatggttactcctagttgcaagagagtctgggaagtgtcgttttttgctttgtagttccatcctaacgtactttggggaaagaggttctgcatgtgaatcattcagggctgagtagagctgtgcttagcctggggtgcccctgtgggcttcagctttctggcttatagtgcacagaattgcccatctcagtccaaggcctggcaatgactgtctgaggcgccgtctgaggcctggagtttacagtacgcaagtgatctaaagcttagtatgtctcatcctggaaattccagggtctgttccaatgcagctggtctgagagagcaccagatttgcacccagtaaacccccatagtgtgagtgaggagctgaagggggagtcctctcctcccagattagccactgagagatgactttgagtggagtcgactgctctgccaggcaggctctgtgcttctgtcctgccaagctggcaggaaacttgctcagtgatcttgggctgctcagagccacagtggttctaaactgccatgccccaaaccttgcacccttggctccactggaacctacagaaagccagatggaaccgtttcctcggagaagatcctctccctctgagcacccgtggctttcttccctgcccatttcctggcagcccaggaggggatggcacgccaggcatttcccagcaagctgttggtgaggttgttccatccggagtgagtggcgagggcatgacttctaagctgtgttcacagcccttcccgtgtggtgatcttgtcccagctctcccacctggaggctcctcttggagtgccctggctggccagatggccctgcagccatgagcaagtcctaggccttcctgcaggcttcgaaggcccggaaatcagcaggcagctcccccagccgcctcggggtttagctccaccctgcctgccagccccagagctccgctggcatcaggccagagtactcaggcctctggggcaggtgtcctctgcagcactgggcgggcggcaggagggctggctgtggaatcagcagagccccagggcctacgcccacaccacacaagtgctctgtgcacctccatgcttctgcacgggcacacgacgtatccacaggcacgagtgtgtggggattcagcacctccacccccacacttcctccaaaagcaacctcacctccatggcaggtggtggaggccatagtaaatgtgaggccacaaaggccatgttgaaagtggaggtggaggccatcctgaatgtggggtggaggccatagtgagtgcaggtgaaggccctggtgagtttggtgggggccctggtgaattgggtggaggccatggtgagttgggtggaggccctggtaagtgtgagcggaggccccgttgaggtggatggaggccctggtgactgcaggtggaggccatggtgactgtgagggtggaggccatggtgattgtgaaggtggaggctatggtgagttgggtggaggccctgccctggtgagttggatggaggccatagtgagtgtggttggaggccacggtgagttgggtggaggccctggtgagttgggtggaggccacggtgagttgggtggaggccctggtaagttggatggaggccatagtgagtgtggttggaggccctggtgagttgggtggaggccctggtgagtgtgactggaggccctgttgaggcggatggaggccctggtgactgagggtggaggccatggtgactgtgagggtgagggccctggtgagtggttggaggccatggtaactgtgaaggtggaggctgtggtgagttgggtggaggccctggtgagttgggtggaggctctggtgggttgggaggaggtcctggtgagtgtgagcagaggccctggtgaggtagaggccctggtgactgagggtggaggccatggtgactgtgagggtgaaagtcatggtgagttgggtagaggccatggtgactgtgagggtggaggccatggtgagtggggtggaggccacagtgagttggaatggaggccctagtgagtgtgaatggaggccctgttgagttgggtggaggccctggcaagtgtgggcttgcttgtgctgtcatggcccccacagtccatctcccctaacacactggtcctcacctgcagcctgttggttttccaggggccagggtgtcagtcctgccagccttcagcatctgtaaggcagtgctgccgagacaccacaccgtttccagtaccgggcctcggatggggtggctgcaaacgggcccctcattgctgagcagtggctgcagtggcagagaaatctgctcagagcggctgcttagccagcacctgctctccagggacccagctcaggctgggagaggtcgcagagcccaggatccccagacccccagcctccctccctctgttccggaggccctcgctgttgccagtacccaagcctggggttgtatgttcagtgcgccttttgttttctcataatttttcagacaaagaccaaagatccagaaggggggggggctgtgtttatttgttttgttttttgcttagattgtaatcctggtgattatagaatatcaagaaggaaaatcaacaaagccttccttcctggggctcgcggagccgttcctggtcgaccagcgccacctggtggccagtggcagcggccccgctcggagatgggagccccagggaagcctgactccccggtccaggccacctggagcttgcaggcgggggcctgtcccacccgcgcctctggacctggtgtctgagatgtgctaggaggctgtttggggacctgctctgtaattctggagtggtggggcttggggtggggctggaactagcagcaggagaccctagggagaggtgcctgtgcccaccttttttcctctccagctcagtcgatcctgatccagtatcacctggctggctggggacggcgggctgggagctccgagcctgactaggaacaggtatccctaaggctcagccagagcccatcgaggaaggacagcagccagcctaaaagtccggacgtagtggcttacgcctgtaatcccagcactctgggtggccgaggcaggagggttacttgagcccaggagttcaagatcagcctgggcaacatggcgagaccctgtctctacaaaaaatagaaaaattagccagatgtggtggtgcacaccagtagccccagctacttgggaggctgaggtggaaggatcacttgaacctagggagttcagggctgcagtgagctgagatggcgccactgcactccagcctgggtgacagagcaagaccttgtctaaagaaaagaagagagagaagagaagagggctggacatggtggctgacacctttaatcccagcacttcgggaggctgaggcaggtagatcacctgaggtcaggagtttgagaccagcctgaccatgtggtgaaacctgtttctactaaaaatacaaaaattatctgggcatggtggcaggtgcctgtaatcacaactacttggtaggctgaggcaggagaatcacttgaacccagtaggtggaggttgcagtgagccaagatcgtgccattgtgctccagcctgggcaacagagtgagactccacctcaaaaaaaaaaaaaagagagagagaagggaagagagctgcaaaaacttttcccccatggagctacaggtgtgggcacagtaaggagtggggggatcagccccgggtgggagagagagggggtgttgttagagggactctttctggccagcagtgttcacttagaggcgtgttccagggtcactacctctgagcagagacttctgggataggagcaaatggctgaatgtcaggagtgagctcgggccccccaggccacccagttctggggctcagagggagccgagccggctgcagtcttaccctggaatccaccaaggtcccagaaagcctgagcagagacaatggttccccctcagaaccacctgggaggggctgaaaggcaggcccttccccagacattctgactccctgggtctggagtgggctccagacactgagttttttatgaagctaggttcttgtgctggggtccccaggaccatactttttaaggaaccccggcctatagcagcctctggcgagaggccagccaagagcaggaccagcacctctttgggccacaggcctcctttctcacatccaggtgcgaggagggcaggcgttggaggccacacggagcttagtgtagccacactcccagaggaagccagtccccagcatgcactaagtactgggtgtaccatttctggatgttccaggactgtgtgaggactttccgtagactctgggttaagaaatacgactctagaagtttccttgttttgcagctgaggtgttggtgccggcacatggtggagccttgccagacacttgttgacttgcacttgtgagaaaccctggagttgcataagaggaagcacatctgtgtccccacggcagcccagacagcagctcggtccctgagagcagaggcccggctccctgcctgcatctgcggggcctgggagtcatgggggaggcagcgatagcgctgggggttcctggagaggatttcctctgccttttacccttccctttgggaaggagctgctgccatgaggagcaggcagggcaggttcctggaatctccaggtgggtcccagccctcttcctggctcctgccagaatgcctgcagcccccttccaacctggcatggaggacagcagagggtgggcacggagaggctgacttgagtgtggggcttccttcctactttgctccaggatccaggtttgttttgcaaatgttggtttctcactccagctagttttatggagccgatccggcccccaaggaggactggaagagaaatactgcttttgatttcctgtctctcctggcgtcttgctgcccagggccgcttcaaggccgcatagctgcttccgtgacaggagatcccccttttgtggagtgcgcccctgtgctggtgttggggatacaggaccccaccgacgtcctgggccctgactgctatgcagagctgatgctgagccctgctaggtgccagggagtggttctgtcaaagttagaattcattgccaacattcaaatctccagattttcagcctctctttaaaaatggaaggctccaggccaggtagttgggagctcagaggcggctgctctgtggaccgagcctggcttcctgcggcgctacctccccacacaccaggaggcacctgagtccaggaggccctagagcagtcttaccaggagcaagatggaagcatccagaatcccacttggtcccccacccctctttccaagtggcctggaggggcagataaccctgaggctctgacgctgccaggcggccggcactcctagcgcactcacacttcacccacggtgcaaagaattcccagcctggtaacaatgccgcttcgcacatcaggagaagattccgagagcctcaggatggctctaaagtgccactttgtatgtcactgagcaccttggagatttcctgtgaggccagttacaggggtaaaggacatgccaccccacacgctctgtatttcctgatgatggagtcactggccgggctggaatggcgcctctccctacccctcattgacaatgtctgtcccacttgcaagaagaaagaatacgggaaggtcaagctctcaacaccctggcagtctgctggaccctccacccccgccttttccagaggacgtgtgatgttgggacgaagcccatgccccctggcagagggaggactgtgatgccccaacagcgagcaccagaaatgacaggctcactggggacacggcagataggtccccgcatgtgcacacggtgggcgcacactccatcccgtcccccctcagcctctgcgctcctcgaaatgagatttctgaaaattttgtcctcaggaccaataggcgaatgagagttgagtggtgagatcgggaaattgaatagtatgtgggtgtctggatatgagaagttaaatctaatgaaaatttcatccagttgaaccaagaaatcagaaacagggcctttattcctgtcaacaagaatacagtgaaaattaaaccaacccggctgccatttcccattgaccttgtcgccatggagacagccttctagtgtcaacaacaccgaggactccgaaggggcctcattcactccaggagaggcacgtggccgctccctctcccgtccgcctccggcacgtggttcataaggagagcagccacacgtccagggttgctggagagcaacccagcctataccagcacctggacaaatgaccacagcaccctttgttggctcccaaggtgacctggcttgactagttaaatggccaccctctttctgggtctttcttgggtggcagggtacctaggtgggtggactggacgagcccagatggaggaggaggacagggccccccacagccctccagaaaaggacactgcccctcgtccttgccacctgctcatcacagcacccagaaatctcttctcatgcaaaggaaggccaagcgtcgattccagcaggtgccgcctgtacagttaccatggtgaccaaagctccaggtggccttgccctgtcatccttccaagagttactgccccacagagcagaggggacaggtagctggttctcacccgttccaggagccaccaggggctgaggcagacttctggagttctctctgtctcctcgtccaattcctttccaaagtcttccaggcaggactgcggagcagagagcttcccctcttgtgaggctttccaccctggcctgggcagatctcctgtggatgccatcacatcagaatccaggggtggggccacctacctggatagggcccagtggcatacagtcaggtgaactggcaagaggcaaccactttccagatgaagaaactaagatccagaggaaacaaagatcttgttctaagatcacacagtgcatgagggaaacagctgcggccacatgggggccccgaccccaggccagcacggtgctgccacccggtctcccactgtttctaaattctcgcctcttcttcccacatagccagcacagggcatcgcacttggaggttttccctgccctttgggaaagccccaccactgcatgggacagccatgtcaggaatgaaagacagccaagacgaagctgcccctcagccccctgccatccctcagggggtcccctcccacccccaccataccccaaatgaggaggccctgtcgtggagccaagcattgcccccacacatcctgtaccgtctggaatgaacccttcttagcttctttgggtttttatagaaattccccccaaatgcacctctaaccaggcacaaagcctgctgccgtgacaagaccagcacatgcctcagggaagccccagctcccaggcttggatgcagcgttgctgagatgtcctccttgcagcagcctcccaggttttcttcccccttcctctcctgcttgctctgattttccaagagcaagtccccatcaggccctgcctcccagttcctcccgtgggaggctcaaggacgagtttcttctgccctggtctgggtggcttggccagatgagtgacagctgacctgaccccgaagtgaggaaatcccaagtggggagccagggactcgggagcttctgcccactaaggccccagccagcaaggcctggcccctctgagacagcccagcatctgcgaagtcagggagggcaggagacgaagctgggcatcagcttgggatgacagcatgtggtccagcaccaggaccctgagtttcctgcacagtcaccagcccctggtgaaggggccgagggaaaccagacttccctccaggaagtgaagtgagtcttgctgctcacggccagcaccctctacctccagatggggtcgcttttctcctctgcccaccaccgagctgctgtccagtcttcctcacctcctcctaggagctggtcctggcagagctgaaagccaggcaggtcgcccagtggaaagagcttgaatctgcagcccctcctcaccccctacgcacctgctgtgtgaccttgggcaagttacataacttctctgagtctcggttttggcattaataaaatgggataatatattctgcctcaagggatcactgggaggttaaagatgtcatctctagacctgagcttctcaaacttgagtgtgcctcgaaggcctattaggacgtggatgctgggccccaaaccccagcgtttctaattctgcaggttggggcggggcctgagaatgtgcgtttctaacaagtgtcaggtgattctagtgctgcgggggccacactttgagaaccactgctccacaggagagtgtctggccccgtgccctgcccacagcagaggctcagtggagtacatagtattgttattatttttttccccttctttttttgagacagggcctcactctgtcacccaggctggagtgcagtggcccgatcacagctcactgtagcctcgacctccctgggctcaggtgatcctcctgcctccgcctcccatgtagctgggattacaggtgcccaccaccacaccagactaatgtttttattttttgtagagactgggtctcgccattttgccaaggctggtctcaaactcctgggctcaagtgatccaccctccccagcctcccaaagtgctggcatgagccaccacacctggccttgttctttttttctttttggagtcaacatatgaagatgctcacatactgcctggcatggaggatatgtccaataactatcattgtttttgttgttattactgagacatgagctctgcttatagctcactgagggaaatgatgaaccaattaaaaaaaaaagtgctagggagggcatgattgagaaattggccattcactcattcactctaccagcctttattaagcatctactatgtgccaggcattgttctgaggatgggagatgagcagtgaacagcttggcaaggcctgccctcaggatccaaactccagctcctagggacaggcatgagcagccaggaaggctattgtgatttctatacccatagttctcaaactggagcatgcatttgaattcccacgagggccccttaggacacaggtgctgggccccatcctgagtctgtgattcggtgggtttggggagggcctgagaatgagccagaggcgggggcttgagctgggctgtgctggaaagaagggtggcatttaaagtggtagaagggctaggcgtggtggctcacacctgtaatccctgcacttcaggaggccgaggtgggtgtatcacttgaggtcaggagttcaagaccagcctgaccaccatgctgaaaccctgtctctactaaaaatacaaaacttagccaggcgtggtggcgcacacctgtagtccagctactcaggaggctgaggcatgagaattgcttgaacccaagggtcggaggttgcagtgagctcagattgcaccactgcactccagcctgggtgacagagtgagaccctgtctcaaaaaataaataaataaatatattaaaaataaagtggtagaggagagaggcattctggaaagcccctgatgtcagaaccccttgaactgtacacacacacacccctatacatacacacacctatacacacatacactcctatacacacaaacacacccatctatacacacaccggcacacacctatacacacacacctatacatacacacagctatacacacacactcctatacacacaaacacacccatctatacacacacaagcacacacctatacacacacacctatacacacactccatgcacacaaacacccctatacacacaaacacacccacctatacacacacccacacacctatacacacacatatacaaacacacccacctaaacacacacctatacccacacacctatacacacacccacacacaccacacacacccctatacacacgaacacacccacctgtacacatacccacctatacacacacatctatacacacaaatacatctatacacccacaaacacacccatctatacacacacaagcacacacctatacacacacaaacacacccacctatacacacacacctatacacacacccacacacacctatacacacacccctatatacacaaacacacccacctatacacacacctatacaaacacacccacctatacacacacacccacctatacacacacacctatacacacacctatacacacacctctatacacacaaacccacctatacacacacctatacacacccacacacacctatacacaaacacacacccctatacacacaaacacacccatctatacacacacacacctatacacacacacctatacacacagacccacctatacacaccgttatacacacacacacctatacacacacaccgttatacacacctatacacacaaacccacctatacacacacccttaaacaaacacacccacctatacacacacacgtatgcacacaaatacacccacctatacacacacacctatccacatacacaacctatacacacatacctatacacaaacacacccacctatacaaacacacacctatacaacacacatacacacacctatgtacacacccacacacatacacactgatatgcacacctatacacacaaacacacccacctacacacacaaacacccctatacacacacctatacacacccacacacctatacacacacctatacacacactacacacccacacacctatgcacacacactgatacacacctatacacacacacctatacacacatctatatacacatacaccgatacacccacacctatacacacacctatatgtacaaacacctatacacgcgcacctgtacacacacacgtgtgcagtgcatagagcagggttggtgtggacctttagccacagagcctgaggatgggggaggcctgagcccccatgcggggtgtgttatttagcctgctgtggtttgaatgttttcctccgaaactcatgttgaaattgaattcccagtgcaactgtgtctggaggtggggccccatgggagggattaaactgctttacttagggtttctgggaatggattctttttcttcgcccttccaccatgcaatgacctagcaagaaggccctcaccaggcactggcagcttgatattggacttcccagcctccaaaactataagccaatacacttgtgttctttatgaatttcccagtctgtggtattctgttgtagcagcacaaaaaagacgaagactaaaacactgccctcacagtgtgccacagactggcggcttaaacaacagaaattgatcgtctcacagtctgcaggctggaagtccaagattaaggggacattggggttggtttctggtagggcctctcttcctgggttgcagacagccaccttctcactgcttcctcatataaccatctatctaggcataggcactcctggtgtctcctcctctacttataaggacaccagtcctgctgggatagggtcccacccatgtgacctcacttaaccgtaattacctccttaaaagtctgtttccaaatacagtcacattggtggttagggcttcaacctatggatttggtgggggacacaattcagttcatgacagaggaaaataggacggccctaccgtggctcaggcttagcctgtgtagctgaagctctccgccgcttcccaagggcatgggatggagcagctgcaacccaagaggctctcggctggcagcctgccccatgtggggtgaagcccccacgccttcccccagccctctcttctagatctcaattactcttttcccagcggttggccgcctcttgggtaaattgttcatcagaagatgctctccaaagcatgggccacacgctgttgtcattgatttcattttgattattcatattagtggaagcgctgctgccttgccaggggccataattagggtaaacatcttgtacgagggctaggtcagcattggagtgggccctgggttcctgcgacggccactcccagcctcggctctgcaagccgatcctcacacaggccgcgctgcaggcagccctgtccgcgagaatgcagtccccggcctgtgtttcacggggcagccgcagggcttctcgggtagctgtaggaggacacctttcgaggagccagcatcctgcttcccagtggccagtgtgaccatcctgcctgcccctgtcttgtggagccccatgctggggtctggcttatcccaccccatgccagccctttcttctctctggtacttcccctgacccagccttcctagggatacaggtctctctccaccacctgagcagaccagggaccaccaccaaggctccaactatggggagctgcagagagggtccctctgtctgggattcagctcaggccattctgcctgagaacggggagtcaggtaccgcccggtgaggtacagtgagcaggaggggacagatgtgacccagagccaccaggacattacctttctgggaattcctctttctgtgcctcctcccttacaagacatgtcatgaccttacatgtcatgggaggtcacgtgatcaagtgtacttttaacgcggtttcccttttgctgctttaaaaaggggaaggggccgagggggcggccggcatgcgtggctattaaccttcctttcataaagcgctttttccctatagaaatctcccttcccactgattcattccgtgttgggaagcagagcatgacatgttaaaagccgtcttgatactatttgatattcagtgctaacaactcaccacctcagaggaggggcttttctccacccacccacccccaacaccagagcaaggagggagacaatctgcatattggatgtgccaagacagtaggtaatttgcattaagcatctagaaactctctgcttgcaatctgtcacccttcactgggtcttcattttataaccttcacaacataaggaggagaacaagaggcagagagaatgcggctgccgcacccccatcaggactggaggagaaacctggcctgatcggcggttgtcagagcagaggggaccctgatctgaaatgccaggagactctgccagccaggggattcaaaagcctcactgtgccaagacccaagaccctcaagtggggtgtagcctgaaggccgaagccagaggtggggctgccctgaaaacagctcatctccacagacagccaagttcaaattcagcagggatcttcccagagaacatgtggcctggcttggcaaggggcacctgctccgagttcccacagggagaggctcccgtgatgagctctgcagggctttctgctcttggacttgcagttccctgctgagtttaagcttaggacagagctgcgtgttctcccatcctaacagcatgtgagacagagctgcgtgttctcccatcctaacggcacgtgaggagcctctgcagagctctaaaaaaaatacctggcaccaccccagaccaatgacatcagaatctcctatctagggcctgggtacagccagagtaggggacccacagctggaacagaccactgcctgtgcagcggtacagaggagagtctcaaatcctgccctgtggcctctggaatgtgatttgggctgtcacctcccctcctgagcctctgttttcttatctgtaaaatgagtctggaaatgtctgtaagccaaggagtgccctgggcatagggacaggccagagagcctgtgacccctcatcttgcctccaccaggtcctttctgcagtaatctgtcttctgtattgaatttcttggtagaggtttatttaagaaaagggtcccatagctatgatgaggtttaaaaagcccctgacccgggccttccctccagctgtcagggacaaggtgcttagggggatgctggagaattcctccagggagcccaagatgaaagcactgtccacctgaagaaaagtgggctgtcaatgctgccacctgcctgcctgcgcctatcacatgttcgccgatcacaagttctgaacatggcggcttggcaaacaggtgccactcagccccacccatcccccttagtgacccaccagaatcccaggccccctgagaataagtgaagatgcaggaggcagagggtgctgcagacctcagaggagcctcttcagagtgaagcagaggggaaggaaagggagcggacacccgggtcaggcgacagcacacacagagaaggaaagcagcaccctgaaggtattcctgccagatcccaagcctcacacatgggtgatttcctttgaaaaactatcagaggctgggcgtggtggctcacgcctgtaatcccagcactttgggaggccaaaggggggtggatcacaaggtcaggagttcaagaccagcctggccaatatggtgaaaccccatctctactaaaaatacaaaaattagccaggcccggtggcaggcgcctgtaatcccagctattcaggaggctgaggcagaagaatcgcttgaactcaggaggcagaggttgcagtgaaccgagatcgtgccactgcactccagcctgggcaacagagcgagactctgtctcaaaaaaaagaagaagaaaagaaaaaccatcagagttataattaaagggagagctctacacccaggaacagaggcttgagatgaatggccaccacagagatctacccgcagtgttccggggctgagccatctgtggatttcacagcaagaagcttcctgccacaagcccagtccccatagcatcggccaggccccaggcagggccagcactgcctgctgggtgtcacagtcattactgtcatcaccatcatcactagtgatgttatgacaacagctaccctttttttgggtatgcacaaagtgccaggcacgtagatcgtgttttctcctggccagttctccaggcaggaactactatatgcccactttacaagtgaggaaactgaggctcagagaggctaagtgacttgcccaaatccacacagcaagatcaaaacctagactcagaccaggtacacacctataatatcagcactttgggaggccatgagttccaaaccagcctgggtaacatagtgagatccttgtctctacaaataattttgttttgttttgttttgagacagagttttgctctcattccccaggctggagtgcaatggtgcaatctcggctcactgcaacctctgcctcccagacgattcttttgcctcagccccccaggtagctgggattacaggcatgtgccaccacgcccagctaattttgtatttttggtagagacgggtttcaccatgttggtcaggctggtctcaaactcctgacctcaggtgatccgcccactttggccttccaaagtattaggattataggtgtgagccactgcgcctggcctctacaaataatttttttttaaatatccaagtgtagtgacacatgcctatagtcccagctactcaggaggctgaggcgggaggatcacttgaacccacgaggccgagtctacagtgagtcgtgtttataccacagcactccagcctgagcaacagagtgacacctgtttcaaaaaaaataaataagtaaaacttggactcaaatccatgtctgaaccgagccagctcctacctgccatgtcgacgctctccttgtccccctaccttctagagcccttcacagaactggggccagtgctgcgagggttagcggctgtccccctggagctggtgggagaggagcttcagccaaaggaggaaggacattgctcttgtatcgataaagccactgacctctccgtatctcgaccctgtgcccggctcctccgcgcctggatccccagcaccagctccagccccaaagctgcgaatccactgcctctgagcctggccccactagagacagctggattgctccatgtgccggactcaggacttagcgaccccttggccgggtctgctccagctgagaaaactgctctgctggaaaagtcggtttagacttccagcccccatcctgccaggcaggtggggaaaccccaatcccaactccaggaactgcaaaagtgcagggaggaaggttgagcccagctcccggggtggctgttcagatggctgccatcagtcagcactgggcactgagctacctgatgtccaggccacgtgggcccttcagtcccgtccccatctcccctggcctctcctgcatctgcactccctttggggcaaagaagtctggtgagggcaggaagccagagtcttaccccccagggtggggccacctccccacacactcctgggagaggcattggtcctcccggctcggtgcttgttggtccaccacctctatcctgagtctccacaagaagctcacaggctgggaagtccctcagcctcctgtccactctccttctgtccttgttccctttctcttccattccagcacccctggaagagccgcctcgtgcactctgactttagggaaacaaaagcagaactctatgcggtccactccctgggctgcaccatagtgagggggagctaaagagctcagaacccccgatgggagcagggggtctggcgggggcagcctggcctcccttcccctcctcctcccctactcatcaattcgccccaggagccagctccccagcagtgagagggctgccctcagggagggcctgggtcctaccccttggccccacccaggtcccctctgcacccacgggctctgacagcccccctgcctctctcttcacagtccatggcatcaagtggacctgcagcaatgggaacagcagctcaggcttctcggtggaacagctggtgcagcagatcctcgacagccaccagaccaagccccagccgcggacccacaactgcctctgcaccggcagcctgggtgagccggggctcccggggcaggcgggcgccacggggacagaggggccctaccaggcagccgtcatggctgtcctctgtgggagtagccatgacatctagtgagggaggagggggacagtcagggactgggcgacaccaccgcacccagcacagacacaaggcaggccttccgcctcgtcctgccctgcaactggctggcagtccgctctgggcaggagggagcagtgtccagagggacagcttcctccgtggggcaagaactgggggcagcagagttggggaagcgaggagctctggggctcggggcctctctgttcaggcccacactcttgggcatcctctgccagagggcactggggtcttgagggagacgtgccctgcgtcagtgacaccacgcaggcgcaacctctttctttaacctctgtctcctccaagaacatgaagcgtcccgcgctctccttcctaatgtgtctgtttttctgataatggtatttgctctttgaaatgtgtgttctccactccccaggctgacttaattagatagtcccattagagggtcgtgtcacttctctacgcagtcttggtgcattgaggagtcttggtggtgaggccataacaggatcagggagaatttgccctttcatcaaaagtaaagtgacccttatcagatgaaatgaaaatggtgaaaatatccaatgggagggagagaaaagccgtcctggctgccggggctggaggagctgccagggaggctttgccaagctcagaaacgttcggctcctgaggcttgtacgtctgaaatgaggagcaagggctctgtccctacttaggacctagaaggatttttgtaccccagagagctgagggtaggcctgggcttaggtacctttccgcctctggagcagggtcgagaaccctctttggtcctggggcctgagagctggtcccgagactgcatttccatcacctccccattgacctctggttgccaggccccaggggtggctcctcactggggcatggcctgagcagctgtgggaagttggggaggggaggtggggcaggatacgaacgtagccactctcaccaggctgatcccctcttgccagcaaaagcccttccagatgagtggtatctgtctctgatggcggaggggactttcctgggtgttgacattctctccaccttctccttcccaacttcccatatgcttcctatttgaaaagagcatcaaggccaaagcccctctgatctttggaggagggtcaaaggggcgtgggacggcccccgggcttggggtacgtgtccaagggctgagagtctgtggcctgcctggggtaccgggcctggactttgccagggaccccagccgctgtggggcaggtccaccacggtcctagctctgactctcttttgtgtgtgcatgtgtgtgtgcacatgtgtgcctgcgtgtgcgtgcgcgtgttgtgttccgatctccgcaggagctggcggcagcgtgcatcacaagtgtaacagcgccaaacaccgcatcatctcgcccaaggtggagccacggacaggggggtacgggagccactcggaggtgcagcacaatgacgtgtcggagggcaagcacgagcacagccacagcaagggctccagccgtgagaagaggaacggcaaggtggccaagcccgtgctcctgcaccagagcagcaccgaggtctcctccaccaaccaggtggaagtccccgacaccacccagagctcccctgtgtccatcagcagcgggctcaacagcgacccggacatggtggacagcccggtggtcacaggtgtgtccggtatggcggtggcctctgtgatggggagcttgtcccagagcgccacggtgttcatgtcagaggtcaccaatgaggccgtgtacaccatgtcccccaccgctggccccaaccaccacctcctctcacctgacgcctctcagggcctcgtcctggccgtgagctctgatggccacaagttcgcctttcccaccacgggcagctcggagagcctgtccatgctgcccaccaacgtgtccgaagagctggtcctctccaccaccctcgacggtggccggaagattccagaaaccaccatgaactttgaccccgactgtttccttaataacccaaagcagggccagacgtacgggggtggaggcctgaaagccgagatggtcagctccaacatccggcactcgccacccggggagcggagcttcagctttaccaccgtcctcaccaaggagatcaagaccgaggacacctccttcgagcagcagatggccaaagaagcgtactcctcctccgcggcggctgtggcagccagctccctcaccctgaccgccggctccagcctcctgccgtcgggcggcggcctgagtcccagcaccaccctggagcagatggacttcagcgccatcgactccaacaaggactacacgtccagcttcagccagacgggccacagcccccacatccaccagaccccctccccgagcttcttcctgcaggacgccagcaaacccctccccgtcgagcagaacacccacagcagcctgagtgactctgggggcaccttcgtgatgcccacggtgaaaacggaggcctcgtcccaaaccagctcctgcagcggtcacgtggagacgcggatcgagtccacttcctccctccacctcatgcagttccaggccaacttccaggccatgacggcagaaggggaggtcaccatggagacctcgcaggcggcggaagggagcgaggtcctgctcaagtctggggagctgcaggcttgcagctctgagcactacctgcagccggagaccaacggggtaatccgaagcgccggcggcgtccccatcctcccgggcaacgtggtgcagggactctaccccgtggcccagcccagcctcggcaacgcctccaacatggagctcagcctggaccactttgacatctccttcagcaaccagttctccgacctgatcaacgacttcatctccgtggaggggggcagcagcaccatctatgggcaccagctggtgtcgggggacagcacggcgctctcacagtcagaggacggggcgcgggcccccttcacccaggcagagatgtgcctcccctgctgtagcccccagcagggtagcctgcagctgagcagctcggagggcggggccagcaccatggcctacatgcacgtcgccgaggtggtctcggccgcctcggcccagggcaccctaggcatgctgcagcagagcggacgggtgttcatggtgaccgactactccccagagtggtcttacccagaggtaagctgccgccgctgccaccacctgtcacctcccctcccacccacctcgccagcccctgcgccaccctgcagctaagggatgcctgtggctgcccttcagaggaagctctggaccacaaagatgatgctttcccctccttgtgtccccacggcgcttgaacacctccgtctttcacgcagtggttctcaaacttcactggggcaagtagctttaaagtcagggggtctttggccgggtgccatggctcaaacctgtaatcccagaactttgggaggccgaggcaggaggatcatctgagccaaggagttccaaaccaacctgggcaacgtagtgagaactggtttcaacaaaatattaaaaaaataagccaggtgtggtggggcctgcctatggtcccagctattctggaggctgagtccggaggagcacttgagcccaagaggttgaggctgcagtgagctgtggttgtaccactgcactccagtccggatgacagagtgaaaccctgtctcaaaaaaaaagagagaaagtcagggtatccttggaagcaaaatgctcccccagctccagccagagtcgtctgccgtttctcaatttatgtgttgagtccatctatgttttgctttgctttttttttgaaaaggggtcccagggttgcttaaaaaaattcaaaagtcaccattggccgggctcagtggctcatgcccataatcccagcactttgggaggccaaggtgggtggatcacctgaggtcaggagttcgagactagcctggccaacatggtgaaaccccgtctctactaaaaatacaaaaaattaactgggcgtagtggcacgtgcctgtaatcccagctactcgggaggctgaggcaggagaatcgcttgaacccgggaggtggaggttgcagtgagtcgagatcacgccactgcactccagcctgggcgacaagaatgaaactgtcttaaaaaaaaaaaaaagaaagaaaaagtcaccatcatagatcgtctacatccactgccttcaccctacttctctaagccaaacaaaaccaaaaaccaaaaatctctctcaaaactgaacagggcacagcttctgaagagtcatcctgaagatccttcttaagtaaacctggccttctgcaaaattccacacaggtcataggacgcaggattccaacgtgcaccctcccccagcccccaggccgcctcagctcccggggatctgactttgagaaccactactccaaagaccaaagcatcttgcctgagggacacaagcagtagaggaatctctgctttttctgtagagcagaatagcacaggaaggggacagagtggcccaggctttccctaaataacctagtgcagacaagcacgtgcatcctgacctctacccagcccatctgggtgctcagggaccagcacatgcaccacgggccctgattggacactgcctgggaggtggctgcccacggcccactcggctggagaacaccaaagaagggggctcatacttcctcacccttcttccccgctggcaaagctaagaaaatctgtgtacagacacccccagctctcccatccccgataggaagagcccggaaggatcagactgggcttcctcttggtataggttggtgtgaccgtgtttctgacccccctgctgttgttgttttgttttgttttgttttgttttgtttttgagaaggaatttcactctttttgcccaggctggagtgcaatggcgccatctcggctcactgaaacctccgcctcccaggttcaagcgattctcctgcctcagcctgccgagtagctggggttacagacacaccctgctgcatccagctaatttttgtatttttagtagagacggggtttcaccatgtttcccaggctggtcttgacctcctggcctccagtgatccgcccacctcagcctcccaaagtgctgggatttcgggcatgagccaccacacccggccctgacctcctaatcttatcagtgactctgagctcaatggcaccttcggagtgcccaccacaccccccaccccaccccatgaaggccagttgggcatcttccccgtgccccctgaccctgggcttaagaaagcgatgcaaagggacagggaggaggccaggatcagggtgcggggggacggtcagagctgtcttctggtcctggctccttgagacctgactctctggggctcagtttccttacgtgtaaatggctgagagggggtggcctcgaggcactcccagtcctaggacctgggagatttggtcctcgggacacttagaggcgccctggagcccttaatgtcttgcagaagccaggaggtgggaggagggtcccctcttttcccgaggtcctggcctgtcagacaggccctgggctgggtgcagacccacaccccagcctcctgggtgtcctggcgagtgggacattagcaggcctgactccttctgtcctttctgggcctgcagttcagcagctcgccacacgagggcggcccaggaacaggaacgcaatggcagcctggcagcctggcagcccagcagagggagcggccagccttgcttttccagaagccctcaatgcttccagttacccacaaccaaaagctgctgaaattcagcttgatttggaaaatgcgcataagccacccagctaggccctttggggccccacctggccacacagtgaggcctcagaggttgtgaagggccccttcctccttgctgtcctctcctacccaggccactgtctccacaccacagcaggggtgcccccatcctgggttctacaggagagagcaccttctctcttgacacttctctccctttgtctggccctcgtcctgtcccctccctgccagcctgtctgtgcactgactgcatcaggagtccaatctggccaggttctgccaagctcagggagggctctacaggcaggctcgtcggcctgggccctacttcccagtctgcaaaatggggtttggctaaacggttactcagcacccccacccagctctaaacctcaatgcatctacctagcaggaatgcgatggccggggccatcctgctgtctcttctctgagtggccctccctcccacaggctgctcccatttctcctatctctgtccaccccttcacctccagctgcagctggtcaccaacacacacacacacacacacacacacacacacacacacacacacccaccacacaccccagaggcgtccccctatgccccagcatctgccctggctgcatcagacatgggccctttatctcaggactcagagacctcagatggcatttcgtgccccctccccacccccaaaaccctcctgcgtcatctcccaccactgacactcctgctgcagcagcagaagagcctgcaattacagcctcaggcacgcgcgtcaccaccagttcagcgcagccaggcgggctgttgccatgggaaccatcccttgaatggatggatgctgagctgtcctgcggcggtttccatggagaaggtcctgatgttctccagtaatttctgcagttctttgttcccggcagcagccccagcctcatgctagcagctgttgattgcggttattattttttccctttttctcacatggtaactgtctgtggccttttgaagtcactgctcttccacttcccaggatcctgggggatggtgccctgagctggccttctggtgcttccagacatcccaaagtcaggctccacctgtccgccggcactcttctcagccaggcacccactccccccaatgccccgccacttccacggagctgcaaatatccctgggcatcagaacaagggatgctgtggtcagaagggcccctagcaaggagatgccacccagagaggctgggccacttgcctgaggacacacagctactgaggcgcaggagcaggcctcctgcttttgtttctcggtcctgagctctctctgctgccgtagcagtaaagtgacctcccaggccagagccaggctcatgcaagagcaggggtggaatatgctttccagcctgggagagccccttccgtggaagaagtctcttttcctggctgggcaatgggaggagctacttccacctcatccctggaaacactcactcctgctgcagatgccctgggccaggcctgggttccaggaacattgtggggcgcctagggcaggctccttgtagaggccggggcttcctccagggcaggggtgggccagggcccaggagaggccaagcaagaatgagtgactgaccagtagggagcatctggttggcacggagttggggggtagggaatcacttctctggcctggagcagtggggaaggtgggctcacagcagctcctcacccccacctcccaggctccagcctgcctggcggccttctccagcctggacactaggtggtgctctccgccctgacctagcagctctccgccccactgcagggaaaggtgtttactggtttgggggtggggtggatggcgcctctggggtgggtccacccaaggttagccaggagagtccgggaggccggcacccctaccttcctcatccccagggagagcctccctctactcagtgaccagcccctctcctcggctaagccgtaagtaggggacctccaaggtgccgtccacctcgcacctccctctctcatcactaagcaggacaatggccatgaagcaggactgcccgggccccggacatgaggccaccctcctcctccactttctgcagcagccccaggctggtcggaacggggagtcagggagtaccccagcccttccgatgctctcctgcccctgggcgccctgggaggttcctgagggtggggtcctcccccctggagctgaggaaggtcattcgaggctgctcccagccaggctgcatggtcactgcttgcttgtgggaccccaggctagctgtgtaggcagtgacacagactcaaggacctttgatagcacagggttgggggagggggcagatgctcagccccgttccactcccagccccaagctctgagccccaaactcagctcccagggcagtctctgagcgtctccttcacttagctcctttagctcctctgtttcttcatcgggctcttcagcccgtcctgctccagcccctcaccttgccatccccacagcctggggatcctgggtctctcctcaactccctacaagaacttctggtccctgggctgacacggagatgctcaggcctgttttcaaaacttggagttccctcagtctgtccacaagtgaatgacggagcaagtcccctccctgccctcggcttccttccaggccatttctcaggggcatcgtaggctgaaagggtttgcaaaactctgcactccctcctgcctggatctgcgagttacacaaaagggagaaggtcaggggttggagctgccggtcctggggcttcctgaggggctggggaaggagcgccttgggctctcctcttgctgtagtcctggagctgtggttctcagaagtcggggctcactgcaatccctggagtgagggcctgggaatctgcatggggcgaggggtacagacccccatctgagcagtgaagcctcaggggggcttccccatgctgcctcccacagtggctcacactccaactctgttcccctctctgttctctgcagggaggagtgaaggtcctcatcacaggcccgtggcaagaagccagcaataactacagctgcctgtttgaccagatctcagtgcctgcatccctgattcagcctggggtgctgcgctgctactgcccaggtgagaaagccgccccccaggcccccaaggtgagtgtgatggcctgaggagcactggactcggagttggccttggggtgaccttgagcaggtcatgtccttactctaggcctcagtttcctcggctgtgaagaagcggatccccgatagtctattagaacgtcacctcctttggctcagggacctaatataggacagggacacaggcacgcttgactgggattttgaagcgaatgtgatgagagcacgatttagggcaggaataagccaggcccaggcgatgtatccaggactggccacagtgggaagcggccaccaccctcagcccaaagggtgactagagctggtaagagctggggccagagaccacctctgcagcaaggcggcctctctgcacctgcccgtgcctcccatggcccaagccaaccagaagccaggagagcccaggcaatgcagcccacacacaggctccatcctcccgagggccctgggcagggggcagaaggctggagaaagcctggcaggggcggagggagatggggtggtgatgggaggtcaatctaacaataatcagcacaaatgcctttgagaatgtaaaacagagccatctaccctgtgcccagaaaaggtgcatataatttgcttccaatttcaggggctcaaaaatcccccaagaaacccttgggacagcctctgtgctgtccctgtgcctctgaagcccttccccaggctccagcattatctgcttagcacggtgtccctgtctggtcaacttgtcattgatctctggccatcactgcttccccactcgcctgtcccatggggtcagggactatcttcttgatcaccatagtatccccggggctggcagagtgccggacatgtcacagagggggatggagattgtgacggaatgaatgagtctccaggcatctgaagcctgtttctagagctcatgtcttctgctcctgggctgttgctggcaggactcccttggctgccccatctcatcaccaccagccctcaggatggcctgtccagtgagccctgaccataaacaggaggggggtaaggatgcaggggtgcggaacggcagggagacccacccctgtcctctaacgtcagggagcctagaaaggagagaagatgctcagtgtagaagactgggggtgaggaggaaaggtacggggtgggagtacagagctggccagtgctaggcaggccccagggtgtttctaggttccacccaaggtggtccagcctgagccttggctgccccagctgtctgccaccaccaccccacccttgaaccatgcccccaggctgggccagctgagtcccaccacccatttctccttttctccttctctctcaggctcttctttttgttggtttttttgttttgagatggagtctcactcttttgccaggctggagtgcagtgatgcaatctcggctcactgcaacctctgtttcctgggttcaagtgattctcttgcctcagcctccctggtacctgggactataggcttgtgccaccacacccagctaatttttgtacttttagtagagatggagtttcaccatgttggccaggctggtctcgaactcctgacgcaagtgatccgcccaccttggcctcccaaagtgctgggattacaggggtgagccactgtgccccatctctctcaggctcttcttgcagccaccagagcagaaaacccctgctccacagctggctgcacactccgcctctgcttgaacccagcaccatcttccccaaaaagttcccaggagccagtgcagcagcccaaggtgcccaccccaccccctgctggcccagccctcccctcccagcccccacctgcctggctccagaaggcccacctagctgccctgctcggcctggagcacagccagccggggtggcagccaggccgggtctgcctatcacagctcagggctgtgtgcagctgatgggaccccggcccggcgggagtggcggggagggcactgtggaattaaacagtgcacccatcatctgctgccagaatgcgacttgcctggcctataaatagatgccacttcctgtacctggttctcgcctggctaaggaccagggcagggctgcttaggtctgctctcagttatctgacccctctacagaaaaagaaaggctgggctttgtgtggccccggggctggagtcagccacactcgggtccatcccagatcagccagaaaccatccctgttgctggagctcagtgcctgacctctctgggcctcagtttctacagctctgaaaactgcctgccagcagggcgagagcagtgagtgagaggaggtgtgtgaagcacctggcccagtgctccattcctgaagggttcccattaaggaggccttcgctcttcctttcccaagggggagttcggagagggtaccagggcagtttgggtctcaacaggcagttctcctggtcctggggcatttctgggtccccagagatggcaggtagagtctctgcccaggccactcaccctcctagctgttcaggctcattatatgagccataatgtgtctcggaccaagggaccaggagccacaaggctcaaggcacactgagagctgggactcccctgctagagccagcactctgtcttcagctaactccacaaagggggcctcctttggacatctctgctttgaggcccaaattggaacacattgctctgtaaaacagcactggatgtattaattcattcattcatttcttcatttgccaaataacttttgagtagcccctgcttgctctgcacagagtaggggcctggaatggagcaaacaataagacccagcttctcaccgggcccctgatcgtaaggggctctcggtccagggaggagtgcagtgcgcaaatgaatcactgctccggagatgacgctggctgcttggggacctcatctttgggtctccccagaggaatctgaggctgagctcgaaggatgaacacttggaagtcagaatcaaactggcctcaccaaaaagagaggctcagaggcttatgagcacaagccaggaacgacacgggaggagggggcactggcaacacagttggccaatgcccacccgtctcccaacacacctgcccaagcaaaacagatgagcagggtcctgccctggcagctcccacaccgtcacaggtggcaggagacacgcaggcactgagtgtgtcttctgcaagactccagggtgcttcaggggcaggagggagcccaccaagttagggcagtgagctgagggcagtgagcagcagtgagtgagaggaggtgctggggaaaagaggcgactcaggcttgggagaagataggggaatccaccaagaagactctactggccagagagccctactctggattcctaagaggtcaccagaacacaaaagatgaaattcaaaatgaaagccaggcacagtggctcatgcctgtaatcctagcatgttgggaggccgaggcgggcggatcacttgaagtcaggagttcgagaccagcctgaccgacatggtgaaaccccgtctctactaaaaatacaaaaattagctgggcgtggtggcaggcacctgtaagctagtagggaggctgaggcaggagaatcacctgaacctggcaggtggaggttgcagtgagccaagatcacgccactgcactccagcctggaagacagagtaagactctgtctcaaaaaaacaaaaagcaaacaaacaaacaaaaacaacaaatgaggtgtagaattgggtttcaaaacaattcattcaacaaatagttactgagccgccataacatcctgggcactgaccttggcactaggcatgaagattaagacagagccagtcccagctctcatgagctaatgttctactgcagggagacagaaaacaaacaaggagaaaaagaaataaccaagataactggtgaaaactgtatcccagcagtagaatatggtaataaggtcacctgggaagaaggaggttccttctggaacatggatgagcagaggcctctcgcagactgggacctggatgatgggatggagccagtcatgggaagtgggagaagcatccaggccaggtagagggtaggggaagtgcaaaggccctggggcagaaagaggtttggcaacgtggagaatctaaagcctgagaaaggcactggctgcaggatagtgagtggggtacggggagctgaatacagtaagactggagatgatagcaggaactaaaataaatcgtgtccatctttctgcatcataggaaggagtttggtttgatgttacttgcaatgggaggctgttagctttaagcagggagtggcttgatctaaatgatgtctttaaagatgattctgggtgtgtgggaaagatgattctaggttgtagggaggaagaacagaagcagggagaccataggaagaaggcagagggctgatctttccagatgtaaggagaagggctcccttgggcaccacactccccctggtttcctgtaggggtgctgggctgtggcccccggtgctggattatgggcctcccgacaccctcccagcaggagcgggtctcaggtgcgctgatgttgccttcgacaggaggctaatgaaggggtctaggcaacaaatgatggcggcatggactacagcatctgcagtggagatggagagcaatggatggacccaggacttgctgatggactgcatgagcggggaagggaagagcgagtccaggaagcttcctgggtgatggaactgcaggagcagggctgctgggctgggaccccggagaccacagtaggtcccctctgctccgtctctctgggaaggaagaaatgccttggagtctgccaccattccagcgttgctgcaggttgtgcacttgccagaagatggtggaagagcagcagcagttgaagaggccatcccccccgaccccaagctgggacacattgtcccagagaagccgtgagttctccaaggctggcccaaggaggctgctaagaggagcagccctgagcgggctccgatgggtgtaggtgctggccacctgccttcctgttggcaagccaggccaatctccagggcaggcatgcgaccacaagcttggagacccgcccagggatgccaacagagccatagcaggttctggacttggccggggctccctgcccaggcacctcggaggtcctatgtgacctccactgtggagtcctttggttcaggttgtggcctggagctgaggttcccagccagggtggaaaacacagaggaaaaacccatgggtccccttggacagtgactcccgaaggccttccctggggacaatggcaagatggctgctgccttaacacatccacccaggatggacagcggccaccggtcaatgagctggttttcccatcgggactgggatctgcatcagagtcctcggaggaaagatggagctctgcttgtcctagggagcggctggcttggacggcttcctcgactctataagcttctgaaaaccaagggcccacacagtaatgtgatccccacgcatgtcctccctggaagtctgtactggggaggccctgggtatcagtatctggtattccggaaaagcagggcagaaggcacagaacccagacatctgccagggatgaggcctggcggggcagtgtgcacacccaccattgcccacgggccacctctgtgggccacaggccagcccccaagatgccaacatgagccatggagaggcaacctcaacccaagagctgaagctggtctccaccgcaggctggcttcgtcttactcacagtgagaacatacctcgtttattccacaaatagagttatttgttgagccctgtgttggggccacagcagttaacgagacctgccagggccctgtcttccagagcttactgtcgggccactggagggaggtgcaaccttcacatcagcatccccagctcaacacccactggggctgagctggggccagggtaacagaggcacatctgaagctccttcatcggggaagcagaagaactaaaaatacaagggatggctggctgttcatcgagtcaggacaagcttgtaggaataggtgaaacaaaataagcgcaaataaatccaaagcaaattttgtacccgagccccacccaggaaggatgggacaagaggggaagtcagccagccatgaggcagggatgggggccattcactcattcacttgttcagccagtctgtactgagcacccagctcctgccctcactcggaggacaaagcaaaggggcagttacgtacctgggagtgatcacaggacagctggctgagtctgggcgaaccaagaaggttcctagaagcagcattgtgtttgggcctcgaatgagcaggcataggctaccattaaggagagctggacattaaccaatgaagggtagtggggaggggacattccaggccctgtgtggttcaccaggctgtaggtacccacccatcccttgacctggtctttttctctcgctttcagcccatgacactggtcttgtgaccctacaagttgccttcaacaaccagatcatctccaactcggtggtgtttgagtacaaagcccgggctctgcccacgctcccttcctcccagcacgactggctgtcgttggacggtaagaacagtgcttgggtcgtcttgccaggcaccaagggagagggatgcttggggactcttgcacaaggtgtgaaagaagagtaagcacccagaaaggggcaggaagtggtgccaatgtgagcaaaggaaggccgactgggtctccaccgccaggctgagtgcctatgctgtcagccatttgtgtctggacactggctggccccaccctcaatctcagtctctccctgggacagactgaaaagtatgtgagtgtgggcctgtggctggcacgcctgctgggctgtctgagtggccaagcaagcccagggcagctaagaggctctggcgaaggaccccaggcagcaaggtccaagcacccgctgtgcccctccaggcctgtttccgcgggctcctggaagcaaaaagggttcccagaggccatcgccaagccccaagcctctcgagaaagaggacggggaggcagctcaggcctgggcttctttcgaatttgggggcttgcttctgccttttggggctaaccagccaaatcttctcctggaagccctcaaataccctcaactccagcttcttggctgattttaattccacctctggcctgtacggcgtctgtggcaagcccaggatcacgactgtggcagagggtagagtgtcagggaccccagtgggcttcaagggagcaggcaggacctggtggtcaaggagaggcagggactccaagagctgccagccttggccatgggggtcggtgagtgttggtggttccccttggggtaccaggggctctgcagagaagagctgccaaaggcaggctggggacgccagagccagaggctgccatttcccacctgggcacacgtcaggaggcccagagctagccaaggcctggggggctgagcccagtacactggggatgcggtaggagggatgcctgtccataacctcagtatcaggtgagcccacagaggtgacactccatggggtaccttgctggagaccttgctagcccaggatgttgaggtctgggctaagctgagcctgagccccttgcaggggtgggttctccaagcaacaccccctcacgcaccccgcacccacagctggccttctgggtctcacctctcagactgccccttgctgttggctgctggaggatttctgggcttgggtacatagttcatttcctgaaccacccagtgtgtaaacctcagccttatcccagtccctgccccagccgagagagagggtgccgacagctgccctggctggtgaaccctcaggagacaattccctggggtggctttgggtcttcaaaccctagcatgggctgccctggggcaccgagctgcccttggcagcatctctggctgaggccggagccaggcagagctgtgatgaccacccacaggatgtaacaaagaagggcagggtgaccaggggctcccgtttaggaaatctggttttagttttgcagaacaaatggggaatggagtcaggaactctccagagctctggctctccctgagtgacttggccggcctcactagaatgaacccaaggatgctgggaccactgtaggaccctgcctggcagatggagccttttcagagagcaaagtcacagtcaggcagtgccccagagctcaggacacatctgcaggccccctggaaacccagagagccagctgtaccccagaagctacggcacgggaggatgctgccatagaaaccggggggaaggggagccacccaactgcttcatgacagacacaccccgggacctcggccaccccaggcccctcgagatgggcctgccgccaagctgggcacctgctccctagctgcccccccccccagaactttgagctctgaactctgtgggcctccaagttgaaataagcacccctgcacctgcaggatacacaggagggtgacaggaattggggcggcgatgacatcaaggcctgggcgtccagcagcatcgcctctgttaccaccagccagggcacagctaggggaacagtagctccgcagcttggacccccagctcagagcgccctgctgaaccagaggggaccagcctggggtccacctcggcccaggggccctgcagagagcagatcagggccctgaaggacgctttcctttggtctgggccagttgtcctttcaaggaatgagtgggaggcagggacagaggaactgccagaccccacctggctggggagaagcgggtcttccctggctattctttttccccctaaatgaatacaaggcactcacccacccaagggcccagccttcccagcctttcaccagcttgataaatactaagggaggggaggggaagcagcgccgcagtcgcagcgcaaagggggccgcgggaacagctagtcgggagcgcgggggtcccgggcctctggccagccacggggcctggccatgaactttgcgtccgggccaatgctgcagtggccgggcggtggtgagccttccgttccccgcctgtccctcccggcccctcccctcggtctccgcagcttctcggctcagcccctcccgtccccgcgggcgctgggccgattctccctccgcgctggccaggccgtggagacgggttcgccgcggagaggggaggagggctggggaaggggtgggcgccaggggactgcagcgcggagcaaactggggcacggctgccggcggcgcgcgtgcacacactctctcccacgcgcgcgccctcccgccgacgcgcagccgcaatgcggggcccttcgcggaactgctggcggcgccgcgccccgcggggtctggggccccagcagggactgcgaggaccgcgggactaggaaggcctgagcccggccacccgcctccgagtgcgccgcaccgtgcggcggggaccacaggccttcggtgggcggcgagccctggctccctcgttcggtggcctctgctgcatgtgggatgcgccctttgtcccctctgccatgcgcgggggaaaatgtttgagggcggggaagagactgtctgccctcatttgatctaaaacatgaatttgtttgcttggctaaaggccgggggggggcgtgggtccggggcgcagagaacacgcgcgcgcgcgcgcgcgccagcagcagcagcagcagcagctgctgcggcgaagtctttgtccccgcggcgcagcctttgtccccgcggcgtagcttttgtttgcgcagccccgccctgcggagggcgatcgtccccacgttggggccggggggcagggacccgacgtccccaaaatctcagctggggcgcagccatcctgggagagaccgggcgtggagatgggggaaggtgggaggaggaatcgcagccttctggatcccggagctgcagcgcctcccccagacctaggggtcttcccctcccttcccctgcgccccactgtgagctccagggtcaaaggccctgtctgctggacccccatcacttagcccagggttggcacgtggtgggctgcagtacatatttgtgatatgaatgcaggcacacgtgaatgagtgcaggagggactgtcaaaaagctgaatccaactagtggtaaggaaggtttcacagaggaaacgacccccttggtgagacctgaagcctgagcagggttagcccgggaagagggggcatcaagggtggcaggagagggaatgagcggctgcctttaacccagggtcttcgggaactgccgttttcaccatttctcctccacccacaaaggtgcggattcagaacaaatttcctctgtcctgacctgaccccaggccatttgcacaggaccccagggaggtctgagcaggccagctcttcatacaaagatgcaagggggacctcttccaggctagaggtaggcaggcaatggggtttaccctggagacccactggggaggatctctgggaaatgtcacttatacctgtgataggtcctatggatacaacagccagggccgtgctgaacttcaagaggatgctgtctgtgtagatttggcctcgcctgtgcctgtgtttacaaagagaataaacccaggcagttcaacactgcagccctggagctgaggggatggggcgggccctcttctggccaaggacactgggacacctttaagtgacctgggtccctagaagagaaggtgagcggaatttttgtgtgcctctttcttgtcttacagcatctgattctcccccaaggccaagttgagaagatttagggtaccctgtccccacccccacctgccggcccttcttggaaccccactaagccgcttagacttagactctattttcagtgcttctcaggcaactgagcctccttgcctgggtgagaggattggagtgagacctgcgtgcagctcccctgggcttggctggtctcctgggcaggcccccttctggcctcaggggtgaggggggaccctgtcatctcaggcagagcggggagcatggactaaaagctcaaacttcattatccagttgcctgcttcctgggcaagcctcagtgtaaggtgggtgagcccagacagcttgcccctgcagctggccagagacagacggggttatcctgtgacttctggggcagcctggccctggggtaggtgtctgggaagactgagagcctcgctcctgtctaagcaagtggagagaaggaaaggcctcttggtttggccttctgatccgtccacgctctctgtgctaacagatggaagatgtgtctctggggcagcccctagctctgcccccacttcggagctgccaccttaggtgtgagagggcctgtccctggcatgtggctgtggtcctgctggcctttccttgtgggctgattctagtaccagcctccacccaccagagctgggagatcacacactgtcccagagtccaggggtacattccagggacagtgggaaaggccattctagctgggacactggtccctgggaggcctctgggtgcttcttcctccaatggcaacactccagggctttctgctgagtgggcctgggccggccgctcctaggctggctccctccctcagatccacccagcccacctccgagcaaccctcagctggcccatgaacacatcgcatgacatgggatgctgtaagagaacatacacagagttggctgggtgcggtggctcacgcctgtgatcccagcactttgggaggccgaggcaggcggatcacaaggtcaggagatcgagcccatcctggttaacacggtgaaaccccgcctctactaaaaatacaaaaacaaaattagccgggcgtggtggtgagcgcctgttgtcccagctactcgggaggctgaggcaggagaatggcttgaacccgggaggcggagcttgcagcaagctgagattgtgccactgcactccagcctccagcctgggtgacagagcgagactctgtctcaaaaaaaaaaaaaaaaaagaacatacaatgtacactgagaacacattccaaaggcatcacttgtcccagataatggaagacagaggagcaaaaattatttccttgctaaataatgtaaaatgcctttgctttactaaaaccaatacagtttgtattgtggagcagaatacaaaattcacaagaatttttcagattagacagtatgggtgaatggtcttgacttcaaagagctactttgaattacacccatagtgaaagactggaagcccccacctaccctctcccacctccgggagctctttaggggagctggagaagcactgacccaggggtcacccaaaggaagaaaggacgcccaccccaccgagagctttctggcatccacctggagtggggactggggccagcacaagctggttagcgcatgggcccctgggtacttctgtgcatagcagtaacaggtgacagaagcagctggcgtgagccggtcttgcactcgggacctgaggctgagtggcaggagtcacgtcctctccgagcccagccagtgccatgctccaaagcacagggccctcctcgtaacccgtctctcgctgtctgtggggcctccgtcattatacattgcggtgggtgtctgtcagcttgggtgcatgtgctccccaggcctgctttcctcagcaccgcagtgggtgggagtcgcatcagcatccagtttggggagcatcttagccattggggctcctaaggagccagctgtgctcctcagccaggaccaagaggtctggtcctcagatcctcctgggacagtgacttcctgccatttgcagctggagccacaccaagcagacctgtgtggagctcctctgtgtagcaaggagtgggtcaccttggagctgggtcccatccggcctccttggagcagtggcaaatggtgccctgcggagaaatggcctttaggaggaagcttgcctctcagcaaaggccgaggggcagcctttgccaccctgtcctggccgttggggcaggaagcaaagttgactctgtggaggacgccccaggactcgggcagatgcaggctcctctcccaggattggcttccctgccacctgcgggccagatggctccttccagagtgtgcatgactatggcagctcagaccctccaggggtcaagatcagccagctgttcctgtgactgccagacaaatgcccaccaactggctggcttcacacagagatgtgctctcacggctgtggagactggaagccagagttcaaggtcccagagagccgtgcccccaccaaaggcgctagggagggaccctctctggccacttgcagctctggtggctgctgatcatcgttatggatccatggcttgtggcaacagaaccccagtctctgcctgcactgtcctccctctgcgtgtgtctgtgtccctactttcttttaaggacaccagtcattggattaaggccaaccccatccggtgtgaacccgtcttaatgaattactaattacatttgtaatttactaattacaaagactccatttccaaatcaagtcccattctgaggttccctgtagacatgagcatttgaggaacactgttcaatgcagggctccatatcttgtaggcttagtccccagggcatggtcctgggcatgatcccagccgtcaggcctcactgaaggcaaaactgacccccagaaaataccagaagcctcctgagggtttgttgtgcacggggttctgccctaggtgttgtgagaagcgcagtgaagaagccgcgcaggttaggctccggggactccgcggtgtcggggagttcacaggcaccgtcccgcggtcacaggtggcatgttttgaggagttcgcaggcaccgtcccgtggtcacaggtggcgtgttttgaggagttcgcaggcaccgtcctgcggtcacaggtggtgtgttttgaggagttcgcaggcaccgtcctgaggtcacaggtggtgtgttttaaggagcatcacaggaagtacagttccgttcagtgtttattgagcatttactatatacacagcaatacgtatttagggaaggatgcagatatgggaaagatcagttcctggcttggaggagccactcacaggatgccctcctgttggaatgctcagggacggccatggggcagcaggatagggcggcctcccacagccacctgccatgaacacactgaccagcttggctcctgccgagaccacagcacatccctgtggaccccacggcctgattgtcttcattccacttgaggactcccagcccctgtgtccccattgatggccccttccccaggcgaagccctctggctctgggcagtgcgattctgcccctccctcccactcccctgcttgctcctcagtctccaagcttctccttccaaaattctctgtcatgtccccatggccggctctctcctgactactctcttctccctgcccacgctccctgagggcttcttcccagccagggctcgctctcccacctactagggtgcagggatggctgcccctctgtttgtcttcttggatccaggccatccatctaacggcctacagggcagcttgacccacgtttctcttgggcaagccagtaggtcccagacaggacaaatggccgttctttctgttttccccaacctacctctctgataacattcctgacccctgtggataatcccacccaaaaacccaggagtcaccccttgctcactccctccccgacatcccaatactagcctagcatgtttctttcctttatttctctcacattctctacttctcgccatcctctctgccaccaccttaattcagcccaaactaatcaattgtgcacgtcctaaccagtcttcccacctccttccacctgggctgcctggtcttccatcacctggtcaacatggactcggcatctgctgggtgccaggcactgttctgggctctggggaatccttattctcctgtagtttctattctagcgggggagaaagacaacaaacaagatgcaaaggaaactgtcagatgttgatacctgctgggcagggaacttcccctggatggtctgggagagggtaccagggcggctgctttataggccaggagaggtcagaggaggcctgtatgagaaggtgatattcaagctggggtatgagtgacaggcaggggccagccacagtaagaccgtggggggaatattccaggacagggaatcaggagcaaagcccccagggagagggcaagcctggcgcgttgggggagctgcggtcagaatagaggaaggggaggtggagggggttgcggggatgggagagggccagggggttcagcagaggccacatgggatgcatcaccaagagtagggggctgggcttttattctgaggtcagtggggagccacgggaggggcgttgccacacacaggtgtatgtttgcaagaacaccgcagctgccacgtggagaatgaattgtgtctccaccggcacagagactactccagggctcttgcgtccgttcgggcaagaggcgattgtggctctgacaaggccggaacaatgactcctgagggacagggtgggtttggggttgtttggaggtgaagtgaagggctctgctgatgatttgaatatgaagaacgagagaggacaatgagtaataatgcctagatttggggcttcaaccaccggaggaacagcaaaccatttcctgagatggagaagtctgaagaagcagcaaacccaaggggataggggaatctagtgttcagttttggtcacgttacagctgacaacctcattagagatgcggggttcacattgcggtctgaaagtctggaggccaatgagagatccagaatggagatgacgtttaggagtcctccgcgtgcagatggcgtttagcgccctaggtctgagcacgaagactccgtgaaacagcacagatgaagcagaggagaggctgcaggatcaagcacaggctaccctggtatgaggacaccaagcagaggaggagctggccaaggagggagggggacagccagtgcaacggagggaaaccagcaggatgtgacccatggaggctaagaaacgaaggtgtttcaaaaaaaaggacgtggtcaggcaggtcagatgccaagcagggagctgggtaagagccctccaagcagggggaggtgggtaggaaggtcctgaggcaagagggagctccacggatttgcagaattcagagaagtggctggaaaatccaggtgacacggcaccatacctgtctctgagctcagagtcacagccttccacagtgtggggtcagatgagaaagggcaggagcctcctggactcttgcctggcccaggagatcgcgtgcctcccactgccccatccactgctcgttcagcagaaggcaaggccccgtcccctgcttttcccatcttgcacctctggtgttggtcttgccaaccttttgataggtccgtgggccccaggagggcagcttctgtgtccctgggctcgtggagatgtcccacatctgttctgagtcccagagacagattccttcttcatggctccccgctggggagcaggggctccaggtgagccccaaagcaggaacaaactgtgattcacccccaaacactgtgttggtatcagacctggtggagacagctccagggccctgaccactggttgttgctgggtgcaagaatcgtgcagattcaccggaagcctgcctggcaggcctgctcaggcaattacgccccagctcctaaatcgattacgtcggactctcattattcctttttttttttttttttggcagagtcttgctctgtcgttcaggctagagtatagtggctccatttcagcttactgcagcctctgcctcctgggttcaggtgattctcctgcctcagcctcccaagtagttgggattacaggtgtgcaccaccacacccagctaatttttgtatttttagtacagagtttcaccatgttggccaggctggtctcgaactcctgaccttaagtgatccacctgcctcggcctcccaaagtgctgggattacaggcgtgagccaccatgcccagccggactcccattattctaccacagcatttggatgtgggtcagctgttccactaaaagcacagccttgaagaaaggcctcttggcaaagctgggaccacagagagaccggtcagggaatctggctggtccaggccagcaatgggctgacatccttagcctttactgggattgggctcccagaatccatctccctggaaaccaagggaggtgccagtctgtgtgtgcagctgccgggagaagtggtcctgagacccagaacacccaccatggagaagagaagacacaagtgctggttgggggctagggcagcctctgaggggatgtgaattcctagtggtcctgagcaaggtgagaggacacccttcccatccagtccaatgctcagcctctaactggggccaaggacaaagccctgtcctttcagaagctcctaaaaatacacatatctctgacccttctgagcagcccagcaaccttgtcccccacatctgtgacaccaggacattcaaaatagtctttgataggctgaagactggctccctccccagcagtaatctgctgaaactttgcacctgttgtgaaatcagagtcctttgttaggggaaaaacagtgagaggcaggtatgtgtcatatggaccatacttcatgaataacaggagactttttaaaaaatcaggccgggtgcagtggctcatgcctgtaatcccaacactttgggaggccaaggtgggtggatcacataaggtcaggagttcaagaccagcctggccaaaatggtgaaaccccctctctaccaaaaatacaaaaagtagccaggtgtggtggcacaggtggcacctgtggtcccagctactcgggaggctgaggcaggagaatcgcttgaacccaggaggcagaggttgcaatgagccaagaccacaccattgcactccaacctggatgacaaaagtgaaactccttctcaaaaaaaaaaaaaaatcagtggcaagccaggcgcggtggctcacacctgtaatcccagcacttttggaagctgaggcaggaggattgcttgaggtcaggagttcaagacctgcctgggcaacatgatgaaaccctgtcttgacaaaaaatacaaaaattagccaggtgtggtggcacaggtggcacctgtggtcccagctactcgggaggctgaggcaggaggatcgcttgagccctggaggttgaggctgcagtgagctgagattgtgccattgcactctagcctgagtgacagagcgagaccatctcaaaaaaaaaagaaaaatcagtggcagagggaaaacagttgatacaccaaaaacaaacggaggttgttcaggagttggaacttgtcccatagtccaatctcctcattcttctggaaggaacccaggccccaggaagagcagctgctggccccaagccatcgctgaatcgggatggaagtcacctcctgactccttctgcatgctctcctccctctgtctgcctccccttctccatcccacagccaaattcacccatgccccagaagctaggacacaaaggcagataagaaatgagccggctagtgggcacagtggctcgtgcctgtaatcccagcactttgggaggccgagttgggcgtatcacctgaggtcaggagttcaagaccagcttgaccaacatggtgaaaccccgtctctactagaaatacaaaaaattagccaggcgtggtggcaggcgcctgtaatcccagctactcgggaggctgagtgagacaggagaatcacttgaacccgggaagcagaggttgcggtgagtcaagattgcgccactgcactccagcctaggcaacaagagcgaaactccatctcaaaataagaagaaagagccagctgggagccctgggcggcttctgtgtggtgggttgtggtttctttggcgaggtcaagttttgcctctggtgtccccgcggagtgagctgacactctcccggcattcacactggcaggagagagggagcagtgacctggctctagccctctgctccctggccctcatgcagaaggaccagttctggcatcagcagatcgggaggtacccagtggaggcctcagagtgtctcctgtcataccaaatcctgagatgtgctggcatgtgggcaaggaactctaccccagccccacaccccatttggtggtcttgagaagagctggtgacatcctgcatcacttcagtggcaccaagctgcatcgattggtcttgagacacatggcagacttctgagccaccaggattgtttctttcagcaaaacaccttctggcacagagttgccaccaggagggacagcagctgacatctgcacatgcaccacctgccaggacctggccatgaagtactgatgtgtacccatgtgtagtgactcactgagactttccggcaacccgtgaggcccctgttccacagatggggatgctcagacaacagtgagtgggtggcgcagagagtcacacacagcagtgcgaccccatcatccgctcttgacctctatgccatgtgaggcttctggagcctcttcctgttgcacctgcactactttggagctgcctcccagggctagagcctgtccttgcttcccggttattcacgacaaccgtcagtggagtacccgttaggtgccaggcactgcgtcacgtgatgagtatcagaagaaatggatcagatgaggacctgcagtcaacgagcttcccgtccaggggaggaaacatccgaactgaccacctgtcttcgcacaaacaagcatttggggaccttatgatggaggatggtgacttctcgaggaggtctgggagggatttcttgaagaaatgacccccaaaccaagagctgaacgatgagcacaagttaactccctgaagagagaaggcaaacattccaggccgcaggaatggcacgcgcagaaactctgtggtgggagggagccatgaagccagtgaggcagaggggcaggcagtgaatcaggccacaggggctggagggaccctcagagccagggctgtgtgtgccaggctttatccccaaggagaggaaagccactgagggctcgagaggcagggacgtgaccaagttggcttctgaagaagcgcacatggcagccacatggagaacagattgaaggaggctcagagagggtgaggggagaccaggaaatcatcctggctagagatgatggtaacttggcagttctgggggcacagggacagtgtgagagccaccgaggagatggcatcaggaggtcttgtgggtggattcactatggaggctccatgtcattcaccttggaggaggaccagtcaggagttgagctgagtttaaggggcttttgggacatctgtgtgaaaagtcaatggcaggtgggtgtagccccagagctgagagagcaaatagacaagagagcgagagagagagagaaagagaagtctgaaatgtctgcgtggaggtggcactgaataaagcacatctgtgggtgtggaggaaattgataagcatgacaatattgctgagtcccaaggccaagaacttctgtcttaattatcattgtgccccagtgtaggggtccagggacacagtagggtctcgatgaaggtttcttcaagggagggaaggaagggagggaggaagggaaggaaggagggagggagggagggaaggagggaggtacagatggcctagtggtatcttcagggccattgtcctcagggctgactgcagctttaggatccagccacccggatatcctctctgacatcagaaccaggctgggtagggtgtccaggactaaccaggcagcgtcacctccctttgggtctccctgtcactgaacaagctccaggcaaatgacccaagaccaaagtgcagaagcttgaccctctgctacctctttattgaacctgccctgaggctgccttcagagcttttaaagggccacctggtgagaaatcctcccttcagctcactgaagctggaagagaaaggaaaaagcacttttcttcctggagctgctcagccctctctctaggcctcagagagggagggggtttctcaggccggtccttggcaagtcactacatggtaggttgtggtgcatggaccctggaggagagcctcatctgaccctctgtaatgcccctgacccagtcccacattagcctggtgaaggaaagaaagaacgaaagaaagaatgaatgaatgaatgagtgagtaggtgagtcggggccatgaaaacctccctatgcacaggaatcctgctgcttcaaaacacactggtgtgacagtgacagtaatgatcaccagccaggccccaggcctggtgcttcacatcatggccctgttgaagcctcccagcacccagcctcaggttgtcattcacaggcacctcacccccaaactgggtcataaactatatggaagaaacagcgttgataggtggcagcccgtccacccacctgtcattcagcagtacctgctagaaccaaggctttacccatcaaccaggcatccccccaccccccaggaactcacagcccagggcagggggcacacggaacaacacaattaatgtgaggagtgcttgagtgtccgggaggtgtgagaagccaggggaacccctctgtgcctccatctggagggaacacacttgacagtggctaattctctatcaaaactgtaatgtgtgctcataggagtgcccttcatatatagaaagaatgtgcaagtgttaatgtatcagtctgttttcacaccgctgataaagacatagccaagactgagcaatttacaaaagaaaggggtttaattggacttacagttccacgtggctggggaagtttcacaatcatggtggaaggcaaggaggagcaagtcacatcttacatggatggtagcaggcaaagggagaaagagctcttacagggcaactcctgtttttaaaaccatcagatctcgtgagatgtattcactatcgtgagaacaacacaggaaagacttgcctccatgattcaattatcttcgactgggtccctcccacaacacatggaaattcaagatgagatttgggtggggacacagccaaccatatcagttagccacctgtcaagttaaagggagcaccatccacataagaccacctttattgctgcaccaactgcaaggggtaccctagaccaccctcaggtttgatcattcactggaaggacgcagaactcatcaaaagctctcatactcacagttgcacattattacatcaaaaggatacagattaaaatcagccaagggaggaagggcatagggcatagtccaggaaggtaccagacatggagcttccactgtcctcttccccatggaatcatgaaaagcatgactttcctggcattgatgtgtgacagtacccatggagtactgccaaccagggcagctcaccatagccccagtgttcagagtttttattgcggctccatcacacaggtgactgccctccctctccagctcctccagagtcagctgataccacgtgacccaaagaccccaccctaagtcacattgttggtctttctggcacagccaacccctaccctaaacctatccagtgtggccagcatctaccctaaatcatatggttagaccattctgtgacacaaggatcccaggcaaacaaactccaatcaggcatgatattccaagggcttagagttcacctcccagaaggtgaggacaaaagccagacctctctttgggcaacgttaaattctttcctacacaaaatgccatcttcccactcctctgcacccacttgcttgcacctgcttcccctactcctcaccccagagaccagattcttttcagtatctttatcgagggaggaaagggttgttgtgtgtctgaggtgtttgttgttgttaaagcatggctcctacacagatcttatgtagtattcagcagttctctggggacaaagagcacattttactatgagaaatagtttgggtgaatactttgtcgtctgcagaaaatattgtgcagagctccagttttcctagatggagatgtgaaattaactaaattacagatcagtccacctaaaatatgaaattaaatgacaaattccaggagcctttgactgctaaggtcattattctaacatatgattccaatcacctttttaaattgctcacctgtgccatggtccacgatgccctggaaacaacactgcctcctgtctctgtcctgcagacggcacccctggctcaagcaatgctctcctctcggtcaagtgtcctcccaatggctccatttgctgtgcggggttgtaaacggctccattttaagccaccagctccctccctccggccctctctgctgtctccctctcctgtgctgggggctgggaggctgaaggaagccctagcaccactgtcccctcctcgatggctactcttctccaacaagacctctcttcctctcctcaacactgatgggaatggatcggaccttgcaattagtgcccagctgggtgcagacagggatctctgagccagggcggggacctggggagagagcattcctgctcaataattcacccttaagggaaaggaaagctacgaatgcagcattcagccattttccaagacattaacaattcagtgtaattcctgaggcataaaaaatgcatcattgctctaattttataagctccatgatgtttattatgacatcagaaggtctggtctgggtcacccaggagagctaaagccaggagaaaccggtagatagctctgtacagggcctgcacagaggtgctttggagccagcccagaaatgctgcagacacagcccccacgaggtgggacctgatgccctggaagcccccagcactctggaacttggaaatgactgacgcattcatcatgagtctttacacccctcccctggaaagcagcaggcaagagcgagctctgagcagagagaagagggcgcggcagggagcctgaagctccaaggcccccaattgcactcaaagacatcattcctccccggcgttctcattttttcattcccagtaacagagtgagtgggtgctcatttttatatttggtgaaacgccctggcattattccaagtcacttgaaagtgagattagaccaggaggatcactgggtggggctgcgtttcttgttcccactctggagacagagcacgatccatggtatttcactttggacataggtgcttcttaggccctggggggcagcagagccaagcaggggacagcctccacttcattggttccagagccagtgaggtgctggcctgcatgggactgtggctgcaccatgaggggccacagtgacaaagtgacccagggtgccaaagagagatcagcagggggtgggggcatgcgagtgtgtgtcatgtgtgcgcttttccctggccacttttttctttttctaagtaatgtcatttagcaccaaaggtatctgcaaatgctccctgaactaaatatgtcagctctgcctcccctggtgcaggagacggctgtcatttaaaatgcacttgcacagaattgggccttcctttgtgattgctctgtctcctgttggtaacagcacagctcctctcttcatgaccttggtacttattattcttagggagtagctagttgcttccctaaaaggacaactttccagctctcattttcacgggtacctgacagtggctcagtggctgtgaggatggtgatgtcaaaatggctttctcataaatgtcacagtcttttgactccactgttgcctatgagagagcacacttgtttctctttaattagatctctaagtttttgttttgttgttgctgttttgttttgttttttgatacggagtctcacactgtcacccaggccagagtacagtggcgcaatctcggctcattgcaacctccacctcccaggttcaagcaattctcctgcctcagcctccgagtagctgggactacaggcaccaccaccacacctggctacttttttgtatttttagtagagacagggtttcactatattggccaggctggtctcgaacacctgacctcgtgatcctccctcctcagcctcccaaagtgctgggattacaggcgtgagccacagtgcccagccagttttttttttttttaaaataaatgttatctgctttataagaaagccacaccatgacagcttgatttagtgcattttttgagagtacttttctgattaaaatgcccatttaccactgtgactctactgggctgtagggtacacggcatcctctttgaaggctcagtggggtctttctgcctcatggaaaagttgactgtagccccacaggacctctgatgctgtctcagacctgaagactggggtctcctgagcacctcttcaggagcttgagaagggttggaccctgcacagggagccgtagagaaggccgtggcagcccatacactctgcacgggaggatctgtgagcccttagccaggtgaagaagtgcatggacatgtgggaattcttgcttagaagaaacagcctgtattgctttgctggtgcaggctgggctgggtgggacctgtgagttaaaccagtgcatgctaagaggtctgggcctaggtcgtctcactccagctactcctgaatggctacagaataagattccgttggagcacctctcttgtacctgtgtgggattactcaatctgcctagggcatcctggccaactccctcacacagctgctgtgcaggcaggaaaggcaagctcattcgaacagcatagggaggaaagtggcaggaaggcatctgccaccctgaaagatctggagcacatcctgaggacaggaggacccgaagtgatggtgatttccgggttctatcccctgagccctcactgggcacccaccaggccctgggctatctatttaagtttattatccaacttcatcccggccgtattccagatctttccatccccattctattgacgaggagcctgaatcttagaggagtcaagtgacttgtcctgtgtcacaccgctggggattcgaactcagggccatctgacattgcagcccagtgggcactttttcaccatgccttcccaccacctgaattgatttgggacaatccgctttttagtatcctgctccccttcacagcagagatgtctctgcatttcgcccactttaatggggagaatagctgtgtattttaacatccaacatgtgtgtaatagtgggggcctggtagaagttgctggcggaatggatgggcctgtgtcagccagcagggagaatgagttgaaggtggtttcactccgcttccttggattcttttctgcattatgtccattaggagaaacctgccagtttttgggctgatggctaatgcatctcttcctccctccatattacagctggcaccttcccaggatgacgccaatcatggcatatcctggtagcaaacactgtttctccccactatcctccacatcactgtcaggaccattatctctggccgtataacaagccaacccaaagctgaatggctcaaaatgatgagaatgggtactttctcttgatgccgtgggttggccaagctcacacatgcaactgcactcatgggactgatgattttaagcccagagtccctgcagctgaagcataggggcacctgctctgtcaggtcatgctggccacgcactgtgaccccccccccccccaccaacatggccttagacctgtcccttcagcagcaacaacggatttggattaaacaggatttttaaagaattatgttgagactctagtccagggtgtccaatcttttgtcttccctgggccacagcagaagaagaagaattgtcttgggtcacacataaagtacactaacactaatgatagctgattaggttaaaaaaatcacacacaaaaaaatttcataatgttttaagaaggtttacgaatttgtgttgggccacattcaaagctgtcctggctggcatgcagcccactgactgcgggctggacaaccttgcagtgtagtctaaactgattttacagaggaggaaactgaggcacaggaagggaaaggagcttgccatacaggtagttctggggggcaagggggggtgcggaactggaaccagagcccaggctgctgaccccaggccaggaccccgttccccacctcagtgcctccttcttcctggatggctcaggggccctgacaggtgcagctcagctggagatgtttgaggctctctgcaaagctccccctttcccctgagtcagccaaccattgtgatctgcaaggaaaatcccaagttctgaatgctgttctcgccaggatccccagctgtcagggacatcatcatggccagcagggactttacagactcacccctggctttttcacgaccttcagaagcactgtcaaactgcctgtcttctgacatcttctgccctgggcatcaccatcgtgtgactcagggcctcccctgtgccagtctcatctcctcactgagtagtcatgggacagggcctgtctattcagattcccctcctgccactgcaccccacattggcccagaccgactcactgggaggatcggccatcagactctcctgacctgggcctagctttttccgtcggtcagtcttcttttctcaagttaaatccattgatttctattctatacttcttcattctctttctattctcctttgtctatgtgtgtgtgttacagcattattgagacataattaacataccatacaatttacctatttgaagtacaaagtttctgagtgttttcacagggttgtgcagtcatcaccacaaactaattttagaacattttcatcccccaagaaacatcctgctgcccatgaaccagggtcactccccattcctcctcagctcccccccaccaccctccctaggcaattattgatctatttcctgtcaccataaactttcctaatctggacattttctataaatgatgtaatacaatgtatggacttgtggctggcttcttgcacttagcatgatgtttttaaggttcacccatgttgcagcatgtatcagtacttcattatttttattgctaagtaaatgtccatatgtatggacatctcctttcattctcttggatatatacctaggaatggaatggctgggtcacatcataactttataattaaccttttgaagaactgccagactgttttcctaagtagctgtgccattttacatttccaccaccagtgtacaaaagttcaaatttctccacatccttgccaacgcttgttattgtctttctttgtgattatagtcacttagtgggtgtgaagtggtatctcattgtggttttgatttgcatttcctcagtgactttgatttcctcaaatcaaatgttgagcattattgattattgcccttattattgatcttctttggagaaatgtctattcagatactttgcccattttaaaaactgggttctttgctttttatttttgagctgtaagagttctctttatatttgagatacaagtcccttatgaaatatgagatttgcaaatattttctcccttttagtgaaatgtctttttacttcttgatgttgccctttgaagcaaagaggttttcaattttgataatgttcaatttatttattttttcctttggttgcttgtgcttttgatatatttaagaaactatcgccaaatccaaggtcatgaaggtttactgccgtattttttttccaagagttttgtagctttacctcttatatgtaggtctttgatccactttgagttacattttatatatggtgtgaggcaggggttcaacttcattctttttcatgtggatagcccattgtcctagccccatttgttgaagacgattctttccccattgaattgccttgtcagctttacctgtggctttttaaaatattttctatttcttcaagccttaaagatatactgaatatgcatcttgctcttatttttaaattgtcacttagtttgagcagaatcttatgattttttcttttactggaagttgatatatacagaaacatctgatttcttatcagacaggagaggttagattatactgcagtaacaaccaattcaatctcaggactggatttctcattcatgctacaagtccaactacaattgctagggagggccctactcatcatggtcacacaggggccccggctggcagaggctaccttttcctataaacaagcttgcacaattgccagggccgggggaaagaatgtgttgggcaggtcactggctcttaaagcttctatctgtaataatacacatcagatttattcatgtttcattggctcaagaaagtcacatggtcacatctaacttcaaagggtacaggccagtgcaaagcacccccagggatagcaaccagagatatttggtatataatattaatgactaccatttccctggagtgtattgaaatgtaacaggtgtaatgaaatcagttgatgtggactttctgttgtgcatctcgaactttaatcactgtggtaaaattcctttgtagagatcaaggctgcatcgagccaagatcatggcattactctccagcctgggcaacagagtgagatcctgtctcaaaaaacaaaaaaatcctttgtagaaatttccagactgttctgttaaacaaatgatatctacttaatggtaagagtttttaggtgcttggaatagggcagaatgaacacaggctctgaagtgaaacccagatccactgctttccagctgtgtggctttgagcaagttatctgactttttgaagctttcgtcttaccctctatggaatatcctgcttgcaggagacttagcagcagcgtgagtgcctggcacaacagcaggcagataacaggcatccaacagactgaaattcccttcttcctcctctgcaacaggatccaccccctgggttcatcctgagaccctcagcagggttagggctgatatatcaactccctgtatctgctttttttctccccctttttgagacagggtcttgctctgttgcccaggctggaatgcagtggtgtgatcatggcttactgcagcctcaacctcctgggttcaagcaatcctctcgcctcagcctcccaaatagctaggactacagacacacaccaccacaccccgctaattttttttaaaaaaaattgtagagaggagatctcaccatgttgcccaggctggtctcgaactcctgggttccagtgatcctcctgcctcagcctcctaaaagtactgggattacaggtgtgagccaccgtgcccggctgtatctgctttaaaggacaaaaattgcacttaaccttggtactgccaatggactcataactgagtattctttttctctattttacaaaacaacccaggtatgctcaaagccccataaaaacccagtgtaacaatatgcttgaatcatgcgcgtgccttattctctcatcttctaacttggaagaaagaacatgaataccacaaggaaccacctgtggagattcagttttagggcgctggcagcactcggggcttgcctcaggagcacccagctcatcccaccctagctctgcctgactttccaagaaagggacccaaggaagcctcctgctcctgtggtgcagtgagtggcaggcactccaggagaagaacgagcccagccgagaaacaataccaggacattccccatgcagaaacgtcaccccaggctcctgaccccaacccactcagcagggctcagccagtgcctcctgggctgctgcagccatgaccccacctgtcccacctgctcggcagaggtggggctgctgcaggaagggtgaggggtcatgggtacccctgaggcccctccttcagacagctgggatgccagggctgaaacttgtgtctgccaaaacaaacaaacaaacaaacaacaacaacaggaaaaagaacttccccacctgagagagaaaagactgaagattccttctctttaactgggcttcaggtgcctgaactggatccaaatcaccacgagttccccggcactttagagtacagaggcaggcgctgtctctcctgtcagcctccacccctgctggtctcttgctcacaatccattcagagcaattcaacaaccatcagctgagcacttacagcgtgccccgccagcactgtgcaagctgctgggatgtcaggctttgttcttgttctcaaggagatgagggctgtcctgctcttagtgaaaaacaactaacttctagaaacactttttattaatgtatgatggacatatggaaaagtgcacatattctaagtatgcaactcaatgatttttcacaaactaaaaccagtgcccaggtcgagattaaaacagcaccagaaacccagaagccaccccaaccccagcctccagccactcctcctcgcccccaagtaccccgttttggcaaagctggcaacggtagctaactttgattgaatgtacatcagtgccaggcactggtacatgcaccttccacctattgattcctttaactcccgcaccatagatatgaaggcacagacagtggagcacacagctagcaacgagcccactctgaacccaggggggttggtttcccgagcctatgtgtccctgatgactaccctttcattgccgccctggaaaacaaacagaactcactcactgtgtactgcaacaccaacacataacaaagctggaggtttggttctgctgagagcgtcaggaaaagccactgagggtggccagatttgagctggaccttgatgaatgcataggagtctccctagcagataaaggggaggagttgcatagcaaaggtggtggggggagcgtgcaaggggtcctgcgtggtgacccggggggcgggcgaggggtagacaggtgcagtgggaatactgacctagagcaggattggaatatgtactggggctttgccagggcaggcttcggaacaggagaggaacttgctcaggtttacagtgggtggcagcccccaagggaagccatggacgatctaccggcatgggcaggacccagcttggtcagggtgtccttcacgcggcctctaaccagcgattcctcattgggtgtacaggcttaagggctctgcaaatgttggggttgtttctgtgtgcgtttgggtagggtcagaaaagagactccgcccccaatttcgagacacctttttacccaggtggcagagacatggccgattttacagataattgactgtatctatatatctatatctattagtatataacaaaaacaaaataggcggtctcatcacaggtcttggggtcaggcactttctctgtgcgaggccgtgggactgcaaacagcacagggaaaaaagaaagcgggatccgctcgggacgcctgagcctcgattaagaggtgcggctcgggatttgtggccggggcgagagaccctcacgcagaagtccccaagtgcgcagggctggagctggaactttggaacgcggaggttagacccaaagggtgggcggagcctgcactccagctaagggggcccagcgccgcaccccctccccaaagccggagccgccgccaccgtccccgcccaccgtcctccgccccgccctggccctccccgggtcctcgggccccggccccctccctccagcctggcccccacgcctccccgctcgttgcgcagcgccggctcctcccgccggctgcattgcagacgccgccgccgcagggcgcgccggggccgcgcagggagcccgagcccgggaacgcgggccctcggcgcggagcttcgggcggccccgacggcgcggggagccaggcagggcgggcgcggggcggccccgcgggaaggggaacgggaggcccgcgcggggctccgggggccgtcggcccgggcagcgggcgcagccgtcgggctccgagccgtcccggcctcgagggaaccgtcgccgccccattcgcgggccgcgctgagccgggcgggcggagcggcggggaccgcgtcgcgagggaccgggggcccggctctcgcgcggggacgcccgggccgcgctccgcccgcaacctccggccgggcccccgccgtccagcgcggctcgggcgcagttccggcgcagtccccgcgccgagcggctccgcgccccgcaccagcctctgcccggctccgggtgacgtcgcatcctccgattggaccacgcggcctggggggcggggtctggtccggtgagctcaccgccgcgccccgccattggtccgggcggcgcactcgggcagtggcggggagaccgcggtacccggagccccgcgagtcgttccagctgcggcgagtggagctgagcgggcgcggggccgggctgggccgggccgggcggggccgggcggggcgcgggagccagtgagcggcggctcggcgcaagcctgacgagcaggagccgagctcagcaggtccgggtaggtgcgcggcggcgcggggctaggcggagggcgcgtgcggtcgagggcggcggccggcgggggcgcgcgcggggcgggggcggggccggggcgtggggacacgcgtgctcgcgggccgggggcgtggtgcgcggccacgcgtgtttctggcgcgagtgtgcggggccaggccgggagggcgtgcgcggaccgggcgtgtttacgcgcggcagggaggggccacgagggtgcgcgcgtttctggcgcgagtgggaagtgtggggatccggcgggcccggtgtgaggggcgtgtttctggggcgagagtggggagtgagtgtgaggagcaagggtgaggggctgcagggaggggtgcgtttggccgaggagtgggtgggagacacgcgtgtccatgccgcgagggtgtgtcgacgcccgagcctgcgtggggcccggggccgtgtgtctggagtggccgagggcgtgaggggcgcgcgtgtttgtgcgaggggcgtgtgcggcgggtgtgagccacgcgtgtctgggtgcgcgcgcgggccggatgagcttctggagtggtgcgaggacgcgcgcgtgtgtctgtgtcggagcgagggcggggacgagcgtgtcgggcgcgcgcgggcggggctggggcggcgtcggggcgcgcgggggcccggcccggccggcggcgagtgtgttggggcgctcggcttctcctcaacacgggtttttgggacccagtgccgcctccttcccgcggcggggcccgcggagctcccggtttccctgggcagacaggtgcgaggcgaggtgcgggcacagccctgcgctcctcagcgggtgcgggatcgggcgacgggggactgtctctaactacagaccaggggagcggagggacgctcgattcacccgcgtgcacagggcagtcctgaaagtggatggaaggctcggaggaacttctgagagctttgcttccctgcagactggcgaccagagagcactttccacgcgcagatgggccaggatagatgctcggggtggcccttttgcattttcggagctctggtgattgggtttctaggtattgcgcctctttagaggtggcgctgatggcgttctggtgtttgagactttttcgatctctgtagattactgcagacatcaaaagcatttctctacaaatcaggtatcagaatagatttctgaaatgatgatattcttgcagactgtcttcttaatcagttgcctcaccagggaaggacgacaattttaaagtccattttctattttgcccacttttacttgataggatttctgctggcagcctgaagtatctaatcccggaagcggactcagtaaacgtgagaggtgccctcagataactacagaaatgcctcctgtgtttggttgcttgaatgaatgcattatattttttccaccagtgaggccaacccctgactttttaaaattgtgctcccaagttttatcgataaaatgtctggctattacatacaaggagtctttttctcttactaccttgaggaactgaagtgttccgtttccctgcagaatctgtgtcttatcgagaaactattgctgggaaccggatcaagagaaatgcattatgcagaagcacttttcctgctgtgtgtttagaaaaaaaatagttattattccaagaccagaattagacactagcaaataaatttgtttctctttttctttgtattagatttagagagtaataatgtttaatgtccaagaaaatagcatttacttacagcgtatgcatttcctaaataaatttaacctagtagtgaaaagaagcagagaactgctgtgtattcctgagagaccttgatgaggtcgtcctgattaattataatctgaacaactcaaatggaaatacagtatttcatgtactcgttaataacagtcttgtttgtattatttaaggatttggctttggtgataccctggcggatgcattatttcaggctattcttttttttttttttttttgagacggagtctcgctctgttgcccaggctggagtgcagtggcatgatcccggctcaccacaacctgcacctcccgggttcaagtgattctcctgcctcagtctcccgagtagctgggactacaggtgcgcgccaccatgcccagctcatttttgtattttggtggagatggggtttcactatgttggccaggctggtcttgaactcctgaccttgtgatctgcctgcctcagcctcccaaagtgatgggattacaggcgtgagccaccgtgcctggcccaggcttttctttagtcttctatttaggactgaactgggcctttactaagagctgtcactgctgcagtgtattcatgtggggctgttctagaatccagtacgtgaataacaagtggaactgagtattatttacttaatatgagaaagatagcaaagttaaagcattggttgatatgaaagtttcccgagtgaaaggtgtgaggctctttttgaaacaggtttcactctgtctcccaggctggagtgcagtggcatgatcatggttcagtgcagcctccacctcccgggctcaggtgatcctcccacctcagtctcctgggtagctgggactacaggtacacaccaccatgcccggctaatttgttgtattttttgtagagatgaggtttctccatgttgcccaggctgggctcaaactcctgagctcaagtgatccacccgcctttgcctcccaaagtgctgagatcacaggcgtgatggtgggagaagtccagatgtgatgtattgaattacattaaaaaccacaagttagtattactcacatttaacatttcagaagtgcttattagcctgctgggtgataccaatgggtagtgtcacatcatgtcatggggatgttggcgttcatagtcatggagaccttcagttagagtcttctcctcttcttgagtgaattgccctgaagtcaaatgaccatcttttctttgctattctcttatgtgactacatttggcttaacatgacaggcagacaaggagatgccgtcgccatcaggagatagttactcttcaccccacaggcagtacagcaagtgactcattaaaaccatgatatgataccttgtgaatagtaagtttaaaaatacggccaggtgtggtggctgacacttgtaattctagcactttgggaggctgaggcaggtggattgcttgagcctaggagttcaagaccagcctgggcaacatggagaaaccccgtctctacaaaaaatacaaaaattagccaggtgtggcgttgcatgcctacagtcccagctactcaggaggctgaggtgggaggatcgcctgagcctggtaggtggaggttgcagtgagctgtgattgtgccattgcactccatcctgagcaacagagtgagaccccatctcaacaaaacaaaacaaagaatagccaggcgtggtggctttcacctctaatctctgcactttgggaggccaaggcagaaggattgcttgagcccaggagttcaaggctgcagtgagccatgatcatgccactgctatgcagcctgggcaacagcaagaccctgattcaaaaaaaagaaaaagacagtggagggggagaatgccagtatgatcttgtgtaatgctttatttcagtaaagttcctttgatagactaactggaattttagtttataaagtatcgtgatccctgtaatttgcttaattttatattgtcttataaacattgaaaatagagcatagctttagacatgatgtggagagactggtcagctcatctttgaagcacctactatacatcagttgcttagcaaattaaaactaataattaaatattactttgaggaaggtaaagtatacggagtttaatgagggtaaatgtttctaggagttaaagtgctgatcataaagctacataatgtttttgtaatgtggaaggtgatgataagtcatgtaaataaatttctccattatattaaactaatatttatcaactactaaaaattaatcattctctccattttttcagctttcgtgtttcacctgactttcaccaccccatacatcatgtttcactctccagctggccacaccccatcctcagccacacagcatgagccctctgtcacacgcagccaggctggtgtgctggtgtgctggtgtgcctaccgtcacccatactccatgttaaattctgtctcttttttcctttgagcctcactcaagtcttattaatgaagctttttttctcccctcccagattagattaacagctgtttatggggtgcagaggggccccacctaagctgtatcttctactatgcctagcataatgccatctgggacttgaagtttcatgaatactgttagttggcaaagaagttatccagcgtgatgctactcattagatagggtgaggagactgtaatgaaatgtgtttcttcaagcccaagacaaacgtgatcctactccgtgcctttggttcagtcttgtttgttggtcatttaggcacaaactccaaatgatttcccatgcaggtcagttcaaggaggagtgagagggtcgaaaatcaatctatgtggatgtgaatctaaagccaactggtggatgtgagttttcacttaggtggtcttgaggtggccctaaaaatcctggacactgtaccagtgtaaaataggcctgacacctgaatcattttcccagactgagaatattggccagaagcccactgtctagggatgtgtgtaggtaacagctgttctctttcatataatacagcaggatgggcactgggtgtttcagctctaccattcactcagtgagaaaccttatgtaaattaccttgtatctccggctctcttacctgttttccaaacccattagtggttcagaaaagcatggtcaccatcatcagattttaaaatcagagtgcattgcacatagtaagcgtaagtattgatttgggaagctttttggtttccatatgggagtgtgtgtgctggcttctatttctttctgtggaccacagtttaaaaaagttgaaagccactagactggatatttcctaattctctttcaattcagctattctgctgtgattcttttctgtggtatgtgtctgttatgacgccacatttagcagtcgcataaggcctgaaagagttaagatacctccatatgtatgaattcaacagatagtctccagccaggccagagctcagtatacctttccttgtcttactgaatgttttggcagtcaacattgaatcagtgttttgaataagcaagacagtttattgctactgtcatttatcacatgttttgtagataaattctaatgctgcaagtgacaaaactccacctcagactggcttacataaaaaagggaacttggccgtgtgttggctcacacctgtaatcccagcatgttggggggtcgaggcaggaggatctcttgaagccaggagtctgagactagcctaggcaacatagcaagacctcatctttaaaaaaaatttaaaacaaatagctggacacagtggcacacacctatagtcccagctactcaggaggctgaagcaggaggattgcttgagcccaggagtttgaggctgcgggtgagccacgattacaccactgcactccagcctgggtgacagaacgagaccctgtctcaaaaaaaaaaaaaaaaaaaaaagaatttattgactcttaggaagtccagaattagtgttatcttcagctagaactagctctagatgtacaatgatgtcattaggcctcccccattgcccccaccccactctcctcctctatgttaattttattctcaagcagggaagggtccccaatatggcagcagcaagatggcccactctgagctacaggcttatcgtctgccaaattaccagatgtctccaggaagacagctcttatttccctgtagttccaggaaatgtctcatctcttattggcccatcttgagtcacgtgtctaatctcttgaataaggggacatggtcctctcattcataaggcctggctcatacacccctggagccaagaattgggctctgcgccacctaaaccgggtgcagttccttagttcaggctgctctaacaaagtaccatggacaggtgtcctgtaaacaacacagatttatttctcagttctggaggctgaaagtccaagatcagtgccagcatgatgagggtcacttctgagttgcagactgccaacttcttgctgtatccttacaaggtggaaagagggcaagttgctctctggggtcccttttataagggcacccatatataatcccattcatgaaggctgtactctcaagacctaatcaccttccagaggtcccacttcctaataccatcacgttgggagttgggatttcaacataggaattctaggaagacataacattcagtccattgcactccccaaggaagaagtaaggtgccctgatcagggatgaaggaagggacgctaggggggccaactgtgaaggaaccaataggttttggtcttcacacttgattgtcatagtcctaaagaaaacaccatcctgaagctacagaaactcactctagggctttcttccttgcttttattctcatggtcccattttaaatgagaaagaggaaccagagcccatcaccttttagtgaatctttaaatggatattgactaacaatttctaggaccatttccagaaagtatggttcaattccttagtattatacactgtggtttggattaatcaccaaagaatttatttaaatatcctcttttctagtgaaagaagcgatgtcactctagccagaaccaatgcccctggcgcgcgtgtgtaagatgttttatctaatgatgtaaaaaataggaagtacttagcctaaaactgatgattctgaaagcttttaagtcagttgagtaatatttcccagaaaaacagtgcaataaatggcaggtaggttcccaggctagccagagaacaaaaaccttttgggacccactatagatactctgcatttgcaggagagaaataattaaaataatgtgtgtgcacatatatatgcatattataaaacattgaactacataatctataaaatctatcaatatataacatacaagtatgtattgcaaaacaagtgaaagagtgaacctcgcatttatatattaagtgatgctgcttaaataaggaaatatataaaataactttggtaaatggaaacagttttggtgaagattcttaattcacagggtagaactcaaaatggttctctgaaaatacagtctagttctctaatgttttagagtaaagttgcatagaataagtaatataaatttattgataacctaactccaacattattcattataattactattttttttttttgagacagggtctgactctgatgcccaggccgaagtgtagtggtgcaatctcggctcactgcaactcccactgcccaggctcaagtgatcctcccacctgagcctcccaagtaacagggaccacaggtgtgcatcactgtgcctggctagtttttggattttttgtagagacagggtttcatatgttgcccaggctggtcttgaactcctgagctcaagcagtccacctgcctcgcctccccaagtgctaggattacatgccagagccaccacatccagctcaatcttacttttattcccaaatggaacaaagagagtgaaagaaatctttctgaggtggctcagataattaaaacaaggatagggaaatagtccattttcatgctgctatgaggaaatactccagactgggtaatttgtagagaaaaagaggtttaatggactcagttccacatagctggggtggcctcacaatcatggcagaaagcgaaggaggagcaaaggcacgtcttaacatggcagcaggcgagaggacgtgtgcaggggaattgccctttataaaaccatcagatctcatgagtcttattcactatcacgagaacagcaggagaaaaatccaccctcatgattcagttacctccgactgggtcctgtccacgacacatggggattatgggagctaccattcaagatgagatttgggtggaaacacagccaaaccatatcaggagaggttggattaaagaagtgattctgtctgtcaaaggttgtctgaagtggaattgactgaccacacagagtgagtgagggagtctcctgagatgggagagaggcaatgatagtggggagacattgggtcaaaccatttcccacactgatctctggttggcatgcaccattcatccacgtaattttattggagtctgtgctaggatggagtagcacctgagcctgatgagagaaagaggaggaagagtatggaccaagactttcctaactcggagactgtctatatcaaaaaggtatccttagggctagtttccttcccaaactcttctgtgggaaaattagtttcaggaaatgcctgtaagaactgccccccagcccccaccccacaaaaagtttcacataagtttaagaaacacacctactattggcgattatcagtttatagcatctgttagcatattagggttcagaaaagtcttcccttaatgaggtgtaaatgtgtttgtgtttcacctagtatttccaaaacatctttgatacaacattttgtgtttgctgatcaatagctcgtgggaaatgttctgcagaatgcaacctaggaaatgcttcagcagatagaccatcctcacaaaatagttctgaggccgtggcatggttctttgagccccctgaaattgaatacaagatcttatatgtacgtatgtttctaggagaggactcacagcctttataattgtcaaagagcccctgaacagaaagcgcaagaattgttgttaagggctcttttctaacaagggaagtttcagtttctcttaaatttctcttatctgtatatttcatatcagcataggggatattgcccggtgagcaccgcagccactcgggggtccacactgaagaggccaagttatgaacaggggctgggcagtcacttgattattgtgtttatggttgaacagatttaaaaattggcagctactctctttccaccacgaattgtggaaagatattatctatgcaagacactgacttttagccaaactccaggtacattcaattctgaaaacagaagaaactaatgtgttatttcattgcagtaaagagacttcttgaaaagtgaaggcccactgacctgcagaagagaatgttgagagtgatttagtaatatgcaacttaaaaccaatgaactatagaaagcttttccttcaagaaatttagaacatccaactcatctacattcagatttagaaatcagcatgtattcctctgaatggtctacctttaagccaattcatcagagcatccgagagctgtgaagttggaccacattggacctttgctgaatcgcttcgatgaaatggtgctttggtgttccttaataccaaacagtaataaacagtcacttgaaacctagtagtgcttttgtcgcaaggatgttgaaatctattaaatcacagcatccttttttttttggagacagagtcttgccttgtcacccaggctctggctttgggcgcgatctcagctcactgcaagcctctgtctcctgggttcaggtgattctcttgcctcagcctcccgagtagctgggactccaggtgcgtgtcaccacacctggctaatttttgtatttttagcagagacggagtttcaccatgttggtcaggctggtctcaaactcctgacctcaggtgatcttcccgcctcggcctcccaaaatgctgggattacaggtgtgagccaccacgtttggcccacagcatccttcttattaggacctatgggagaaatttatttcagatcctagtaccagggaaagtcatactatccaaagcaactgacgtagtgtgatcttgaaactcactgcccccttttgctttgtttgctacgttcagccccatttgggactcacatttcaccattttggagggtttagtctgtgttttctgtgaaacagttttcctggagctttcttttattcttgtctgtaacatcatgagtcctgattttgcctgatctgctattaatcacaagtatttttgttagccacctcacacaggattgttaccagttaagtgagagcaggaagggaaataaagaggcccgggggaatgggctgggacagggaaggaaaatcaggaaaaggggggaagagcagagaacagactaaggagcatctggaggtattagggattcgagagagaggatcctcagaaacagtgcacagtgccaccggagttggctattaacgttttgttccattatttaaccattccgtcaaccacttgggggggttctgtaaggatctgcagattgcatagcccctgaaactggatgaagtcaagctgcatcccatagccacacactttttttttttttttcttgaggcacggtctctctctctgagccagactggaatgcagtggcacagtcatggctcactgcagccttgaactcctgggctcaagtgatcctcccacctcagcctcccaaagcgctgggattacaggtgtagccactgtgccagccacatccccctttcacagaaagcacccttaagtgttttgcttttttacgtaatccaagggatgctttaatgctggcctcagtaattcatacatttgttcaggcctcactgatttgaaatttgcaaaaatcggaggatgactctggtctaggggtagggtgccaagggatactcagaggaactgagtgccgtgccggcatgggagagcagtccttgatgtattctgatgtggcataaggagccgagacatgaaagaatcctcacaagcatcctgacactactcggaagaagcttaatgactaaaaattttctgaaaccctgtacttcccttggggaaatagtttatttctgaataaaatatttatgtggtatattgactttttaaaaatatcatctatttatcagaagggtctatgatgaattataaaattgttttgctttgttttattttgtttttgaaacagggtctcactctgttgcccgggctggagtgcagcagcatgattgaagctcactgtggcctccaccttctgggctcacgtgatccccccatctcagcctccagagtagctgggactacaggctcatgccaccgtgcccagctaatttttttatgttttgttgagatagggtcttactatgtggcccaggctggtctccaactcctgagttcaagtgatcctcctgcctcagcctcaaagtgctgggattacaggcatgagacactgtgcccagctaatattcttaagtcattttatccattaggacctattttattagcccctaataataaagataaaatattggacagatattttatccagaatccagctatttattttaaaatatgtacatttcattctactaagttgggaaggacttatttacctatatgttttccagattttgtagcactatgaaaaacattataattaataaacttgtgagttctggaacagaagtctctcatgtagaatccagtattcagaaaaatacatatttttggaacgtcttgggctttaactctcacaagttagcaagacagttagcaccgtctgtgcagatggtccccctagagttagttctgagagccaagccttgccaatagcagtcctaaataatgtatggagaatgagcttggcacaactaatgaggatccagcaatcccaccactgcgtctgtagccaaaggaaatgaaattaggatgtcagagagagatctgcactcctgtgtttattgcaacactgttcacaataaccaggatacggtagcaccctgagtgtccatctgtggatgaatgtgtaaggaaaatgtggtctgtgtctacagtggagtactattcagccataaaacagaatgaaatcctgccattgccaacatcagagctgaatatggacagcattctgtgaagtgaagtaagccaggcacagaaagacaaatgccacatgatctcactcctaggcagagtcttaaaaagttgatctcatggcagtggacaatagaatagtcattaccagaggctgggaatggggacgtcggggagatgtttgtcagagaatgtgtatttacagttagacaggaggaatcagttcaaggggttattgtacagcctggtgactcgagttcatcatgatatattcctgaacattgctaagagggtagatgttaaatgccctcaccacaaaaatgatagctgtgtcattatttaatgaacaaatgtactccaaagtacatttgtacatagtgcattactatgtagtacatttgttaattagctagatttaatctttccacaacgttcatgtacttcaaaacatcaggttgtatgcaataaatacgtacaatttatgtccatgtcaaaaaaatttgaggccaggcgtagtggctcacacctgtaatctcagcactttgggaggctgaggcaagaggatcacttgagcccaggagtttgagattagcctgggcaacatagtgaaaccctacctctaccaaaaatacaaaaaattagccaggcgtggtggtgcatgcctgtggtcccagctacttaggaggctaaggcaggaggtagaggctgtggtgagtcatgtttgcaccactgcactccagcctgagcaacaaagcgagaccctgtctaaaaaaaaataaaaaaataaaaacggatatattcttattagctaaaaggtgaccatgaaggagctgcttttaataacttggctgaaaaaaagcccatcatagaaatgactcatggaaacaaatatttgttctacatgttattctgtaccttgttcttcttgaagttcacgttgtgtatttccgatagttgaaattaaatcatttcgtcaataaatatttacagagggcctactgtgcaccaggaatttctgctaggcctcaggaatgtagcggtgactgggatgaacgtagtcactggcctcactgagccaacacaatttctctttacgttcatgtatatgagaccgagtttctggtgacaaaggctcatatcgtgttgggtttttgtagtcccggtggctaacaacttgagttgtcttgttcacccttagttccctagagccttggcgcagtcttagccagcagtgggcgttccgtaaacacagtgggcgttccgtaaacacagtgggtgttccgtaaacacagtgggcgttccgtaaacatttgtggaatgagtccgttctggccggattctccatagttcttccccaaggatttcaagtggtgttttgatcatgctaggcgccaccaaacaagccgctggtgcttaattattgtatccatacctcctgacaattcctgctcactttgtcgtttctgtctttgcagtttcccttcttaagtgttaggattttcattttccattttcctttatataacccatttaaatcacgccttcatgtccaggttagatcattcattgttcatctccaggtctcattacagcacttttttttttttttttttttgagacagggtctcgctctgtcacccaggctggagtgcagtggtgccatctcagctcgctgcaacttctgccccgccaggttcaggcgattctcctgcctcagcctcccgagtagctgagaatacgggcacatgctaccatgcccagctaatttttgtgtttttagtagagactggtttccccatgtttctcaggctaatcttgaactcgtgacttcaggtgatccccctgcctcagcctcccaaagtgctgggattacaggcatgagcccggtcagcccttttttttttttttttaaagacctcattagtcttaggagtaatacgctttctctgttcttctacattcatttcactagtcttactttagaatgtctcaattcttgtttataatatttctgattttcactgtgcactgaaactgttgaggcagtgtgctccaaacttgttgctttctgcaaagttagccgactttaagatgttctcctcttttgtagactctttaaaggtgggtgcagaatctgtatgggagttccaaatctcttttgtgcttcatgccaattagctgcagttttactacctttgtctttagttggatttgttacttcactgacagcagagttggctcctgcgtggtggaggtgccgtcggtgcctgagactgtgttgtgatgtggctgcctgaatgttccttggagaataggtttgagattttcaccctgagacacccctagctctagtattgaaagatttcaaatgagagatgattgtcagtttgctttgctgcccttgtaacattttgtctaatcactgttggtccgttgttttggcagtatcctgaatgatttttctgaacaagtccaagactgaatatggggatagtgtaaaacaaagatcaggaagaagaaatatggatgcagaattatgacaaatgaagaagtcctaagcagcattgctcattgccatttctagtgttttggtatacagagtcagagagttttcaaaaagtggagtatggcggttttttctacggctaaatttagccattgctttggaaaatcagagtggtacagcttgtgcctcatctccacccggcccttacccttccctctgcacttggacatcttaaacggcttgccagggaggagcagcttaatatactctcgtggcaccatttattctgggagggaattaagtgacttcattttccctgtccttctgagcttcctaaaaaatttaggagacttcctaagcagcgctcacagtgctctacagaaatagttgcaggcatgcctcctttgcctcctcagctctccctgccagggcagccaagggctgtaagtggaatgagagatggatggcagtgggagagcacatgtgcacttgagctacaaataacgtgttttaaaatagcagatggtatttgacgattgcttcttcattcacttacctgccaaggcaaaactttttcttctcctctggcaacaagacctgagatggctcagctcagcagttgtaataacaagttctcacgtttgccgatattattcattagctgatgtgcaggcattcatattcatggacgctttctggggctgttctagaaagtgttccttttgtttaacccgatcgaaacctcatgtttatacaacagttgaacctggctgacttgttaaacaccttggtaactaacgaaagccactcctttcattgaggggcgctgccagtcatttgtattccaaatagtccatttttctcttgaaaagggggaacatctcaaagttaggggttgggtggttttttttgtttgtttgtttgttttgtttttgaggcagagtctcactttgtcgcccaggctggagtgcagtggtgcaatctcggctcattgcaacctccctctcccaggttcaagcaattctcctgcctcagcctcctgagtggctaggactacaggcacctaccaccatgcctggctaaattttgtatttttagtagagacggggttcaccacattggccaggctggtctcaaactcctgacctcaagtgatctgcctgcctcagcctcctaaagtgctgggattacaggcgtgagccaccaggccaaagttagggtttggtatttttcatgagaaactcagtggctatagaaaagtgacactgctgggaagttccagtgtgtgcctgtgaagaagtcacctcatacccagccttgcttccagagtcttcactgtagctgcgtggtttccttccctgagcttaaagcagatggcagccagccgggcagacacttgctttccaagtcagctctgctggccttggatcactttgaccatcctctcttgcccctggacaggtgataaagctgctcactggtatatgagccacctggactgcacctggggagcggaggctgctcagggttcttgccccagagtttggatgacctcatcaataaataggctcccaggagcttaaattagaaaataatcctttccacatgcactcactttctgaatggtgctagggatacaagacaaggtccctgctttcaaaaagctcacattctagcctctagcaggaatgacacctaggaaaagaactatcccttcattggctcagtactgttaggacccagggcaaaatgtggaaggtttaccaggcatagcagaaagaacactggtctggagtccagtctgtgttcaaatctctgccctgatacttacaagtggtatgctcttgggtaagtaacaaattttcttagcatcagcttcctcatccgaaaatgaaggggaaaatctttatttcagagtcattttgaggattagacataatccatgtaaaatgtctggcttactgtagatgtccagtagctgctattattattattaataatattggagtgatgtctgagccacactctgaagagttaagaagttcaccaggtggatgaggagaaaggttggcctcggcagaggcccagaggtaagtaaaattcctggtcgtgagccaggaattttggagaacattgagttatgagagaaccctagaaacgtagcctgggatggttggtaaagaacagtccattctgtgtcacaacaaagagtttacattttattttgtatgttcaggaggagggatttattttaccttatttttatttatttatttttttgagacagagtctcactccatcgcccaggctggagtgcagtgtatttttattagagatggggtttcgccatgttggccaggctggtcttgaactcccgacctcaggtgatccgcccacctcagcctcccacagtgttgggattacaagtgtgagccaccacgcccagacagaggagggacttaattttttaaactaaattatctgataaaatatcaggaaccatctcctggtgtattgctcagtacaaccaggaaaattgattagatttgaagattgaaagtgagttgtgtaaaatccagaggaagcagtaggtgctgctggggcctgagggcctgggaaatctggctaggagctggtttcctggcatagacactttctcactcacagcagacgcccagacactcgggattctccacttttacagcagcaaatcccagcccttctaaacttagaacacactgtgggtgtctgatttcatgaaattgtctctgtctttaaaacattgctaaggaattttaaacatttaaatgaatattaatttgggacattttaaagtgagtccctttgaaggttaggaacccctgtcagagaaagaggaaaagatgtcccatgactgtgctgtgtgacacttcgtggaacagctgtgatggagaggctaggatggggtcgacccagcaaaagaaaagggaatctgaagccccaactaaccattccttgacccttgggccattgtttggaagagttttttcatcttcttcttgatcgttgtaatactcaaagctattctgggattatgagtctatttctatttatacttatgctttctaatattgttggaaactaagaattgaagtataataaggtaaatgaatatactactatactataacctatgcttatacttttgagatacaggagttaaacctgaaggtctcttttttttttagtttaatatatcaataaggtttcttttcagcatttcatttatcggtttattacagctaggtaacacacacagttactttcatcatcatttgatctatttttaaaatgccagctgggcatggtggctcatgcctgtaattgcagcactttggaaggctgaggcaggcaggaggatagcttgaggccaggagttcaggaccagtctgggcaacatagcaagaccgcagctctaaaaaaaaataccctcagaaggctctaataaacactgcagtgctatagtagacacagagacatcagtaggaactcatgtttacattagtgtgtatacaggtagatatatacatatatacgtatatttcctagctttcccatcgagaaggcctagaagcagtgatacctcaatagcaatgaacgctcagcacccagatgttcatttctaaataccgttctccaataaaaagaaccaaagctccactccttagagaaatggacagttctaggattggcacaggggaaatgagagatgaatctggagcatcttgtaatgccagaaaggaaggaagtgctaaaaggaagaaaaaaggatgagggcacgtcagaggggcataagggtcagccggaaagagctcctgatggccaaagctggaacacttggagcaacaaaataaataacagtatcagattgtgacccaaagtttagaataaatgtacaggagtccatactgatataaataagtgattgactaaatacataaataaataaggacaaatcttccttacaggagaactccaaataatatatgtagatactcccccgtctgcgaggtggaacttagttaccctcttgttgttgggactggacttagtgacttagttccaaagaacggaaagagaaaaattgtaacttcacagtacagcaatgtagcaaacattgccttaaccaaatgatggaggctgacctctccaggacatcattatacctctgattgtatgtgatgagcagggtgcctcacctctgatactcttcctaaaaacccagaacccagtctaagggttagaaaacaccaggcaaacctaaattgagggatgtctccaaaatacctgaccagtattcttcaaaactgttaaatttttgtttggagatagagtttcactctgtcacccagactggcaggctggagttcagtggtgtgatctcagctcactgcaacctctgcctcctgggttcaagtaactctcctgcctcaatctcccaagtagctgggattacaggtgcccaccaccacacccggctaatttttgtatttttagtagagatgggtttcaccatgttggccaggctagtctcaaattcctgacctcaggtgatccaccggcctcagcctcccaaagtgctgggattacaggcgcgagccactgcgcccggcctaaaactgttaaaatcttgaaaagtaaaggaatatggagaaactgtcacagatccaaggacactaaggagacttcaaaactaaacacaatgcgggatcctgggttagatcctggaacagaaaaaggacattcatggaaaaagtgctaaaatcggtttcaagtctttaatttagttaatagctctaatataccaatactagtttcttagttttgacaaatgtgccatggttacataagataccatgttagaggaaactgagtgaggggcatatgggaactctacgatctttgcaacttatctgtaaatctaaaattactcgaaaaaatgtttaattttttaaccatgctcccatagatggggctgggcagaaggccccagtctactagctcaggcataagagagtcatattccttcaaaagattgcatgtatgggccgggcgcggtggctcacgcctgtaatcctagcactttgggaggctgaggtgggcagatcacgaagtcaggagattgagaccatcctggctaacatggtgaaactccatcaatacaaaaaattagccaggtgtggtggctcatgcctgtagtcccagctactcgggaggctgaggcaggagaatggcatgaacccaggaggcggaggttgcagtgagccgagatcgcactactgcactccagcctgggcaacagagcgagactctcaaaaaaaaaaaaaaaaaaagatcgcatgtattagtttatttcatcctcacaaacaagaagggatatgtatataaatatccccattttacagatgagaaaattgaggtgcaaagtgggaatcatttttccaaagtcacacagtgacaggattaaacctggggctcttatttctactccagtgttctttgcactgtctcagagctgcccaggctgaaactgctgcttccacaaaaaaggagcacagggagaagaggttcatgaagagaagctttgaatgaatcaggagccggacggttgctatgaaagccgtcagaatgattgagtttttgtccggggatttacatgcgcgtgcatgtctggaaggtagcgggaaggaactactgcatgaaggtgaatgtatccttcctcattccctggaacctttcaggaaaatagactgctttagagaaacacgagaggcggagacagacacctggaaagacagcccatgttgtcagctgagtaaaggacaaagtaataaagaggtcagatgcaatgggaatggtagaggagtacttgatccgttgcagacagcagtgcaggtggctgggttttaaatcgttttcgagtatcgcctggtctgagttggggtgcttgagaagaaaatgtgcacccagttattgtcaacagagctactgcggatggctctggcatggttcacatgaggtgatgcctcacatacccatgctgggtaggaatctctgcttctgtttgagcaggtggttctgggatcattcttaacaggcacttgggtggaggagagaggagtcattctttcactgtggaaacaggccagggtcttagggcagcggttcttgaaatgtggccctagaccagaagcatcagaactgcctgggaccttgttagcaatgcagcctctgggtctcactcagacccactggaccaaaactctgggaatagggcccagcagtctgtcttaagaagccctcctaaagtttgagaacctctggtctagaggaatggtcactgggatgagcagaagccgccatctagggcagcacacagcctccagccaggaacaggcgggtgggtcacacacacagactcacagcctccagccaggaacaggcgggtgggtcacacacagactcacagcacacggcctctagccgggaacaggcaggtgggtcacgcacggagagtctgccactggaagggaagctgagactcacacccagaggttctgcaccagaagtaagacatcattcagagctcactttgcctgagtctttagatccaggagttatgggacttacccagaggggttaagagttggggaacctcagcccagttgacactttattttgtatcatttgatacttccttgtctgtcaaaggatttttttttgcttttgccttttcctactctgccctgctcttccatgccctcagaaagtttatagtttcgctggggaggacatggctgatagctcagtgtagttctggatctaacattcacctatacaccccgcaggatacaaactatatgtatttatttatagcctcctatgtggccacaaaagtttggtcattgttcccacttgaaggtagggtatcattgcaactaacttttgtgaggtttgtattgatacctagaaggctctaagtaggtggctctttatactgttttttactgaagcatgtatgtgtagaaatgttatgtaaatttttattttcttgggtaaaatgcttaggatggtggtgtctgtctctgggttatgcgtctgtcatcctcatgtcttcaacaggaggccagcctgtgttactagaaacaggcctctgtgcacctcttttctgtacccttgcccagagttcactcgctgcagcaaatatagagtgcctgttctgtgatgaagcaggaacttgttcttccggtgcgacggatatagcctaatatttcaggataagaactaaaaatctcagaaccgccaggcaggaagtggagctagagcagctggctttctttgcggggacctctggagcctcctgtggccttgagccacctctgagcctcatgtgcccatggaaacttgcacttgtaactttccttctgtgcagaattttctcccgatggagtagttcagctgcttcacttggactgtcctaaggacatccacttggaagccctcaaagctcaccctgttgtctttgtttgaagcatcatgggtaagaactaggaccaaactcatcagctccctaaatctacgcattattcctactcccctttctctgccttgtattaatttttttttttttttttttgagacagagtctcgctctgtcgcctagggtggagtgcagtggcgcgatctcggctcactgcaagctccgcctcctgggttcacgccattctcctgcctcagcctcctgagtagctggaactacaggcgcccgccaccacacccggctaattttttgtatttttagtagagacggggtttcaccgtgttagccaggatggtctggatctcctgatcttgtgatccacctgcctcggtctcccaaagtgctgggattacaggcgtgagccaccgcgcccagcctctgctttgtattaatttaaaactccaggtttgttcgggctgcagaaattatctgttggtcgacaaaagagggcaaggatattttcactgctgttctaagtactccctactgcctggtgcatacatagtaggtgctccagtgaatatttgtgcatgaataagtgaatctttcaaatgtacttatttactctaatgtaatcagaaattcttctttgcttctaagtaattgtattccctatatcccgtaatcacacacagcatacagttaaagcaatgcacagctctcaatttgccaaatatttcacagtgttttaattatcctaataaagctgtaaaaccaaaacaagcgtaaaggcgttgcttttggcttgctagtgtggagatgtaaagaccatcattttatccatctaagccttacaacctcaagagctgggccctggccccgtgcagaggaaaggacatgtgaggagaaagtctctctgaacttgcatagcacagtgcaacagaccgcactccctgggtgccagctcagtcatttgcatttgagattggttttttattttaattatcactcgcttcccctttggaattgagaggctcagagatgccgttatgcatgatatgattttgttaagaggcacataattgcttctgagtattttcatgaggtgcttctcagagcagcttaatatcatgcactcatggcatagcaacagggaatgcagctggggaacaaaagctggtcacctctgtggcacacacagagtcactgtgactgttggaggggttgaccgggtgacgccgtgggcagggcctgactcagtgatgtcagggaaggtctgtttctgcagtgcccgtgcttggcggggggatgggcaggggacagctgatgcggggaccgcactgcagcacactgcagcacaaagccacctccacgggcagcaggcaggctcgctccaggctgaccacagctcagagagcacctttggtgcttttctgcccctttgtctgccaccggatgttgatcttggccactcagttgcagattggttccagagtgctctggaacaagtgaaatggatgctgaaaactcgttaaccagatgcaagatttgtagacttgcagaagaaatcacagatctgtggctatggaggtttaaaattcagtcaagtcatttcaatgggatgcataacgatctccaagtaggttccgagatcaatggttgtctggcttagcagcatcaggaataagcagaggagtttataatatcctgcaaagggcaactgccatgctgcttggaactgaactctaactgaagagtcaacttcttaggcttcacatggaagagacctgtgatctgcaagatttcagatttctaacaaagaggcatggcatctggagtaaagacaccagcgcaacctctgtagtcatcttgtgttttctgctggtggtcacaggatgagaacggccgtgtgcaggttaccccacacagtgtgtattcagagttacctccctgtgggaagttgccactgagtgagacacttagtggcaggatcctccaagtttgcctgtgtctgtccatccatagttgtgcaattggaaggaagacgttatttttcgctttaaaagaggaagtatctttcttgcattgttgttcctggaagtagtttattagaaattaatatgaggaatctttttttttcttttttttttgagacagagtctcactctgtcacccaggctggagtgcagtggtgccatctcggctcactgtaacctccacctcctgagttcaagcgattttcctgtatcagcctcctgagtagctgggactacaggcatacaccaccacacccagctagctttttttgtgtttttagtagagactgggtttcaccatgttggccaggctggtcttgaactcctgacctcaagtgatctgtctcagcctctcaaagtggtgggattacaggcgtgagccaccttgcctggccagaaaataatatcaagattcttaaaaagcaaccttcctcttgcttttgtgttttagtaaagtaaaatcagtttgatctgaagtgaggactgaactgctgactgggtattgactgtcttttgagtagagctaagctttctagagagtgagaatattgtctccttctggtaagactgcctcatgcctatgcatcttttcttcccatcacccttccttcttcttggcgtatctggttatactcccagccctggggccagacagatgggttatctccatgtgcctcagttttctcatctggaaaatgaggataataacaacacctacctcacgtgatggttgtgaagagtaaatgagttaatatctgcacagtgacgcagtggtgcctggtgtgcaggaagcattctgtgagtgctatctctgcctgttgttttctctcacatggaaccgtcgtacgctttgctcgctagtcttggaatttatagtcaggatggtaaggagtggtgataaaatatttcttctccagattatccctttgcatgattcagatgactgtattttgaaaatagttatgttctcaacagttggaggagaaatatgtggtcacagctgttcagtcagcttccacagacattgacttcatttgtctaaagatgatggtgatggcaagcatgctaacctaggatttatcatgttctgagcacttacatagattaacagccctctgaggtaggtgtaactactgtccccatttaagggttgaggaaacggaggcatgaaaggttttgttctaagttcaaagctacacagcttttatatggcagagccagggctctgcacagccattcactggtctgactcctgcacacctccagctctatcgtctcctgcgtctcctgctctccctccctctgtgctccagccacacggtcttctgctccctgaaagccctgcctcagggccttcgcatgtgctattaccaggcctcagttctggacatgtttggctctttctcatcattctgagcaaactcgaagtgtcacctttcctgacttgtctaaactctgtccccatcccatccctccttattacgttatcctgccttcttcacttaccaaggcctgcctgtgctagagtagggagagacctcccctcttcgctattgaatatctggcacagtgttccttaaaatttgtgaggtgtggccaggcacggggtttcagcctgtaatcccagcactttgggaggctgaggcgggcagatcacttgaggtcaggagttcaagaccagcctggccaacatggtgaaaccccgtctctactaaaaatacaaaaaagattagctgggcctggtggcatgtgcctgtagtcccagctacttgggtggctgagccaagataatcgcttaaactcaggaggcggaggttgcagtgagccaagatcatgccattgcactccagcctgggcaacagagtgagattccatctcaaagtctcaatctctctctctctctctctctatatatatatatatatatttaacatatatatgatatatatgtcataagcgtatatagatatacatatatgaagcgagcgtgggcatgattgattttaacatcgatttaactcctcttatgtacatggataggtgacccaattctaacatgtgtatgtttgtgtgtgcatgcacatgtgtgtgtaaatgcaggaatgtggagagacgtgttctaatcttagtaaagtggtacagaatcacaacgtgttttctctttgagtttcaatcctagctccaacagtaattcctgttgtttctctgatgtagaagtgaagtacctatttatgtttgtctccgatgagacatgggttaaaagaaatgtggggctgggcgcagtggttcatgcttgtaatcccagcagtttgggaggccgaggtgggcagatcacgaggtcaggagttcaagaccagcctggccaacgtagtgaaaccccgcctctactaaaaatacaaaaattagtgaggtgtggttgcaggcatctgtagtcccagctacttgggaggctgaggcaggagaatcactttaacccgggaggcagaggttacagtgagctgagattgcgccattgcactccagcctgggcgacaccatgacactctgtctcaaaaaaaaaaaaaaaagaaaagaaagaaatgtggctgagtacggtggttcacacctgtaatcccagcacttttgattccttgagcccaggagtttgagaccaacctgggcaacatggtgaaactccatctctacaaaacaaaaacaaaaacaaaaattagctgggcatggtggtgcacacctatggttccatctgctcgggaggctgagatgggaggatggcttgagcctgggaagtggaagttgcaaataagcctagatcacaccaatgcactccagtctgggcgacaacgtgagactgtctcaaaaaagggtgtaacagtctcaggcactgaatgatgctattcctgaaataaattataaaagctagagcttggctcaggaaataaaatttaaaacaatttttttttgtaaaaactcagtgttttggtaaaagatatactacctttttttttttttgtctaacataccttcctttcttgctgtgattgctttcttctactagtttaatttaaattgtatttatttattttacttgctctagagggctctctaccagatctcatgtcagggtttccgttggggaatttgacaaagaaactagggggcaggaacctgaacctctttttgatctttgacaaaaagagaatttctggtcttttatccgagaacttcgggctgctgaaggtgccaccatcctgtgtgaggtggtgacagattcacgatcgtgctggggaactctggctggcggagacctctctggtttggtgaagttacggacggcatttggatgctggtcccgcaaggctggcgaggccacgtgttgactgcttttcttccagaacacaacctcactcttcctcctgctctgccctagataaccagttcaggatgtccatcctggaacgactggagcagatggagaggaggatggccgagatgacggggtcccagcagcacaaacaggcgagcggaggcggcagcagtggaggcggcagcgggagcgggaatggagggagccaggcacaggtacgaggcggtgctgatgctcagctcccatttcgcttcatgtttatggattggcgaggcagtggatggatcacaggcctcttctctgctgctgatgcggtccctgtattcaggcagaaggcctgagggagtactttacggtacctgtgcttttaagcattataatctgtgcagtatggaagaagccttggaatgtggagcttctcagttgtttacccccctaatccttaagttatctctattaatctcagaattcactactaaattacagggcagtgggaattaaggacaaccaattgaaaaatagaggctggctgggcatggtggctcacgcctataatcccagcgctgtaggaggccaagacgggaggattgcttgagcccaggagttcacgaccagcctgagcaacatactgagaccctgtctctatagaaaaaaaaaattttttttaattagccaggcgtggtgggacatccctgtggtcccagctactcaggaggctgaagtgggaggatcacttgagcccgggaggttgaggctgcagtgagccatgatcactccactgcactctgacctggtcaacagaataagaccctgtctcaaaaagaagaagaagaaaaaaaaaggccagatggtgacttagacctgctagggttcagaattaatttagaatcttcctactttctattctgtattttatccctatcttaagtgtaggtataaaacataattgaattcagtaattcataagccttttataaactcaaggtcagtatgaaaagagcccagagaaagtgtttatgtaatgattcagtgtagaatgacattatacattacagcctctttcacaaactttctgtaagttccataaagaatgtatgatattgccaagtacgagtaaattaccaaacattgtttcagagtcccattggtcttgaaggctttatatacatttcatttaggaagttcatttttgggaagtctcccagggagaaattatttctcaggggaccctagagataaatttaaaggaactgatggtatttcttatctccactactcagtcgttgcaaaaaaaacctcaaataatgccccctctttctcttcaagacaaatgatgatttcctttacacagttaagtttttaggtgaatatttttggttttatgaacctcataaatatcaagtttagttatattttaaataataggttaaaagaacatcatatgccacacccaaaaggctagcctccttcctccccgtgttttcatattgctcccctgtcttcagaaatcagcaggaaagaaacaacttggcacgcagtagaatattattaaggctaagataggcttcttttttttctttttgacacgaagtcttgctctgtcgcccaggtgcagtgcagtgacacaatcttggctcactgcagcctccgcctccgaggttcaagcgattctccagcctcagcctcccaagtagctgggattacaggcatgggccaccacgcctggctaattttgtatttttagtagagacggggtttccccaccttggtcagactggtctcgaactcccaacctcaggtgatccgcctgcctcggcctcccaaagtgctgggattacagacataagccaccgtgcccggccgatagtactaagttttataaaagaagtaatcattgtttaatttacctcatggctcacataagagatctccttaaaatacttttcctttcaccaacaaaagtggcataaaaggaatggtatgtaatgtcattttaaagctcagccactacgcagctggctcaaacgctatgcaactggcctagaatctcatcccatgttaaccactactgaatatcctttcatcagtttaagttgccttcagtaaatgtccgtgtttgccatgcgggatagagacatgactgtttttgtttaatacaaaaaaaaaaaaattcccttttcgttcactctggccatttccatgtgctcatgaatgtgtcttgtgtgtgtagaatggctgtgccttggccttttgagtcaaggtcagtttgcggcatgttgggatcacctaactctgctcctgtaggtgtttttacagctttgatgaggctgagataacaatcccatcatctgccttttttattttgggaggcattttttccacatttaaaaataaaaatcagcgaggagccatagtatttctgtagtaagtaaagtttatggagtttattgccagaaaaaaaaagtactttttaagtaacaccagagatacaaattagcctagaggtgccatttatttgggggagtgttaaacataaaactgctatcacagagactcacataagctgttgaagttactaactttcattttatttttcttccattacaactggttcataggaagtaacccatgtggttaaaattagtaaacttctctttcctatagcccttattgttattaataacacttaaatttcaggatctctaaatgcttttctcagtattctttttactttacataaaggactggattattggatacttctagtcatttctttaaggaaaaaacagtccgcatctaagtgatctaattctccttcagaagaagcaagaggctgggcgcggtggctcatgccaggaacctagcacttgggaggctgaggcaggcagatcacttgagatcgggtgttcgagaccagcctggccaacatggtgaaaccctatctccgctaaaaatacaaaaattagctagaaattgcttgaacctaggaagcagaggttggaatgagccaagatcgtgccactgcactccagcctgggtgacagagcgagactctgtctcaaaaaaaaaaaaaaagaaaaaagaagaagaagaaagagagtgaaagagccgctatacccgccagtggaaacattaggaaagctactctgctccactgtctcacaacagtttactgcctacaggaaggctagaaccacttttttttgtttaaggctgtgtacactttccccaagacgaatcggcatgaagttcctaatcagagtgtcagccctaatagatagactcgtgtctgtagagctgtggacttcagagaagtgctactgagctgaagctaagcacattctagtctcaatttcatggatggttcttgggggtttgggttttttgttgttgttgttgttttttgagacaaggtcttgctctgtcacccaggctggaatgcagtggcgcgatcacagctcactgtagcctcaacctctccaggctcaggtgatcttcccacctcagcctcccgagtagctgggattacaggcacccaccaccacgcctggctaatttttgtatttttagtagagatggggttagggttagggttggccaggctggtctcgaactcctgaccacaagagatctgcccgcctcagcctcccaaagtgctgggatttcaggcatgagccactgtgcgcagcctaaattttgtactttttgtagagacagggtctcaccatgttgcccaggctggtctcaaactcccgagcaatcctcccacctcggcctcccaaagtgctaggatttcaggcatgatccagcatgcccagccaatgtttctttattttcagtgttttatgttttccgttgtgagtttctaatcgtaaagcatttgtttcccctacatcgaagcgctgatggggtcgagggcctttagtcctgaggtcgtaacgtgcgcttttttgtgacagtgtgcttctgggactggggccttggggagctgctttgagagccgtgtggtcgtggtatgcgagaagatgatgagccgagcctgctgggcgaagtccaagcacttgatccactcaaagactttccgcggaatgaccctactccacctggccgctgcccagggctatgccaccctaatccagaccctcatcaaatggcggtaaggctgtggtgcagctggctgggggtcagcctcgcacatcctcgctcacattcttcctgagcactgccacccgtggaagaaatctacccattcagtccactttatagccggcgagcaaagggctttgtccttggacagtttccaagggagttttataaacttcttcccaagaaatacccagagagataagaattaaatgttggacttgtcattttctttggacccctagccaaatggagcgtccacactgccctgggactctgtttcttcaccatggggatgttatatacccagttgggtttcatcttggtggggttttataatattctggtgtttccttttaacggtggtgaatagtgtggtaatttctggtgctctcccttatagtacaaagcacgcggatagcattgacctggaactggaagttgaccccttgaatgtggaccacttctcctgtactcctctggtaaggaatggattcctgtagcccccccttgctgttcttccagtctggcataggatttgcctggttcccaccgttgtctcttgctgacacatggcatgtttcggagatactttgggatgggaatcttcaatggccccaccgagattgccagcaaggaccagtttgtcagttggcagcaatggcaaaagtcaggtctggtcttgacctctgattgagaacgcttgctgtgtctccctgtcttctagatgtgggcgtgtgccctagggcacttggaagctgccgtcgtgctgtacaagtgggaccgtcgggccatctcgattcccgactctctaggaaggctgcctttgggaattgccaggtcacggggtcatgtgaaattagcagagtgtctggagcacctgcagagagatgagcaggctcagctgggacagaaccccagaatccactgtcctgcaagcgaagagcccagcacagagagctggatggcccagtggcacagcgaagccatcagctctccagaaatacccaagggagtcactgttattgcaagcaccaacccaggtaagaattcagaatcatgacatctcagagcttgacagagatcccgtttgctttcatgcagctgccctcagcagagtccataggatagtcacatacatttcagtttttttgttaatgtttctgatttttctttaagaatgcctagtgctgccccctcccccagtacagaagaaagtagcaaaaattctatgttcatgcaagaaatacataattttggaggaggaagatctgaatctggtgtatgctactggggatatttaaatgttagggacgtgtcttgagttccggctttgcactttgtgtctctcaggcatagagaaagtgttgattcttgaggattcctagttgtatctcctgtcctgactatcctttctactgtacttttcagagctgagaagacctcgttctgaaccctctaattactacagcagtgagagccacaaagattatccggctcccaaaaagcataaattgaaccctgagtacttccagacaaggcaggagaagctgcttcccactgcactgagtctggaagagccaaatatcaggaagcaaagccctagttctaagcagtctgtccccgagacactcagccccagtgaaggagtgagggacttcagccgggaactctcccctcccactccagagactgcagcatttcaagcctctggatctcagcctgtaggaaagtggaattccaaagatctttacattggtgtgtctacagtacaggtgactggaaatccgaaggggaccagtgtaggaaaggaggcagcaccttcacaggtgcgtccacgggaaccaatgagtgtcctgatgatggctaacagagaggtggtgaatacagagctggggtcctaccgtgatagtgcagaaaatgaagaatgcggccagcccatggatgacatacaggtaaaaagcagggacagggtaagcccgcagaggctggtgcgttccagttgctgtgatctttatggtccatttccgaaggttgtgtcattttcctccccgtgaagccttcgaagttggctttgtgcagaacatcgttggagtatcttctttccttggggccacattttcattcggtgaatcgggcaccgggagtagggcctgaataccagtgaccccggtctcagcaaagccttccctctttgtaccaacttctcagaactcactgaggaccctacagtacgtcatctgcttcctccttgcatttaggttgattgatttcactgttttaagtactagttactagttagaatatagtcaagacctaaaaatagctagaacaggaagcccgtggatagattttgaattatctgagtgaccttgatcggcatagctatcatctagccattgtaaagggcatatatggcgtgaggctctcacgagggcagcgaaatattcctgaagctgataattgattgcccttataataaatctaaaaattccagaatcttttcaggaccttaaacttgttatggactaagagaatatataccaaaataaacttgacattaggctaataagcaaattccatctattaaaatatgtaggggaggaccataagggcagcctaaaaacatgtttgaattcctctctttccaacttcccattgatgcaacctaaaacaaacgtaaaagggaaaaaaaacgactcagaattcaacagggcacccatgcctgtagaagtgatacaaggagagggaggtgtgtggaggagatcatatgtcctggtcagcatatcttgggagaggcctgatttctgagccattcctgctcattgcatcccagggaccccttcatgccagccctctgctgtttgcagaggatgagaaagaagcttgcatgctcaccaatgtgttcccatttctggggagttgccgggggcaccacttctgacctaccgtattagtccattctcacgctgctgataaggacatactccagactggggaatttataaagaaaaagaggtttaatggacttacagttccacgtggttggggaggcctcacaatcatagcagaaggcgaaagtcacatcttatatggtggcaggcaagagagaatgagagccgagtgaaaggggaaaccccttataaaaccatcagatctcaagagccttcttcactaccacgagaacagtatggaggaaaccacccccgtgattcagttatctcccactgggtccctcccacaatacgtgggcattatgggagctacagttcaagattagatttgggtagggacacagccaaaccatgtcacctactgaccaccgcagtttccctaccacaacacatgggaattatgggagctacaattcaagatgagatttcggtgaggacagccaaaccatatcacctaccgaccactgcagtttccctaccacaacacatgggaattatgggagctacagttcaacatgaaatttgggtggggacacagtcaaaccatatcacctaccgaccactgcagtttccctaccacaacacatgggaattatgggagctacagttcaacatgagattttggtggggacacagccaaaccatatcacctaccaaccactgcagtcatagggaggactgcccagaaaaatcaaataatgttttagacaagagtctggtacatttcttctataaagagccaagtagtgaatatttttaggttctgtaggccatacagactttgtcctagctacttaatcggccctaacagcaccaaagcagccttagcattaaacggaggagtgtggctgtttcctagtaaaactttatttacataaacaggcagctggctgaattcagcctgccatcatttgccaaatcctgttttacacaattcctgatggaacccacaccagacaccaaaactgagcaatctagaactatataaacataaatatctaggaataagttagattacatcgaaaatcagcagctcaaaagaggggaaccaactgagcatcgagaacagtaccatccactagaccttcccacagtggtggacgtgccttctatccataccacgcaccgtgggagacacttggtgccacatgtggaatcgggcacttgatcagcatggctgtcatctagctattgtaaagggcatatgtatgaaatatagccagtgcaactcaggaactgggtttctaattttatttaagtttaaatagccattggatagagcagctttttgaaagtggccttcactgaaacagagttcatgcaggaaatagaaaataacctttaaaaaatccacttcctattttcacagatctgttagagaataacatcttgccaaattaagagcatgtgtctatgaaaaaagcagcagtctaaagaaagttttttagccaaatgagaagataacacttaaaaataatgaaataattttagaaaaagtggcaaaaccgttcatagaggagtgaacaatcaaacagtaaaactgagcaattatcgatagtgtggtatatgtgagaggaatttgttaggaagggactctttaaatagaagacgaataatgtttaaactatctcctagaactaaaattctaaattattttaacaaaaccagggagtgtagggaaatgaagagagtaaaagtgtatgaaagctctcgggttcagggacagtaacagattttgttccactcgtgatatagatagatgtgcgctggataggctgaaatatgctagttagaaatgttggccgggcgcggtggctcacacctgtaatcccagcactttgggaggccgaggcgggcggatcacgaggtcaggagatcaagaccatcctggctaacacggtgaaaccccgtctctactaaaaatataaaaaattagccaggcatggtggcgggcacctgtagtcccagtactcgggaggctgagtcagaagaatggcgtgaacccaggaggcagagcttgcagctagccgacatcgcaccactgcactccagcctgggcgacagagcgagactctctctcaaaaaaaaaaaaatgttaagttggtaggtagcataaaaacgggctacagaaggacaggtgcggtggctcatgcctgtattcttagcattttgggaggccaaggtgggaggatcacctgagttcaggagttcgagaccagcctggccaacatggtgaaactccgtctctactaaaaatacaaaaattagccaggtgtgttggcaggtccctgtaatcccagctactcgggaggctgaggcacaagaattgcttgaaccctggaggtggaggttttgctgtgttagccaggatggtctcgatctcctgaccttgtgatctgcctgcctccacctcccaaagtgctgggattacaggtgtgagccaccatgcccggcctcgggttgtttttttttttttttttaaataaaagcaggatatactatatgctacttgtaagaaatacaatcaaaatgaaatgaaagagaaacaatgaaaatgaaatgatagataacagctataatagataaacgagtataaaaagaaagataaaaagtacaattcaaggcaaattaatgtgtgtgtgtatatatacatatatatatacatacagtttatctagaagatatgacagttataaactattgtgtacctagcaccataaccttgaaacattacagcaaatactagtaaatacaaagaaatgtggacccataatcacagtgtgctactaacacacatagctcagaatttttcagatcaagtagatatgaaaagcatatgaacaagttgaacaacaaaatcagaaggcttgatttcatatatatttactatatgatagatttaatatatgatatacttatatataactatatgtgtgtatgtagttaatacacatagcaactacgtatataattgttcttttcaggtgtccaaggcatgtttatgaaaactgctcatatactaggacacgaagaaaatttgaataaaaatccaaagctacccatttaaaggccgtcttctctgagcacaatccatgaaatttagaaatgagtgacgtgacttttcaggtccaactactgagaacgttacttaagatgtttttacattgttacatgtttataaaatggaggatttaggaaagtgattgtagagtgataaccttttaggcttcagaaattccaccttacttttaatatatttgaatactttcatggaaaaagaataaagcaagatttacttcctaccgtttgagtcacaaatcaagacggccaatagagaaggtgaaagaaagctgcaatttttttttgagacagagtcttgctatgtcacccaggctggagtgcggtggtgccatcttggctcactgcaacttccatctcctgggttcaagcaattctcctgccttggcctctctagtatctgggattacagatactgtaagaaagcactaggcctgcaccaccatatctggctaattttgggggtttttttgggtagagacagggtttcgccatattgcccaggctgggcttgaactcctgagctcaggcgatccacccgcctcggcctcacaaaagtgctgagattacaggcctgagccaccacgcctggcccaatatatttttcttaaattttttatttttattgttattacaaaaacgaattgttctttgatgaaaatttataaaattatccacaataagcatttttaacagctttattgaggtataatttacgtatgataaaaaatttataaaattatccacaataagcatttttaacagctttattgaggtataatttacgtatgataaaatttacccattttaaatgctcaggggatggcttctagtaaacatatacagctgagcaaccatcaccatagtccctttctagaacacttccatctcactgcacggtgccctgtgcccatctgcagtccgtctctgcccagccttaggcaaccactgatctgattctatccccagaggtttgctttttctagacatttcatgtaagtggaatcatgcaccatgcagcccactgcggctgtttccacttagcaggatgttgttgaggctccttcgtgttggcaggagaagcattttgtcactttgtatagttccatcgagaacattttcagttcacttaagaacccgaagtgctgtgtttcagttaccactcctaagaggtatgcaaggacatttttaagaatcagtccacatctctgattctcataaagaatatcttaatccagaccagctttgaggattctttttttcttttcttttcttttttttttctgagacggagtcttactctgtcgcccaggctggagtgcagtggcgcgatcttggcttactgcaagctccacctcccaggttcatgccattctcctgcctcagcctcccgagtagctggcactacaggcgcccgccaccacgcccagctaattttttgtattttttaatagagacggggtttcaccgtgttagccaggatggtcttaatctcctgacctcgtgatccgccagccttggcctcccaaagtgctgggattacaggcgtgagccactgcgcctggcctctttttttttttttttttttttgagttggagtctcgcgctgtcgcccaggctggagtgcagtggcgcgatcttggttcactgcaacctccacctcccaggtttaagtgattctcctgcctcagcctcccacgtagctgggattataggcaagcaccaccatacctggctaatttttgtatttttagtagggacagggtttcatcatgttggccaggatggtctggaactcctgacctcaagtgatccacccacctcggcctcccaaagtgctgggattacaggcatgagccactgttcccagcctagaccggggttctctaggccagacaaaagggggtggttagatattggttatgtaactaatagtgacacctcattaatattacaggttactctagaactgcccagtgtcattaattggttgaccctgagagtagggagtacatacaagccagaagttctccaagactggactaaaggtttggggccagactatgacttggagataatcaggtctcaggatctcagcacattttggtgtgttatgttataaccttaaaatggtatttcattgcattggattgaggtggaagtctgccctcctgcctgattatttttttctctccaaggcgaggcagggaggtagacctggataacttgtaaggttcctttctaacctgagtgttctgtgaacttctgacttcaggtgaacatgatgaccttggcagaacacattattgaagccacacctgaccgaatcaagcaggagaattttgtgcccatggagtcctcaggattggaaagaacagaccctgccaccattagcagtacaatgagctggctggccagttatctagcggatgctgactgccttcccagtgctgcccagatccggtgagtaaagttacggaggtcactacccagcatagattcccggatgtaattggaggcaggggaggctgattgtatttgatgaatgccgtgtcatagaagaccataccaaggaaggaaggaagcatgaggacaagctctgttgccactttcaaggcccagctcctattcctacctctcccattattttttttactgctatcagagcataagagatcgtgttaagctgggcgcggtggctcatgcctgtaatcccagcacttttgggaggccaaggcgggtggatcacctgaggtcaggagtttgagaccagcctggccaacatggtaaaaccccgtctctactaaaaatacaaaattagccgggcatggtgataggcgcctgtaatcccagctacttgggaggctgaggcaggagaattgcttgaacccaagaggcggaggttacaatcagctgagattgcaccactgcaccccagtctgcgcaacagagcaagattctgtctcaaaaaaaagaaaaaaaagagagataatgtagcataatgtttccccctaattcagctgaagttttctaatggcagtagagtgtactgctactaggttttagtatttagcatagtactaaagttatgataggtgttgagtataaacttactcaatcgaaggacactgggtatgtttagcaacttgcctaactgaatgaaggcatgttcctaattgcccacagtggcttctggcagataccatcttggctcattcattaatatctaatgggtggtgcaaatcaatcattaatctgtctctcctttttctcctcttgtttcagaagtgcatataacgagcctctaaccccttcttctaataccagcttgagccctgttggctctcccgtcagtgaaatcgctttcgagaaacctaaccttccctccgccgcggattggtcagaattcctgagtgcatctaccagtgagaaggtagagaatgagtttgctcagctcactctgtctgatcatgaacagagagaactctatgaggctgccaggcttgtccagacagctttccggaaatacaaggtaaactagaacagaaccttcgttttgtgacattcttaagatcagagaggacagatgaaagtcagaatcatgcgaacaaaaacatttactatttctttttttcctctgaatttgtagaatttttttggaagtctccaatttattaagattcactatataacatatctgtgtgtgtatctgctttgtaaaaatattttatggtaaaatattcataacataaagtttgccattttgtctgttttaaagtgtgcagtgtgggggcattaagtatattcacagtgctgtgcaactgtcactgctacccatttccagagctttctcattctcccaaaccatttgcttttaacaaccaatttttaaacagttaaacatgaaatttttatcaaatgtttacaaagttcctaaagcaccttcatagaagagtttcagaagcgtagtcttctcagttatctgaggcatagagaataactggctgggacaagggcccatccatggttaggccagggcgggaatggggcttttccggcacagaacaatgctgatttttctttttctttttttgaaatggagtctcattctgttgccaaggctggagaagtgcagtggtgcaatctctgctcactgcaacctccacctcccaattcaggtgattctcctgcctcagcctcccaagtagctggaattactggcgcgtgccaccacacccgcctaattcttgtatttttagtagagacaggttttcacaatgttggccaggctggtctcgaactcttaacctcaagtgatccgcctgccttggcctcccaaagtgctgggattacaggcatgagccaccgcacccagccttgattttcctattctaccttgccatcctgagtacaatgtctctttattattccttaaaacaaatttcatgagttcatagaatttttaattaaagttattaatgtcacattaaataattctcagaagctttagtaaaataatgttagccaataatgtaatggttatcaccatgtcaacatactgttggtaatgataatgcgtattattcagttaatataaagtaaggtgacccctctgctgctaggaggtcgtgacctaaagcaggggttttcaactggaggcctgggggctgactccaggcagcccctgaactcctaaaattaagcagtaaagctttttctgtgtgcatttttggtgggaaggggacccatggctttctacagattctcaaagtagtctctaaccactcccaaaaaagtgttaaaagccattaatcattgatccaaaagtaaagtagttggggttatcttaggaaagatagttgagatctggcaagacaaacagtacaatgcctaatttgttaaatactttaaaagggaatatatttttagtctgcttaacattccaatatcatagttttatttagaagcaaggatagtctaaggtttattctataaattcatttttcctcatttataattaattatcaatattttttggtaaacctgggatctcaactctgagaaggtgcattaaatgagtagtaataaaaagctgacatttctggtagttaatcattactgattttttttctccttactttacccttaagggccgacccttgcgggaacagcaagaagtagctgctgctgttattcagcgttgttacagaaaatataaacaggtaaacctcagttttgcaccacagaaggaaactgtgccccacccaaggccactgaagatcctggtttggctaaagagcactacatctagtacctcattacagagacttaatttgttttttggttgtttttttttttttattttttttttgaaacggagtctggctgtgtcgcccaggctggagtgcagtggcatgatctgggctcactgcaacctccacctcccaggttcaagcgattctcctgcctcagcctcccgagtagctgggactacaggcgtgtgctaccatgcccagctgatttttctagttttagtagagtcggggtttcaccatgttgccaggctggtcttgaactcctgacctcaagtgatctgcccgccttggcctcccaaagtgctgggattacaagcatgagccgcagcgcccggccagagacttaatttgaactgccatgataaaacaaacaaacaaacaaacaaacaaacaaacaaaaacaggggaagccacacatgatggcgtgtgcctgtaatcccagctcctcaagaggctgaggccggaggatcttcttgaacccaggtgttgatgtccagcttggacctcgtctcaaaaaaaaaccagaggaaaacaaaataaaaccatctgcaattagacttgtaccgcaaaagggtttttgtccaaatttttgatcttttagtaatattacctacctgagatactggtctgatcctaacaccagtatctttgcagtgaggatccgtggtccaatactttgataaactccctagtaattagagaactgtagggaatccagggtgtgataccgtgattggagaaagtaaatgctggctatttattacctttgagtttgaattatataaggtatttaatctttggccattttcctttcagcttcttatccattttaaaatgaagaattgttaaaatctttgaaaatcagaagaagctcagaacatcttaaactgcttttgtgcaccttagttaaaggtgcaagaagattatctaagtactctttcatgcagtatttctgtttgcaaaccaccttgtagggttatgtaactagtcagatgggaaagggaagtcatatttttggggcagctagtatgcactagattttttaggtgccccatctcatttcctttttacaattatttgaagtaagcagtatttatttccagtttacagatgaagaagctgaagctcagagaaattacatgaatattaggcctttctcattatcaaggtggttataaaatattaaaaattgcctaatggagttttgactggttcacacgataaaattcaggcctgtcagtagattcgagaaccttttatcagattgtgctttaggtagttataaatttttatttaaggaataataaattctaatatgtgtaatggtcacatagaaattagggattctatcaccttgtcataatccaggacttgcctcaatttctgatatgggttgccgtttcctcaagcttctctaggattaagccctattaatgggggtggggggacgtctttggcttcgagccagttgagttcatgatcccagaaaaggaaggtttattgtgcaaacgctgacaccacagtgcctgtagctctatagcagggagccgcactggcttctgtttggtgagcaggcttcctgggagcacaagtgatacacagaatgaaggtttcaagtctgtgattacaacaggtattgattccaaaatatgagtttggttttttaaaaaaaaaaaccctccccagaaactgtcatctacagctaggaagacagaaggcattatttttggaaagagtaacaactataaaacaaatattttggaagatggaaggcattaatatagccaggttgccttttttttttttcttggttgggagttttattgattctggtttttaatttcattatattcagcaatgtaacattaatcttgtattttctgtttttcccccaagctgacatggatagccttgaaggtaatgatacacccaagccctctcacaaaccattccaccagagtcacaaacttcacacccatcaccagctacagggagggccattaagatggcacagtcatggagtaaacatatcccccttgccaggccacctaagcacagttcctctgtcgtctggggaccacgtggttattcagctggagtgggtttcgacattaataactggacattttttggctggtgttaatccatctaagccagttcctgtgagccctgtggccactaagtaaataccctttttcccaaagcgcttcactgtggcccgatgggtctgagtgtgtagtgtgcacaggtggagacgatggaaaccacaggggctctgtagtctgcagcattcttgtcttcaaagactttcagaccagtgaaaaggtaaagcaggtcagataagaccaaagaaggttcttgcagaagggtcctggttcttggacaattctgagaagtcagtttccctccctcatttcacctcctcatacatccagagatacagttaggcagatacagggattttctggggaatatttttccttgcgacggtaagttgccgtcttataagcaaagggcttcattgcaacttctcatccccagagtcatactctgtttgattagaaatttggacgtagcattttaagaccatggagagctctgtatttttagtgcctagagactgatgttgagaattcaccctgggccttcgtccctcacttctgtagctctgcagcgggctgcgtggaggactcctggcactgcctcctgggtcgtccgcagctctgtgacagccgtccaggtttcacggcttcaccaccgtgttggtcttacgagtgttcatcttttacaggttaaaatggcttaaaggtgtcagcgtttcatgataagccttgtatttgggaccttgcaactcagtcagaaacttgtcgtgtggaatgatagttaaaaatcagaggctgaatgctaagtagatttgtgtatggtgggaattggaaggcataaaaaaattatgttagtgtttcaaaactggatagaaaatattaatccgaagcatttaaaattttactgtcgaaatctgtttttagattcataaacgtctaagggtattgctattaaaatttttctccaagaagggcaagatattttgatattttagggaaaaaatatatgtctgaaggcaacccttaaagtaatattttacattttggaaaggtaggtgtaaagattcctcatttgcctcttttgtgattaaaccccggacagagaatgtgataatagaggggaaaagcattttctcttcttcccttcccggtaagctcgaaggacgctgagcccgtgcagcccctgttgttactgtgtcgcttgttcttgtttcccctgcagtacgcactttataaaaagatgacacaggctgccatccttatccagagcaaattccgaagttactatgaacaaaaaaaattccagcagagccgacgggctgctgtgctcatccaaaagtactaccgaagttataagaaatgtggcaaaagacggcaggctcgccggacggctgtgattgtacaacagaaactcaggtgggtggagaagagctcatggaggtaaagctccctagggaagagaactctgacttctttgaaagacttgtcctgggctgacattggagtctggggtgggcctaaagcattggcagtcactgtgttccagaacgttttaggcatggtggctgataagtacacctgtgctgagtctggttttgaatatttagctctttctctccacctcccacccaattattttgatattgccacccaattttaccttatatcagaatttggcagcaccagtttctactcagaaagttaccactcaattatagtagtttaacccatttcctgtttaggaaaaaaaaaaaaaagtacagcccgctgccagcactcatgtaattttacataaacatgctctttgaggctgaaggaaatctgattttcaatgtgaaaataaaatatgaaaactattcttggagttatttctaaacagaacttgttcctaatcctaatgtaactgaaacgtatatgatgctacattccgattagagacaaggctattcttgacacaaatgggaaatgagtgaaattgtagaattactgcatgtgagaccttgggagagtaattagggttaagctgttccattttagagactgtaataaaaatgttgagccaagtaaaatatattgatcagtacatttacaaaatagcccaaagagtgtatcaactccggtgaatcaccttgtaaactaagaaagcctctctaatgccagaatgccttttgtggcaaaatgagcttataatgaattgtggaagaatatttaagtgacattttattttcagtctttgtatagtctgtcttgaagctgagagcgcctatacacaccctcctttctcctctagtgatgcccggactcgatactatgggaacagcatacgcactcatcccccttcagattgtatacatctttaacatatgctgttggctttgctacacgaactgcttaattcagagtcctctgtcactgctgaccagttttccatattgggctttactgtaaccttcttgtgacaataatattctgactttttcaggagcagtttgctaaccaaaaagcaggatcaagctgctcgaaaaataatgaggtttcttcgccgctgtcgccacaggtacactagtccttgtttatacattctgctcagggagaatgatgaagcaaccctgaccttcttaaccctcactaactcctatgtaaagctaatccccctgcagataatcagggcagacgtcccaaattacaatagggcggtagagctctttaactagggatcaggttgctacccttggagtgctggtaaccatgtcagacgatgctgtttgaacaatggagattcatgcccgtgtttttctgttttaatttgggtgtgaggtcaacttagtcggactagcttttaattctaagtttctctttaacctgtgattgatatgccacattgcagtatgttctttgctctaatcctttactatgctagcgcgtgtccaaacagaaaacagtttctagtctcaaggaagggaaagaaaaccacgaattccaaacaagttttctgatgtagaatttccaccagatagctggtgccctctgctggtcatgtaatcgccaacatgctctattattaaactatcaattaaagccggtccgtgatgaggaacaggagagatcactggaatgcagctgttcaggaaaagaaagacatctgagactctgggcacatcttcaattagtaggaaatggggtcctgtgaccccagcattctgtgggatgcagcatcttctcatggagctaagccagaggaatttctctttgttcctcaaatttgagatttctttatgaagactagcgtctctacttagatttcagagggctggtgaaagtggtttgtgttctttatccaggtgaatattccagtctgacgtctgtaactgcggccatccgagctgggtgtagaccaccttctgtgtggttgggttgttgctctgtgtgtcaggagctgtgcagtttataataccaaacattaaagcagactctctaatgtcttacttcctcttcctatttaattataccaaaagtcctagtattcatatttaattggattccttggatgtttcattttgctttagtttttcttactcctataccatatgattgccggctttgaaaatatcttgcctttaagacttaataggtttaatgggttatttgtacttttacttaaattaacagaagaatttatttttgtgaccatagaaggaaacatgcacagccactgcattaacatcataaaaacttaaaaaacggcattcactaagatagatggttttccccagctatgatgccatgcagaagctaatgttcactcgccctgtgcctcagcaacatttactttccaccatgcaaggatgggagatttttcaccatgatagctaatgagtaacataccagtgtcagtactctgaaacaggaagtcctgttaggaaatgcatccccaaaacgggtatggctctaagatcatgaaattaattctgcaagccttaccaaaggcagcctctttcctttattattcaatcataccttttacttagcagggacttaggaccaaagagagtagctgattttctttatatggtgaacagatcaaggactcacctgggcccttttccttacattctccaatacgttcatagttccttcctcccttttcctcttcgacctgcaaaatgaaaaacctgagcaagatcctatccagcactgaaaccaatagactttggccactttgagcagaatcacatcttctttcatgacactgtggttaatactttccagatagattttgttttcaagaaaattaccttaacaccactcttctttaggccacttcagacaaaccagaatgtctgcaagttaagtcgtgctagactttttcctcctttcttctagtctgatcctcaaactttgaatgaatgtgtgggtaacgtgggagcaaaattgcataaagtcctacactcatctcccttttgtttttgccaaagctgtgtcccgtgtttactttgggagagttaagagaatgagatatttaaacaaaacataaattcatgaaaggttgcccccacaaagtaagctgaacaaaggagtcctttcacttttgtttttagagttctctttctgtaaactggtagaggaaaatttcatgaagatttttgccttaagtataaattttaactgttaataaccttataagatggataacaagaaggttcattatgaagagaacatcagatacgggctctggattcctgtgcattaattggaatgaaataaaaaatgttattggctctttacttgaccatttacagtttagatgttagaaaaataggcaaattttaatagcctctgtaataagatcagtattcacttcccatttctatatattcaattaatatgttcaatcttgaagaaatcctaaaaatctatcctggaagtttgttttaaactgatattttctttaggatgtgtgtaatcctattttcattctgggttgagttatttaatgttattttaaaagaaactattcatgtctgttgtccttagaagcattaaaatcttattaagatagaaaaccttggccaggtgcggtggctcacgcctgtaatctcagtactttgggaggccgaggcaggcagatcacttgaggtcaggagtttgagaccagcctggccgacatggtgaaaccctgtctctactaaagatacaaaaaattagctgggcgtggtggtacgcacctgtaatcccagctacttgggaggctggggcaggagaatctcttgaacctgggaagcggaggctgcagtgagccaagattgcaccattgctctccagcctgggcgacagggagagactccgtctcaaaaaaaaaaaaaaaaaaaaaaaaaaggaaaacctcatatgacaccctctcaaaaaggtaggtagatagtagcttcaggaatcagtcagaagtatcccatttctaagtcatatgaccccaattttttaagacttaaattgatgaatttttttacctactcatttcacgtaccccaccatcactctccttttctttctttccaaaaaagaaaccatgttatattcttttttgttgaaataaagctatttgtaagatttctgttgtgaccctcatgtgctaatagctctctggtgttgttttactgtctaaagccccctggtggaccataggctgtacaaaagggtgagtttagctgcctgctagccagtttctcttctcttccattttcagtattttgctttttgcttgcttgcatgaggctgcagcctaggtatgccagtaagtttcacatccattttgaatgaattaaaatcaagtaaaaactaaccctaattactaacactgctattttatatgacaggagaacagtcacatacattagatgtacaaatgcatgagtgagtagaagggagggccgttccaaaccactgcagggcatgccgaggatgcggtggaggaagcctcaggacgaaaacagggctggcaggccacgtacacggccaaataacgctgcgttatacgaaaacattcagccagtggctttttgtgattaagataatttgccacatgaaattttctcaacgattgctttgtcaaaatttctaaagcaaggaggctcactaggaggtcgtactagggttttttttttttaatgaatctatttcttactgagaatgactgtttccctataccctgctcctgtgcctgcattttctaaatctctccctccctggtgctgtgaggtaagtcactgtacaaggctgccctttcagaacaaacccaggacgttcattataaaatagcgaactggccttccagcacttgatgggaatgctgaataatgaaaatgtggtgtgaaatgtctcgaatatttatattttacataacaagagcagggattccaataggctttgaattttagagaaattacaatgagtaattttagttcctgagattttagaatatgatgctagtttgtaagcagggcaaaaggcaacagtctcccagaagcaactataatgtgtttgaattataataaaagatttagtgtccgaaaaccattttttcaaagccaggaataggccaggtacgatggctcatgcctataatcccagtgctttgggaggctgaggtgggaggagtgcttgagcccaggagttcagtgccagcctgggcaacatagggagactccatctctacaaaagataaaaaattaaccaggcgtggtagggcatgcctgtggtcccagctactccggagactgaggtgggaggatcatgtaagcctgggaggttgaggctgcagtgagctgtgaacatgccactgcactccagcctgagcaacagagcgagaccctgtctcaaacaaaacaaaacaaaacaaaacaaaaaacgccaggaatagaattcatcaaaatttaattaatttaaatgaatttagattaatttgacaacctgtttcttatatataatcttaagagaaaaaatgagttgaaattataacatgggaattttctctatcaactcaactatattcaatgccccctcttcttaaccttacactaatactttatttagtcatctttaagatttctgagaaaaggtcatagttcaaaaaatcttaaaactgctaatgtttctggagatattatttcccatctaactagacttatgttggtgctaatctttatttattatattttaacccagaagttggcaaatgtttttctgaaaggccagatagtaaataccttaagctttgtgggctgtatggtctgtcccaactactcagttcttttaatgtagcaggaaagcagccacagacaacacataaatgaatggctatggctgtgttctaatacaactttatttatacaaatagatactggactagattttggcccacaggttgtagtatgccaacttgatgatagaagaatttagtttttataagttcttcttaataatgaccttaaccctagatttaaaagctttaaaagggccggccatggtggctcatgcctgtaatcccaacactttgggaggccgaggcagccggatcacttgaggtcaggagttcgagaccagcctggccaacgtggtcaaaccgtgtctctactaaaaatacaaaaattagctggccatggtggcgtgtgcaggagaatctgttgaacccgggaggcagaggttgcagtgagccaagattgtgccactgcactccagcctgggcgacagagcaagactctgtctcaaaagaaaaaaaagagaaaagcctaaaaagccttaaaattttaaagatttaaaggctcatttatttaaaactataaataattgctaaaggaaaaatttgttttttgggggaaaaaagcagctatactcttacgtaaacttaactaattaatcctctctagacttaaggaattgttctcaattaaaatatttcaggtcccttgtgatagagctggctcggagacgttttttttgaaatgtaagaaaaaaagaggacaaaaatctccatttctccctctattccctctcaccctctgcatatatatagataatctttctttccattttaaaaaacctccaagagaatagatgcatgccctagtgttcagttcaactacaacttgtagtatcatgcatgttatatgcaattaatatcacctgctgcaaggacaacatttttacgggaggtggttgcttatgcgtttttgaaacttgttagtttctggtatgttaatgaccgtttttaagagcacattttcagaaggtgcttttcaatgcaaaccagaatcccaacctcaatttctttaatgcctgctgcattctattgtgaactcctaaaactcctactcatgcatggaaagttggaatctcatgacaccccttatgcctcacgacatctatgcaagtttgagagataggggctgagaaggttccttctatcctggtgatatttagctaactctgtgaaccaaggaatagcgtatatatggctttgtatgattgccaataagatcttctctccctcgttcttccatcggagaagtcacagtggcactccctctaacaatccccaagttgaaattagtcttgggaggcagagcattctctgaggaagatttatagtcgtggaaattatgttaagataaaatacttatttttgggccgggcgcggtggcttacgcctgtaatcccagcactttgggaggccgaggcgggcggatcacgaggtcaggagatcgagaccatcctggctaacatggtgaaaccccgtctctactgaaaatacaaaaaattagccggttgcggtggcgggcgcctgtagtcccagctactcgggaggctgaggcaggagaatggtgtgaatccgggaggcggagcttgcagtgagccgagatagcgccactgcagtccggcctgggcaaaagagcgagactctgtctcaaaaaaaaaaaaaaaaaaaaagataatatacttattttgttaatttgtaaagtattccatatttaaaacatggtttatacattgaaaaataatattttcccagctactggaggctgaggtgggaggattgcttgagcccagaaggtcgaggctacagtgtgtcatgatagtgccactgtactccagcctgcacaacagagtgagaccctgtcccagaaaagaaaagaaaagaaaagaaaaataatatctggaaacttacagaattaaattttatgggacagtatttgttaaacactaatactgacccaaactcctacgtcagtggagcagggggagatctaaaaaggcagaattaagacacgacagacaaattccagcagcagagcaatcagaaaataccacttgtgtcttgaaatgtttagtctttgcttggggaaggctaagaaaaagcaccaaatatttttcactgagtacagctcacttttatccccctttccttcaggcctacctcttaatttatccagtaacttaaagtgaaattaacaaactctcgatactgtcatcagggtttttggttgttttgttttttgtttttctgttttttgtcttggacacaatagctgtgtttaggagagaacttttgttctacacaaagagattatttaaattaacaaaagtgatttctcagcaaatgactgaaggatttttaaggtttaagaaacttttaaagtacatatgctgaaaagatactttcatttggattttgagtatatctaacaggatattattcagttgcatagagaaaaaccaagatacctcatatgttagcaggtagttcagttacataacagatttatcctcaaggtattgagacttgcttgacctaaaaaaataaaaactaaaatgcctgtttttctagacagaaaatgtctttccacttctctaagacatttatttttcgtggatagtagaaagtgttctcatagatgagtgacaccgctctttgaaaagcaatttctagacaaattcctcctttcccgatacgagacactatttctgtgagaaggctttataaactgtaacaatcactatgggtgttattaaaagcagtgggaatgctagtatttaattaacctatttcttataaactgctggcctagtcacctgtgttcagtaaaggcaggtgcagttattttactggaacaaaaccttaattggaggaagaagaaataacactttttagtcacatattttcaaacaacatattttctttttatttgagaaccgggtttccaaacactttgccagaagctggtaagtaggggtctcaacagagcagctctgctgtgtgcttctgagaacagccccgggtcatagctgcactgggtcattaccaagttctgaaaattacgcttacacttttggctgttttatgtacacttttatccaagggacagttctctaacaatgcggggaagtgtactgagaagtaaacagtgctctagggtcaacaaatgtgttctcacacttccgtagctcaatttggcatgaggcatagtttctaagtggcccgatgtgttcatgagaagtaagacgtgaatgtgggatgtgtcatcatggatgtattttaaatcttcaaagtaattttgtctcacttgcctcttttaggaaatgaatatttttggaacacagtggtgtgtgttaaattgcagacaacatgctctgtgtcattcttattgggcctctctgtcttttttgttttgcaatccaaatgagatttctggaaaatggcaagatctctcttttcctaaattccccacaagctattgcagctctcaaagcaacaggtaataatcagaaagccgcatccgctgccctgtctatttttgacgtccagcattgcgagaatattcccgctgaactccactgactcatgagacatttctctggctgagcatcactgagtagatgtaatgaagcagctttgccttacgctttacccatggagccattgtttgctacaagtttctgaagcaggcctacttcattgattcataaatgatcattggacgtctgatggaagtaaaccctgtgggcttttgctggctttcagtgctgttgcttacgacatcacttcagtacattacgatgcaactttttgggaagggggaattgagactacaatggtatcccagagtggtgattattctcagcctagaatgcttggggaaatactgggattgtctttaatgttaatagctgaatggtaacaggtcagtcttgctattctaattactgtgagtctgagccaataagagttctactttgcaagttactgataggagtcagaaatgtggccgcacagctctcctgagggcagcactggcgctgtgggaactgtagcttctgtcctgcattgcctctatgagctcagggaagactgctttgcctgtcttctgtgtaagtgaatttagaagtaagtgcagttataattttttttttttagatagcctggacatttttagattcagttctttcttagccctgaatgagtcgaacagttgtaattccttaagagaactgagcactcagtaacccttagctaagtgtgtgtaacataacaaaagtttatcatgcacctgtgttccaagttctatagatatggtgaccacaggtcctggattttcaagtctaattccaatttcaaaaattcttgtctatatttaccaagtttgtatactgaaaaatttgcttacaacataggtaatgttaatgaaaccagttcagtccattgattttggtttcagtctacaaaattgaatttttttccttccaatgaatttttcagttgtttttatataatatgaacacagcatttgtaagacagattagtaacagacagatagaaaacgatctaattcactttttttttttaagactaacaagcagctcatgcctgtaatcccagcacttttgggggctgaggcaggagaattgcttgaggccaggagttcaagaccagcttgggcaatatatttagatcccctgtctagacaaaaaaattttaaaattagccaggtatggtgatgtgtacctgtagtctagctactcaggaggctaaggctaaggattgcttgagcccagaaattccaggccacagtgagctatgactgttccactgcactccagtctggtcaaccctctctctaaataagtggagaaaataaaagctaacaagcaggaataattattattacaaaagcagcacatactaattgtagtgaattctggaaatacaaataaccaaggagaatcacccagagataataatggttaaacttctattttgtatccttctcattggtaaagatttatttttaacatctgcctgaataatcattcatgtccttaactaataacaaggtgatcataaatttagccatttgaaacactctgatttgaaacatctatttcttaaaatttgttttaaaattctagtatatgttattctaaatcactttggtgatataattgttttctgtttctttggaggcaatataacattcaaacattattttatccagttgacatttgatttaaaacaaaacaaaaattaagccccactgtctcatcctaataatctactctcaagtaacataaaacttcatttatgatttcactagggcagatagtaagcctctcaatttcatgttaactttcagaggtaagttaacatctatatggtccataaattgcaaattggagaataaagctaaaaatctcccttgattcttacacacattcttttcacacattttaggattctaaataattgtgttgtaaaatcaataagtacattttatgtgagggtcttcccccaccaagaatgttttttattaataaaatcaatatagtgtcttataaaagatgacaccttagaattgagaaaatgtaattgttgttaatttcatctcataccatggaaattttccaaatgcatgtttcttataaagtcttttagaaaaaacaataaaatatgatttttaaaatacttctgtgttatcctgggagatatttttagagacagtgaaatgttgaaactataggtttggaagtcagacaaacctggactcaattccctgttctgccatttattaactgtgtgaattggggcagattgcttaattcctataaatctcagattctgcatttacaaattggagctaatggcagtgttgtgaggactacataaagtaacagatattaagtaacctgtatagctattggaatttaatactttttctctctcattttccccttttttttctaattcctccttgaacgactttctgtaaaaaatgtttgtgccatttaagtcattttgatgtcatgtataatgctagcatactatgataactttatcatgaagctaagaactaaattctccactttaactcaggagttgtggaagcctggaaaatatatctgaaaattgcattgttctcatttttcctgcgtagacattgtacgtggacatgcacctctccttaacctcgtggtctgtgaggccatcactaatttcatagagtatttacttgacaactttaaaaccttatgaaaacttaactttttaattagttctgaaagaaactgaaaaaactgcaaaaacaaatgtgaccattttaactaaaagaaaaatgtttagggtatacctcccctgaccagctgattatagattctttggtatgaaaccacataaaacatttctggcttataattcactctcctttttatttcatctcaatgatgaacttaatatttctaaagcattcctgttcattcgagaaaaattgtgaatgtataacatcgtcgtgtttatgctatcagattttgagttcagaattcctcaaattatagacatctcatcagtgatggagtcactgtcgcatatttgtgaatgaggtctgtgctagtgcagaaagaaaatgtagcatttgaagtggcatgcacacgctgcagaaattcagcagataggtctgcacaagtacagatattgcatgtccagaagcgaagttggcatcagtgcatgccttgcatttccagccaaagggatgttagtatagatattgcatgtttaaaaattgaacagactatagcatgtttcaatttttaaaaagccatttatttatcaagtatgcatgtccaaaattagggacctatagtgatgtacaattctatactgtaatatgacccaaattaatccatggtatatttaattataaaatttaaaactaaatgatatttggatctactcatgaacatagcaatgtattctaactgtgcctgttaacaaaaaaagattcaacagttttagagatacactgtttgtcactgtcatttataaaaatcacactaggaccaagctagggcttggtatatgtagtaagtaaatcagacaagtaagcaagttttcaaagattataattctttttagtattactgataacatcataaagcttttcttctaaaagagagcatcttctctatgaagagattgtatcaactttgcagaatactcagaaatgattctgcttggaagtggtaaatataaatgttttcttaaattgctattataccatatgtgccattccagactctcaacctatacaatatagcaataactgattactggttttttcacactattttctttctgcctgagtattatcaggttttacttgaggctgggcctggtaggctcatgcctgtaattcaagcactttgggaggctgaggtgggcagatcacttgagctcaggagttcaagaccagcctggccaacatggcgaaacatcatctctactaaaaatacaaaaattagctaggcgtggtggtgcgtgcctgtaatcccagctactcgggaggctgaggcaggagaatcacttgaacccaggaggcagaagttgcagtgagccgagatcgcaccactgcactccagcctgggcaacagagttagactccgtctcaaaaaaaaaaaaaagttttactttactggtataacttaagataataggagagcctcttagagaatcagaaaaatatatttgagattatagccctctgtatagcaccacgacaaatccaccttttcctgatcatgctgttgcagtagagtatggtgtcctaagaaactgttgctcctatttggctaaatcagcctctcacatccatttttgggaaacaaatgttattatatggtatgcagtaccacaaactgtgacttacaccacatgcattgccttacatttgatcattctgctattaaggcaggttcgtaattgtcagtgtagagaaatactcttacagcagacagcagcttccccagcaccccatctacatcaggtggccatatccaaaaaaactgagactgatttttatattaaaaattacagattggcagtgataattaataagtaatttgctgatgtgaactttccatgactcagtctataacaatgttatttaaatttgtttactacagtatgtttgatgaatagaacgaagtaccttatcagtatcgcaccctatggctgtccatctgggatcactgggaggaggaacctaaatgtctttttaagttataatgtggaatgggaggaaagtaaggaattataaaaatcaaagtctccacaaaacctgtgtgaaggagtagagttgtacagatgtatgattaggttcaagaaagctaacaatcttgagtctatgaacaaagcagtagtagcttaatccctagatatattaaaagctaaataggccgggcgcggtggctcacgcctgtaatcccagcactttgggaggctgggtgggcggatcacgaggtcaggagatcgaaaccatcctggctaacatggtgaaaccctgtctctactaaaaaatacagaaaattagccgggtgtggtggcgggcgcctgtagtcccagctactcgggaggctaaggcaggagaattgcgtgaacccgggaggcggaggttgcagtgagccgagatggtgccactgcactccagcctgggtaacacagcgagattctgtctcaaaaaaaaaaaaaaaaaaactaaataaatgcatgtacagtttccctaatttacatcatacagagtgataggacattaatggtggtccacgagactaaaaagaaagttatttgaatagttaaatttttattaagataaacatgtgattgtcacacttgatttaatacattagactttgattttgctctattcttagagcgctcgatgtagagcaaagctttagaatgatttttttttcaccttaagtagggtcacgtctttcctttgaatattttccccaacaatttcacaggagtttcttttgccgtcaatcctcaaaacggttttagtcttggcttttcagttcagagggagtggtaatacccctttcctttacttggtcacaattcactatagagttatcgcctgctgttttgttttgtttctcttccagagtgaaagaattgaaaaaggccaaggaacttgaagacatacagcagcatcccttagcaatgtgacattgcttttcagactgttttcatttctgtttttagcagagacatgcaacaacaacacacacgcacacacgcacacacacacacgtacacacacatacaaaatccctctgcagttttggggagatcagctgcaggattttaacaggaatgttttggtcattgcatttgcactttcatggacaacttttaatttgatcagcaagacatcttggaactcaatcttctgttggatcacgggaaatcaagacacccaggaggaattgaaagaggcttcctcttctcaggaagaagccatttccttctcatatagggctgtattcaaacatcgtgtggaactgtacaaatatttataccaaaaatatagataagaaaaggtggggctatactagcaacaaaaaaagaatgctgttcctgcacctgccggttatttccaagaagctgaatctttgggactgattctcagtggagggcttagatcatacaaaaatctttattgggtccgtgtgttctcatttccttcactgtttatttttgtttgtttgtttgtttgttttaatctctacagcacatttaatgcaacttttgaaatctgcaggtttttaatgtcttgtggaaatttgcagaggggcaggtgtgtggtaaacgggtaatgcatgggaaataatgagaagcagctcacagagtttaaactattttcttgtccccaccaccttccaagaacctgcgagggtagtaatcatcttgtcccctttttcatgttcagcactttaatttttttgccttactttcatgtgcaatgagaattacttaagaattggtaacgcatgtagccttttttagtaaccttggaagctgtagtaattctaaggaatcatgaaccttgcctggacatttgccacctaaacgatcagtgtggtgctgcgttctggccagtaaattccatgtttttggctatatctcatccaaactgagcagtttctgtgtatatatagaaggtagaaatgaaaagtgagaaaatatttgaaagggattatattaattgctaaatattttattcacaaaggtcaataacatggcaagataaaattatttgtatagttttgtctgaatgagcgagaaaaatgtggatgtactgtttgtatatattgtatatattaaaacagagatatgtgcatgaaatcaagaaaaaagaaatgaacaaaagcaaagcattagtggctatggtctgtaaaatgaaacaaaaaaactttatttcactataagagtactttattttaaatgttctttaggagaacattttgctaaagcatgactaaactgcaaaaaaaaaaaaagagctactgtatttagacttaggaaaaaaggcagagtaacattacttaaaaaaaaaaggatatgtttacatttaattttggctaccaggagtttagtttattttatttaaaatttttttgccaatggtgccaagtaatgtgaatgctaatactgcttaagaaaattaagttacttttgcaaaacagataatcataagatgaatcagtatgtagcttaacaccatccactcactccaacaaagaacacttagaatgataaaaaaaaaaaaaaaaaacctgacaaaagaaatagtatgaaaagtagaaaaatgtcacgtttccatatctcctgctggaaatcagaaaatataataaaattgcacaaaaaaaaaaatgaaaaagatgcagactggtcttttagagacggcatggtatattactatttccacataatgaggagccaaagaaatctgatgtttttaacaattaaactgctaatgttaaattgagagaataaagttcgtatttgctgatgccagtttaaaattcccaggttacgtctgaggatcagttggtgtaaagctgagatgttttttcttggttctggctgccaactgtgagttaaaactcaaggcttgttgtgaagcctaaaaatattcacaaataagcttttaaactggtgtctttggaaggaaggtagatacaaaaagattgtggtaaaaactggggtcagtgctcttggtgccttttctataattgtacttgttttttaattacttcctttcactgccaacctcgaattactgtacagtatatgtctttctgcttgtgatcagctttgacaacagtgacagccccacaactagtagccacctgtacatttgtaaactgacctgactccattttgtttttaaatgtgtgggttatgttgcagctgttgcagtcccccagatacctattattttacacaatttgacctataggaggacactgagtaatttacaaacacaactgcattcataaatgggaatagaacgtgaaagccagctctttcagaatatcctctattaatactgaatttagatatctttattccatttattatggtacaaataactgatgttttaaccagagtaatgacctcagtggatttgctttaaccctcacattttttttttaatgtttcacatgttacattattagctgaatacgttagaaaatgacagatggtagagacttccatagaattaagagggttctcatggaggggataggaagtaggtttaaagcctaccagtgtaacctaccagtacaactgtgaatcctaggcaaggcaaaaatgcacttccactgaaacgaagcatttctgaccgctttttcttggttatgaatcttaatttcgaatataagatgataggtaagcgcagctttcttggataatctgaattcccaagtgccaggagtaggatttcattataaaattaatagctaatcttattctatctcctgaagatttaattgctattgttacccattcgaaatcagctgtactgtgtgaacgaaataaagacaataatacgaacccctctctggctgcacggtcgcttatggcagttccacacagtagttggcgcccaatggggggtccctgagacttgcatgtaaaactagtctagatgtcttctttttttgtaagttttatttttgtaattgtgcatgtaaagcatcattgaatcaatggatctgttgaagaactcagctgctggaaaccatgcaaaatgttttgaattgcccttaaaatatggaaaatgttttctgaatgctttatattctttctgctgtaaattaaaaatgaagaaaatttccccata

SEQ ID NO: 2382 - DNA, 86725 bp, Homo sapiens
ggacgctcctcccggagagtagtgagacccctggtgcggggcgattggcggcgggagcgatgagtggcagccgcacggcccaacgggagctgtgcgtgggccgcggggcggggccagggcgggtgcgcggcggcggcggggtggctgggccggcggcggcggcggtacgaggcgcgcgctcggggtcccggtcgcgaggaggaggaggatgtggcgcgcggaggggaaatggctgccgaaaacaagccggaaggtaagagccggagcgcgaggggctggggggcggcgcggcgggcggcgggacccggccccgccggacatcccgggcatcggcggcgccgggcgggagcgcgggggcgcggcgggcgggcgggcgggcgacccggccggggagggggccggcggggtgggggggcggagcgcggccgagtcctgaggtgactcgcggggccggcggagcgcggcgccccacaccccacccccgggggcgggctggggccggagggggcggggggctcgcggggcggggaccgggcccagcgaggaggaggagccggcggagggccggcgcctcccccacccggaccgggcatccccgccgctcccgagcccgctgcgcggcccccgcacccccggcgctgggtccacggtgggggccgcggggcggaaagtttatccgcctcgggtcctcctggccccgcgccccactgctccgggccggtccccgtcgggcggcagcggccggcgctcagccctcgccggccccctgctctccggcgggcagggccagatgtactctctccggcaccctcttcagccccgtggacacctccctgagcgggcggggggtccccgagcttctccccgccagggggaccccgtcctgccgagcgtccctcggccgaagggcctcgtgtgacccctcccccttcgcttcccgggaagggaagggggcctgcgcagcatccccgcccctcgcagtcgttcacatcctactcttgcccttgcaccctcacagccaggagggtggggtctccgtttctatggcaagtgaggatctccacactcccttgccctttaccttccgtgaccccgatccttccttggcacaggggtccgtctgatctgctcatcttctttggattcttttggggcctctgcacactctccgttgaccctttttgccaggacaaggggactcaggctgcccatgttcttctttcctcacccagtggatagtgggggcttgtgcagctctgaagtcatttctaaataggaaagcagacacttcttccagatcatgcatactcttacactttgctgggttagggcgagctcatttcctaaataccctttgagttgccctccttttcttatggagacaactggacgttcaccgtgctcctttcgccatttgtgtgtctacactgacttgttctctcttctcggagttccttgtctgggtgagagtgggcgccccaataagatgtagggcagggcttccattgtgcctagtgcttgagtgaaaaggggccacactagttgctcctgtgtctgaggaagaccggggtatatttttgcctccacttgactcttgtgtctcaggagggggcaaccttcatcagttgacactacctcactgggaaaagggtcatgtggccttgttttttgatgttttgattactgtcttctgtgcagtgagaaccagactttgtccgtcccacactcaagagtccttgaacctttcctggatataaacttcccgattgttttttgagagaactcatatcctcctctgtggcttctgcttcgcagtcagccatatttagtgagcctgttactttgactttttctaattttctcaaattgtattcatgttggctgggtaaggagaagccatatgcctttccattcagaaaagggagtgtagacacccgtgtcgcccacatgccatcctggaagaggttgcttgtgtgctccttgttgtactagaaccttcctttggctctggtgttgtctcttgtgggatccagacatttctttagatcttgtagctttcagaagggggaatttgaatgctttctgttttttgctgttccggttctgctttggagaaccagatcatgatgctatattcatttgtttacatatacatacatgtaggtatacacagatgaaatcacattcattacatatacagtgcacaggaagttggaagggtcagatgactagctctacattttgggtgcatatggggacctttatgtgtaatgatacagatagatattaacgttgttggtaactcttcaggcttagaagcagcagcagaagaatcacggataaatggccaattctgactattctttggtttgtaatgtgtactgtactgaataagcagaacgacatcctgcgtgttcaccaagtccctgaatgtgcgaagcgtacagtgcctgcccatacgcatcgcaactttggcggtctgaatttaggggtggtattcgttgcttgattctgcatagagtgaaaagttcttgatttctttactgcagtgtaggggaaagagatttcgtgtgtttggacaaacgacaggagatgggtgagaagaatatgttttcctgtgacagaactaggaacgaatgaccgtaaatatgtcccttttgtattttggccatttaaataattgagagaggttgtgaaattagcaaaatgtacctgtggaaaggccctcgacgcttcatgagaggatggggaacgttattcttcaagttcttttctcttggacaggggaatgatttgagccctgtcggctctagtcaggtgctttgcctcctcaggtctccctccctccctccctccctccctttctccctctttcacgaaattcagaatggctgctagccgctgtcactcagcagggaagtcttactctttgacaggcttagtgtggagactcatcctccccaacaagttccgttgggctctggggctttggcctttaaaactgttctagctcagaggctcgctttgcctcagtttactgtgtaaggagaagtggctcatcggagattgggtcagcgctagttctgtgacttctggactttgcctttcagttagcattgagtcgtccagtgggcctgattcccaatgtcagaaagtagagcttttgagctcattttcttgtttttggttttaaatgtttttatgctgttcgtattctgtgtctgtagtcagcttgatgggattgtgtatttttagggggtgttattagggaacttcggaaaaacgaagagtcgaatacctgctgtagatggtgtagactcagcggagtcatcccgtttccagtggtggttcttcctaccgtttcctccatggccccatggagactttgggagttttccctggtaagcagggggctccgtgcaaggcgcagtggaaggaaaagtggtaaagattggttggaagaagacacttgaggttattgtctgaagctgggccctttttcttgagtttgatgtggttgtgtttctgtgtcactggtcgccacagatgattggaaattagctttttccttttaccttgtagtgcagaatgctctgttgcagttgggcagactagacgggttctctgaaccacatagtttaatctttctgttcgactttctgttaggacatgactctttcctctccttcaccccttacctccagtttttgggactaggttgggtgacctcttcctcctttgtcttcttggaaaccttacttatcctgcttctgcaaatgttgggtttctccatctcatcattgagtggattcaaagtgttgacatacacagagcaacctctactcaaggtcagattgggtcagcttttccttttcaaaagagtagtgttgctcttacttgctctttgagacatatttatgcatcctgctcagctgtgttttctgtttccttagtttttaggctctggcgattttaggctttcccccagaaatagcctattctttagagagtagtgtttagtttagtctcctgtttatgctggatgtccgcccatgtgtcctgctcggtttttaattctttgtgactgattttgaggtagcccatctcaaaatcttaacgtttttttccccactgtttcattactttgagccattcttcctttcctgtttgggggaaatacccctttgtgtgcagttgtacttctttctcctttccttatggaaaaagcagtagaaggtgattctcttattttcttctgttcccctcatagttgtgtcagttgactcttttgtggaacctttgaatttgcccttctggggagaagtcgtttttgtatttatactcccatgactggagtcattcattcaggagacctttaccgagcttctgttatgtacaaggagctgtagggggtgatgtgactttgcttgagaccatattggatcttgttagccttttatattaatgacattttagtgtatcttttttttttttttttttttttttgagacagagtctcactctattgcccaggctggagtgcagtggcacgatctcggttcgtgcaacctctgccttccaggttcaagcaattctcttgcctcagcctcccaagtagctgggattacaggcgtgcaccaccatgtccggctaatttttttttgcatttttaatagagacggggtttcaccatgttggtcaggttggtcttgaattcctggcctaaagtgatccgcctacctcagcctcccttgcctcagcctcccaaagtgctgggattacaggcgcaagctgccacgcctggccttcggtgtggtgcttgtcttaatgcttgtcttttatatagtcttgcaaggaattttttttttctgatttttaagtttttggattgttaacttacaaagatatagtgtaatagtgtgctatcttgttgaaccttttttcctcctcagcaggagtgggggtggtgaagagggtgggagggtggactgggagaggcatttagcagctttcccccagactgtgtgcagagtgtgagagagagagagagagagtgtgtgtgtgtgtgtgtgtgtgtgtgtgtgtgtagacaaaagtaaagtcagccttcttaatctgattgtgtaggcataacttttaggttgtttagatacatgattggttggaatgcttatttaatatttgaacggcagcatcgcactaggcattctatagaacatagagtcaaatgtattttttatataaggaagtggtagaaaaatatttttttcttcggattaactggtatggttcatagtagatagtgagaactgtatgagctgctgttacattttcactgccatgaagaattatatccaaatttaatacctaattgatgctcattcttaggctaggcatctgatataattatcacttttattatatgacttttaatttatgctttttaatggtattattatttttgtaaattgcctcaaattctttgtgggtacaggttaggtataaataatgataataataaaaattactaacaatttgaaataccccttttcttttttcctctattaaattagatttaccatctccacaacgtatatagaaaccaattctgctactatttcactcttgtgaaaactcctgtgtgaggtttgtaatatgtggtttggcagtatgagtatgtgactgagtgtattttgtgttgacaagtgatgtgtgtgtttcttttgcatttccattatacagatcttttcctaaggtggtgtgtatcttctagaatcatgtaccctgtcctttttttttttttttttttaaatgttctaggtgacttaaatccgacctccctttcttttcttcggcctttccttttattttttgtcctttcccacatagagaggtttcttcactgacctgtcattattataaaaaagtgtttgttagatgtactgtatttgtagccttttagtaagaaggggatgcccaccatccctttgtcctgtagcacaaggcattgcttcttgtttccctaagaataggtagatggaatgagatttaagccagaaggccgctggtaatagtatttgtaactagatagcatctctagataaaacactgggtcctttctgctctgggcctccccatgtaggattttggaaatttttttttgctgcatttagccagcttctttctgtctctttggcttgatacaataaatttctttaagcacagccaagtatattatttcatttggagccttcatttacaaggaagtatgggggcctctcctaatgttcctttgcctgttatatatagtactgcctttagtttttggtgtgtttgagagtgagagtgagaagcattcttgctctgctactttgtctgtgtaacttgaataagagtgtacggtcattcactctattttccagatagtgtataatctttctttttatttttcttgaatacctaatcaggttcgagctagaggttgatccgactatcatatccttttattttgtgccatccctggatatagtgtcccttagtcctgtgattaagccatgttcctattttgtcattagagagagggacttacaaacatatagatggtctcccatgataattgtcatgcatttataaggaaagtgtttcttttctttttttttttttgaggctgagtcttgctttgttgcccaggcacgatctccgctccctgcaacctccgccttccaggttcaagcgattgtcctgcttcagcctccaaagtagctgggattacaggcgtgcaccaccatgcccggctaattttttttcgtatttttagtagagacggggtttcaccatgttggccaggttggtcttgaattcctggcctcaagtgatccgcccacctaggcctcccaaagtgctgagattacaggcatgagccaatgtgcctggccggaagtgtttccttgtataaattgacaatggagagcagttcacgtgatgggacaaagtaaagggtgagtaaagggtggttttgggtttttttttttttttgccatcagtatgctagctgtatatttctaaggttgtattgcatccttctgctttgaacaccattgcttgtagaaggtcatgggcctcctgtgtaaagattggtactgtttcctgagcatttttttttttacctcattaccctggacttacagagaaatattatgtaccccattgcaaagagaggccaagggtcagccacattatttccccttttgctctttttctggaggattgttcatttacttcgaactgattgacatggcataagatggaatgactagagatttttttttttaaaggttcctccatattcaacctcagtgtttggctctatcctgacatggttgcttgttctcctgtacatgaatccttttgcagttactttcttgtttttgtttttcaaatttagccagggctttcaagtcacgtaacatatcctttcctgagactgtgagccgaaggtaacttcaaggaagatatgcttgtttggggctgtattcatcactctgctctctacggttttgtagttttcatgtgtacaaagtgacatttcttgaaagaaacgtttggggctgtgttcttaatagttttaaacatgttattatgtggagactaagtggcaaaggtctcaccccaacttcatttcttcataccactcatatatatcttatatatatataccccactcttatatatatatataccccactcttatatatatcttatatatatctcccctacctgcaaatcccaaaacaatagtcatagcaacagaaaagcaaaaccttgtgaagcccagctctgattggttctgctgtgcagttcagtcgctagttttggacaggtgcataagcagataatttttggatgtgtaatattctcagtggggctgatgtgtgacttttgggacatagagcattcattcgttcagcagaccatgcagtatctcttccatttttttccccttatcagttaccacaaggtaagattatgtattcagtcacttaaaaacacttgcaaagtggatttttccccatttattcctatctaaccattggaataaatgttgacagtagtaaattaccatgtccctatttttgtgttcaacatgtctaagagaatggggagctaacttccagtaagggcagtacagtcagtcatgactctttctccatgtagcctgtgcattgtgcagtgatgatttatactttcagctaaatttagtgtctatgataagggatacatcagatgtttaagttcacttaatctcttttacagtgtgcattcaacaaggtgtatttgtgtcttatattagaatgaaatgcagatacaaccagaggtattctttcaacgtagagagagagagaaagcctttctttttacaagttttgaaaaaaagttattgtctatttttccttcatggtgcttgatttagattgccaggagtcatttctgaaggtatattaatacaatcaagaattaatgttcttaaaacttaaatttgttttttaatccttttctgaaaagtcatttctgaggatatatgtgccctgttggttttctgggcacttggatatcaaatcatttgggagtgataataagaaattggtacaaagtgtgaaattatcagatagaaagaaaaaagatgttatagtggaaaaaattactcatttatgattaaaaataatctcaaagtgatgactggaagtataaattcagatatttgaagaagaaatggaatgttgatagggttattgtattgaatcaacacatgcacacgtataaagaatgctccccaaaatggggacgcttagaggacaaataagttgattggattggttttaagaaaaatattgtttgtctttttaaaaagtaattgaaataacccttcttagtgaagaaaatgaaaactttgatggaagttcagcagaatggaatatttaaaaagattcaagagaaggatttttttattgcgaatccacaagggggtagtgatgttctttcaaagatatttgtggtggcaacaatgtgagatgatctcttcacattttagatttacagataaaactggcatgtttgcattttaacttaataagatcttctttttaaaatgtttattggcaaaattgtttattgcttaaattaaaaaaaatccattttgggtgaatggctactttaagccatatgaatggtaaagaagagagaatgtccttacagttttgtgctttggagaggtcaccaaggatgtgagggtcactgttattttctaagaatgtaataatcttaaattccctgggaaacattagacatctaggaatcagttacttaagtgtcctgaataaaaggattttagtaaattgtgtctaaactttacagaagtttgtattactagttgtattttcagtgctgccgagagatgaaaaatatgaacaatccatgccactagccacttttaatagttctaagtaaatcaaatttttataatcttttttattagtttatattacatcattagataaaggctttttttttgttttttttgtttttttgtttttttgttttttcttccctcacataaaaattcaggagctttcttctggtcactgagttccaccccatattattcagaattacttaaaatcaggtgtggtaggcctgtgctgggtcattttcagtggaggactgcctagctgtattatgcactcatttttgaaagttatgccgtgtggtgggagaaagatttaaagttggggggcggctgtgtcctacttatttagagacacaactagtcatcacctgtaacaaatgtgacttcttttaaaacttattttatcttacttttttttagagacagggtctcgctctgttgcccagactagagtgcagtagtgcaatccatagctcactgaagccttggcctcctgtgctgaaatgatcctcctgcctcagccccctgagtgactgggactacaggtgtgtgtcaccatggctgcttaggttttttttttctctttttcgtagaggtggggtcttgctgtattgcccaggctggtcttgaactcctggtctcaagcagtccgtctgcctcagcctcccgaagtgctgggatttacaagtgtgagctaccatgccctgcctaaaaaatattatttctaacaataacacaaaataattatgtggtttagaagttatgatagtttgtgccatatacattgtatatttttcatttttggtttgtggaaaaggttgttaattgagcttttctctttttttctccattccctcattctgagcaaggaatgactttttcttttatttcctttacgaaatgactttggtgttttaacattccagaagatacactgttttttatatgctactctaaactctgctgggaactgaactatgacgtcagcattttcattcatgaatctgattcttctaaatttttttcctgttttgtattcctgagctgacttctggcacatgcacaaatcagtttaccattagtcagcccataaatcactgataaaaggtaaaacaaaagataagatactggagttattttgatagtgctatagttctcatgctgatttgcatcagtacagtttggataaggtttctggctaaacagattgaaacctaaaaagtcaatttaattatctcatgattttgtgacttgaactgtgttgtgaacatattgacacaatatttttgttcttacaggaagttgagagtgctatgctatggctcctttgttataaaatagcatttcttttttttttttttttttttttttttggagacggtctcactgtgtcactcagtctggagtgcagtggcatgatctctctcggcttactgcagcctcgacttcttgggctcaggtgatccctcagcctcacaagtagctgggactacaggcacgcgccaccatgcctggctaatttttgtattttttgcggagatggagtttcgccgtgttgcccaggctggtctccaacttgtgaatgcaagtgatccacccactttggcctcccagagtgctgggattacaggcgtgagccactgagctggcctaaagtagcatttcttgtataatttgactaagttggaagattatataatgctttatttcagagaggttaggcctagagattaaatgatgttttattcaaattacctttgtaatggatttagatttttttttggagcattttcttgcctttgacatattttaaataacttcattgtttgatacttttattttaagatattattattgtggtggaactagcctagtattccttgtattggacttagggtgcatctaccctggattgtgcactcgtgtagctgttgactccggtttctcctctagggaggtcactgcttgcagttcagtactacgttagaacagttcttgaagaaatcttatttggagttttcttctgcaggccaaatttcaggctaagcctccggcccatagtatctttcaagcctgctgtagctgatgaatggtgagccgtaaaaaagtttattttctctactttcgtgggggatttgctgactttctggatactcaattgccaagaaacatttagaaataaaacgtgttatatttaggaatcatcattttagctaaataataatgcatgattagaattgatgattcaagctgcaaccactttgattgatacccagtcttactcttgagatcacttttttttctgagacagtcttgctttgtcacccagactggagtgtagtggcgtgatcttgtgtcactgcagcctccacttctcgggcctaagcagtcctcctgcctcagtcccccaagtgactgaggctataggtgcgtgccaccatgccaggctaatttttgtagagacggggttttgccctgttgtccaggctggtctcatactacagggctcaagtgatcctcctgcatcggcctcccaaagtgctgggatgacaagcatgaaccaccacgttcggctgagatgactttttattttttatttactgggtttttttttttttgagatggaatctagctctgtcacccaggctggagtgcagtggcatgatcttggctcaccgcaacctctgcctcctgtgttcaagcaattctcccacctcagcctcctgagtagctgggattacatgcatgcaccaccacgcctagctaatttttgttttttttagcagagacggggttttaccatgttggccaggctggtctcaaactcccgacctcagctgatctgcctgcctctgcctcccaaagtgctgggattacagacgtgagccaccgcgcctgtcttgagatgactttttaaatgccataacaactcacagatcctgtgtcctcccattcttaaatgaaactagagctttgtgttcctttaggttaaactaaattatctaataggtaacagaagagtggtctgttagctggctttctcctttcagtagatttgctaagagaaaggaaataaaagcaagtagactgtgaataaacattgaagatgacttaaatgacattgttttccctaataatgaaataatttatatattatttaaatataatttctataaaagaatctatttgcaagtgataatgaagaaaggaatttttttttttttttttgagacaaagtcttgctcttgtcccccaggctgcagtgcgatggcgcgatcttggttcattgcaacctccgccgccttggttcaagcgattctcctgcctcgccccccaagtagctaggattacaggtgctgaacaccacgctgggctaatttttgtatttttagttgagacaccatgttggccaggctggtcttgaactcctgacctcaggtgattcacccacctcggcctcccaaagtgctgggattacaggtgtgagctaccgcacccagcctaaaaaaggaatatttaatggtagagggctctgtaaaaaccccctaattttcaaagccatgtgccactgtagaatttatgaaaagttatgggctattattattaggtttcaaaaagtctggaatactggcggtagcatcagaattatttatttatttatcttttgagacagagtctatctctgtcgcccaggctagagtgcagtgatgcaagctccacttctcgagttcacgccattctcctgcctcagcctcttgggtagctgggaccacaggcgcccaccaccacacctggctaatttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctctatctcctgacctcatgatccgtccgcctctgcctcccaaagtgctcggattacagacgttagcctccacctccacgcctggctaaagcgttatcatttttatctaaccctgaaccaatcagtgattggttagttctctagctgtgaaggctttgcacttcctagacagcttgtagaacaagcccacttggattcccagctcaaactctttcctttttactatttatttattatttatttattcgttacttattattaattaaaaaaattttttagagacaagagtcttgatctgtcacccaggctagagtgccatcacagctcactgcaaccttgaactcttgggttcaagtgatcctcctgcctcagcctcctgagtagtgaggactacgggcgtgtgccaccacacccggctaattcttttttaattttatggagaaagggtcttgctatgttgcgcaggcttgtcttgtactcctggcctcaagcagtcatcctgtctcagcctcccaaagtgccaggcttacaggcatgagccgctgtgcctggcttgtactctttcactagctgggaatgctggtgagcaggactcaaggatcccagcagagctgcatcctgtgctgtctttgctgccacttaggtggaccaggagctagaagcctttctctccatggcctccataccttcttttaccagatggtatttctgcatttatcactcttgattccagcacagcttttcctcatcttgcttttctcagacctcagctcttatgtaatgagatagttggtagtcattttgaggggattcatgtgttgggtaaagggttttcctagcgatgacctcgaaagttccttcccattaataataattactattaataattaatagcaataactaatgataaaacagaacagttgcagcaatatactgtaataaaagttgtgtgaatgtggtctctctctctctctgattatcttattgtaccatactcacctatttttggaccttagttgaccgcttgtaactgaaaccatggataagagggggactattgtgtaaggaaatgaagtcggagatatggaatttcatttcagggcttgctttcctgatattcagctattctgtataactgtatcttttccttttgaggtccttgctccaggacaagaataatatgttgactcaagctgtatggggggatttgaactacagacactcagatatctcctttctgaggtacatagagggcttaattttttaggtctgtctgtttaatatactatatttactttaaaaaacgtaggccgggtgctgtggctcggtgcctataatctaagcactttgggaggccgagacgggaggattgctttagccctggagttcgagaccagcctgggcaacatagtgagaccttgtctctactaaaaatagaaaaaattagccagatgtgttggtgtgcgcctgtgatcccaggtacctgggaggctgaggttggaggattacttgagcccttgaggtcaaggctgcagtgagctacgatcacgccactgcactccagtctggatgacagagtgagatcctgtctcaaaacaaacaaaatgtaaaaaaatttaaatttattaaaaaagatgtacaacaccaaaatgttcatagttattctgtatgacagatctgaggtctttgttcagacatagatgagggttcatagttttggaaaatagacttaaataatatatgattacagatgaaaaatatttgctaacctcagactttttatgtttaaggtagtatttatattcatttagttgtactttctggagttgattaatataactgttattaaaatctatcgattcccagtaattcagtaaatgaagactcttcctatttagaaactcgtgtggattggggagttgctgtgggcccactgtcattgatcatatcacatcttcacttgaacctgctccctgggcctcctataggcctcgcgtttggagaggccgtgaacataatttatttttggaagtttctttcatttttaaagatactgagaggcaagttgaagttcctggtgttcgtgtaaacattccctgccttatcctttccatctcagccattatgaaatgttctggctgaatcatttgctttcacaaagctttgatgaaagtttcttcctcatttggttttcttgatagaggctgttgtgctaaaaagaaagctataacaagttagaagggtggagagtgggcacttaacatttttgaagtacttgtctttcttcctaggggtcctccagaaattgatcatagataacttgaccaaattcaaggcccagagatttcttccaggcattctgggagggaaggaacatcaggctttctgtactgaatctaattattctaaatatttcccactgcagcttgtatgagtgttttctgatgcaaatatggtgatagtggcgacctctctaactgggctaaatatccttgacagctttttatctgtcctctccaagtatttttagtctctttagcttctgtggccatgtctggaggaactgaggatggatttagctgctctggtgctgctccaagttgttgtgggtgctctttgctaccttcgtcactgtcctgccacagtcctgccactgatgaggctcctggcccttgtcatttgatgagggaacataaacacttgtttaataaaaataaaaaagtcatgattttcagaatgctttgaaaataagctatggctaatggtgatacacaataggaatgtccctaatttcactaaattgtatgctcaaaaagggttaaagtggtaaattttatgttatgcatattttgccacaattaaaaaaataaaaacttcaaatggatttgaagcttaatgagaaaactagttataatgtcctaacagtaaatatatggccaatattttcatgaccccaaggtgggaggctgtgccttaaataaactgtcagaatcacacattaaaaaaaaaaaaaagtgatggtaatcaggccctgaggttcatttatacagaaagtgatttttaggtgagattttaatatttgcaatatttatatttgtaaagaggattggctagctcattcagaaaagtctgaggttcttaataaacactaggaaacagatggtttggggttgatgtcagggaaggtaagcaggccgtgctttagattagagcacttttgattgcaagtcccatgagccacacagtttaggccaagtgaaagcagttttagtctaagaagagcagaagcaatcgtagcctctcgggacagaaactgaagtgcagctgggcagtgggaactggatctggagagtctggagtacatgtcttctctggagctgggctttttccattcacatgtagcttccttgcttgagttacatgtagtggccttagtcatggctcctgcatgtcctgactctagttccagtactcatcatcatctgactcccatttctatggctcagtacaaaaatattcaagactgggtattggactgactcctctcagccatttgctttgtttccataggccaggtgatcatctcactctggtcgactatgaaagaaggttggttagatccagcagcctgctgatcatttagagggtcttagagtgagaggagattgtgtgagaagctggttatcatagcagggggtcctggcacctcaaactctgtccccatcaaacagtgtaaaagaaaagatattgactcctaaaggagtgtcttatgttcagatgctatagagttttgcagagaaagtgttcagtgtagctacagatagaaggccaagtgtccttggtcagccagcctgggtgtgtgtggagtaagttagtggtaggtgtagtaactgtctcaaagctttttctttgtctctctctctctcttttttttttttgagacaaggtcttattctgtcgcccaggctggagtgcagtagcacaatttcagctcactgaagcctcgacagcctgggctcaagtgatcctcccacctcagccccccaagctgaggacttagctggaaaacacaggcatatgccacaacgcccggctgatttttatgtttttagtagagacaggggtttcattatgttgcctaggctggtcttgaactcttggccagctcaagcaatccacctgcctcagtctctcaaagggctgggattacaggcgtgagccaccgtgcccggccccagaactttttctttgaatagtggagaagcagaacaccttggaatgctatggtctgtgcggtctttgccctgtgggtgttctcaggtggaatcaggcagtttgggtgatgtcagtatcatttgaggtcttccacagttcagctatttgggtgggcttccccacttttccccttgttttgggtcggtaaacataaaaggatggagatgtgtatccttagtaagaatgggagacgttgccttcagaatgggtagaaagcagaaaacaagcggggaagaaaacagaaaacagcctctctttaagtgtatgtggctgcctgtgtgcacagtccttcaccttttccttagtatatccctcctgcctctgatctcttgttgttcttgatttttcatggtagaaggaggaaacaaaattatagaagacaggtggaatactgtgaaagaatagtagtttggagataactatgtaaagggctactagcctgcgcaccgttgaattctctgaatttacagctgtttagtcattgatgtttcatagtgttgaccttgagtaaattcagaaaagcaatactgagtatgttctgctaaacaaaagaggaaagtgtatgtttttaaagaaacaaccttcacagtggtttcagtagttacagggatttggttcttttttaaattattttatttctttttaaagatggtctcactctgtcatccaggctggagtgcagaggtgtgatcgtagctcactggcaccttgaattcctggactcaagtgatcctcctgcctcagactcccaagtggttaggagtacaggcatgtatcaccatgcctagctgattaaaatttttttttttttggccaggcatggtggctcacgcctgtaatcccagcactttgggaggctgaggcgggtggatctcctgaggtcaggagttccagaccagcttggccaacatgggtgaaaccccttctctactaaaaaaaatacaaaaagctgggcatggtggcgggtgccagtaatcctagctacttgggaggctgaggcaggagaatcagttgaacccgggaggcagaggttgcagtgtgtcgagattgtgccatcgcactccagcctgggaaacgagcgaaactctttttttttttttttttttttggtaaagacagggtctcaatatgttgcccaggctgatcttaaactcctggcctcaagtgatcctccagccttggcctcccgaagtgctgggattgcaggtataagccactgtgcccagcctgatttgttttttaataatagcttaagatgtaattcatatattataaaattaacccttttaaaatatataattgagtgggttttcttttgtatatttacatgtttcgtgcaactgtccccactctctaattccacattttcatcactccaaaaagaaaatctgtacccattagcagccactccctgttgcctcctcctcccggccctagtcaattactaatctgctttatttctttatgcatatttatgcctagtgtgaacatttcatataaatagaatcatgtagtgtttgtccttttgtgacttgactggcttatttcccttagcataatgttttcaaggtttttatctatgttgtatgtagcatgtactgttacttcatcccttttttaaaattaaaaaattttaaatttaatataatagagatgggggtctcgccatgttgccaggctggtcttgaactcctgggctcaagtgatccttctgcctcggactcccaagtgctgggattacaggtgtaaaccactacacctggccacttcactccttttatttttgaataatcctctgttgtgtggatatataccacattttgtttatccattcaccagttaatagacatttgagttattccactttttggctattaagaaaaatgctgctgtgaacatttgtgtacaagcttttatatggacatatgttttcatttctgttggaaagatacctaggagtggaattgtggtgtcgtagttaactctgtttaactttttgaggaactgttttccaaacttttccaaagtggttagatcatattacattcccaccagcaagtatgagagttgtaatttctccacattcttgcaaacacttgttattgtccatctttttgattatagccattgttgtagatgggaagtggtatattattgtggttttgatttgcatttccctagtgactaatgatgttgagcatctgttcatgagcttattagccatttgtatgtctgctttgacaaatgtctattcaaatcctcttccatttttgaattgagtcaattgaatttttgctgttcagttgtaggaattctttatatgtgttctagatatcagtcccttatcagatatgtgatttcaaatgtatgattgacatgtgatatgtgatttttctctgattctgtgtgggttgtcttttcgcttttgttttttgagagagggtctcattctgtcacccaggcaggagtgtagtgatgcagtcatgtctccctgcagtcttgcctgcctgggcttaagcggtcctcccaccttagtctcctgagcagctgggacttcaggggggcaccactggtctggctaatttagaaattttttaatagaaacggagtctctatattatattatgcccaggctggtcttgaactcctgggctcaagtgatcctcctgccttggcctcccaaaatgctgggattacaagtatgagctgctgtgctggcctttactttcttgatagtgtcctttgaagaacagaagttttaaatttgattgtgtcccatttatctgtttttttgtttttttttttggtcacttatgcttttggtatcataataagaaaccattgtcatatccaaggtcgtgaaggtttacacctgtgtttttttgttagagttctgtagttttagctctgacatttagttctctgatagatcttcagttaatttttgtacacagtgtgaggtaggcttccagcttcatttttttgcatgtggatattcagttgtcctagcccatttgttgaaaagaccattctttcctcactgaagtgtcttggcacccttgttgaaaatcaactgactataaatctgtgggtttatttttagagtcttgattctattccattgatctatatgtctatctttgtgccattaccacaatgtcttgattctgtagctttgtagtaagttttgaaatcaggaactgtcagtcctttaactctgttcttctttttcaagattgttttggctgtgctagctcccttgtatttccgtatgaatattaggatcagcttgttagtttccacagaagagacaactgagatataatggggattatattcaatctgaggatctatttggggagtttaaattcattttatggatttgctgtatgcttaggaagtcctggctaactcagacacccaagcatcttgccttaaaaacacaaaattttgttttaatttattgatgtagtaggctgccttggtgaaacactgtaattcactgttagactggaattggacttttcaggttctaagagagcaaacagctcttccacgtagcgtgtaggttgacttcctgtagtaaatgtttttttgatgtgaaagtttgctgataccttgcatgttttaaaaaaaatgtggtattctggttaatatacattctggttaatagagaactagcagattatatatatgaatatttatcaaagagttaggacatgttacaataaaattgtgacattaaaatttatataattgttattattactggaggaatcagaagatattttaggaccttgtagtcccgcaggggccacgtgaacattggttattgttatacttttaagtcacttcatttactcaacaaataacaaagtgcctatctgtgccaggcacaaggaaggacagacccagtctctgtccttatggagctaagggggagacggacattaatcaagatgccatatgaaatttcagctgggactcagtgctgtgaaggtgcgtgcaatatgtcataaagggatttgactaatctgcaaggttgggggaggcttcttgagagctctggaggaaaatgggaattaattgtgggaagaattaaggagaaaagttccaggtaattgggtgagtttgttagtgagttgtgtggagatactctggttatatcctgtttatcacttttgggaaagagtatctgaatacttggctctggcctttactctgtcccttaaatgccttgtggctgagcaggtactctttctgagcttgttcacatactgttttttaaatttctgtagccatttttatttacagatacttacatgaaaacatacagaaatctaggcttttggttgattgttttcatataattaaaaaatcattcactttgggaggccgaggcgggtggatcatgaggtcaggagatcgagaccatcctggctaacatggtgaaaccccgtctctactaaaaatacaaaaaattagctgagcgtggtggcacgtgcctgtagtctcagctacttgggaggctgaggcaggagaatcgcttgaatccaggaggcggaggttgcagtgagctgagatcgtgccactgcacttcagcctggaggacagagcaagacttcatctcaaaaaaaaaaaaaaaaaattatttctttgtgaccttccatggttagctatttagaactgctttagtggtaaattgaatacttttctgaacatttttcctagactttgaaattaggagtcatttctgtttacacatacttcagaagcctgtcagggacagagtctgtagtgacagaagtctgtagggaagcagatatggatgtaagtgattcaagacaagtcataatgctttaataaggctctggaagggaagatggaaagacttccgggaggaggtggaatttgacctgaaatcattgacgggcaaacatggtagttggaggagaaattccaagcagaggaaatggaacagaggcatagagccaagagagtacagggagtgggtggaattcatgtgcatatgggtaggtaagcctcggaaagtaggtaggggtcatgttgttaggggcctgaaagtcagaccgaagaatctggatttaattctctgctcaggagaggcttttagaagttttttttttttagtagaggaatggaattgattggataaagtcgattctcctgaaacaggtgctaataagggccacctagttacttctccagcttcctctctacagtcacgtcacattttttagactctgattgttccaaggtcccacagtgtctggtggttttaggcctcccacattgctgttgccttgatttagaagttgcacctgcctcaggaacacaggcacacacgctcacccatgctcttgctgactttctgtgtcttctgtgtttcagcttaaatgaaacttccaataggagaagccttcttgaccttgcccctcttttcagattggatcggatgcccttcctgtgtgcaccatagcactacgtggttttcctagtcatggcacattttagtttgcattggagttgcttgtttacttctctttctctctcaattagatgtgcatttctggaggtaagaggcttgagtacctagacttagtaaatgcttgttggctgaatgaatgaatgaatgaatgagcaaataggaaggactagagtcgggagaaaatcacttctggcaagagttgtctgtagaattggggtgaggaaagagctcgcatggctgaggagtgtgtgtgtcacacacacatgcaattttgtgactgactgaatgtgggccttgagggaaggtgactcctaggttttgaaccataactggggatttagtgaggccagactgagatagggaagacaaggcaggtatatttggggagaatggctgcaaaggtaccactgtttttcttcttcttctttttcttttttttttttttgagatggagtttcactcttgtcgcccaggctgcagtgcaatggcatggtctcagctcactgcaacatccacctctcaggttcaagcaattctcctgcctcagcctcccgagtagctgggattacaggcacccaccaccatgcctggctaattttcgtatttttagtagagacggggtttcaccatgttggccaggctggtcttgaactcctgacctcaggtgatccgctcaccttgacctcccaaagtgctaggattacagacgtgagccaccgcgcctggccggtatcgctgtttttaaggcgtcattgggtagctttagaatgtgtatatacagcgtgacattggagatgtgggtcaaagatcagggagtccttcatatcaccctgctttttttcttcattgttcttccagagggcaagggagggagccttggtgctggagtccttagaggtcagccccctgggcttggggcagggagagaagggctgtgaggaggtctggaggggcagatgcagtggcagcagcacagcacaaaaggtacagacagtacctttgcaaccaatgaatgaatcagttcaaaacaattagaagtcacagttgtgagtgagattggaaggggagcagagaaggggcctgagggcagaaatgtgatgaatgcttacattttaatgccaccagaggggagagaaccagtagaggctgagaaagaatggtcggagaggtaagggaacaagcagaatatgaattcagggttgctgagtgtggagggttgaaaggaggttgtcagtcgtaatgctgcagagttgagtagactgaagactaaggaagggtattggttttgtcaattcgataatgagagaataaaggagtagagatagggtggatgattatttcagaaccgtggtggcatatacagagtactggtagaaatgatggtgaaatgattgatccagtccaagatgagaaaagaaaccactgtggcctgatgggctgtgagtgtattagttatctatagctgctgtaaccaatcatcacaaacccagtggcttcaaacagcccagggtggaatctcctggttcccatgggtcaggcatttgggcagggcagggctgggtctgctggattgggactgctgaactgtggtcgaggtgctggccaggactgggctcaccttggaaacctctggtaggggaggatccacttccaggctcccttggccatttgaaggactcctttctttgggctgttgggctgagggctcagcttttcgccagctgttggcccgaggctaccctcaattcctgccccaggggcctctgcaacaccatagcttgcttcatcagagccaggagggacagtctctagcaagacagaagtcacagtctgcccattacctttgccatgttctgctggttagaagcaacttgctaggtccagcccacactccgggggagggggttacacaaagctgttaacagtggctgggcgcggtggctcatgcctgtaatcccagcagtttgggaggctgaggcaggcagatcacgaggtcaggagatcgagaccatctggctaacacggtgaaatcccgtctctactaaaaatacaaaaatttagccgggcgtggtggcggacacctgcagtcccagctactccggaggctgaggcaggagaatggcatgaacccggaggcggagcttgcagtgagctgagatcgtgccactgtactccagtctgggtgacagagcgagactccgtttcaaaaaaaaaagctgttaacatcaagaggtggggatcataggaggtccatcataaagtttgtcctccaccgtagaggggtggtgacgggattagaaggcattataacagttcttcaggtgaggccttggaggatgcagatggaaaaacgggagctttcagaggcggaagttttggaagtgcagttccagttgaaagttgggatagtcaggtggtgacgcttctcaggaggccttctgtgccctttgtcttcatgtgccttctatgtgctctctcctgttagacaaatgaacattctgtgttacagttgccaccgataaatccatctgtctggctaaaatggaattatttaccagccaattcctggccagtggaggtatctgccctcttgccttatggttttgttgaggatcaaatgaggtaattcatatgaagtgttttatagactacaaagtaatatgcaaacaaaaggtattaaacggtgctacctttttctctatgttaagtagaacccatggaatttaacttacattttccttaataacttgggttcattatgttgtatgtagcttattaaactgggctttatttaacactgtgatttgggtttttggagtagagagtttacttttatgataaatgaccccaaactgctatacctttcaaatccttgtgtcccatttttattgtttaaaaaaacaatctcaccttgccgttgcctgtcactcttttgcttctgtgtgtcagttttgagctacattttttcccctccgatttgttgcttctgatctctgggcttggcaacctgataatgaagcatattagagctgtgagtagttttatagtaatcaagctacgaatgtgggtcggagaaactcttctcacagtggagtacataagcttttgtgcatggacttcgtaaaattcacttttggccttcagagtgttcttggcttccttcctagttctggctgtgttcggattaagggaggttcccagatagccgacctccattccggggctgtggctgccattttcttggcgtccacctcattgctctgttacgagaaacagtgtcattctcttctttagttttgatgaggttttagttctttgggcagtagcaagtagtgataggtgatggtggtctgtggttcatggaccaaaaaatgtttgagaggcatggaggatctttagacaagatcaccttctaggtgtatgtggtagcattctgttccaccgctctcttctccttcaggatgtctccctcccagctaacctgctcggtgttcctcagtgggagcgtttgccttagctttctctcagagcatcgtacttactttttctgcccgcatttttgcattgctgctttgtggagaagcgttgctgcattattagggagagaaccgtgttttcttgtggaaatcacacagtagtatgggagaactggtctggttctaattctgccccgtcctagcttgtggcctttgcccagtgccttgttacccatgtcttggtgtctccatttctagaataggcttaatgtgtgctttgctaccttttaggatcgaaataagattttatatatgaaaatgcttgttatacgtacataatattgaatagaatgcctagtttgttgggttgattttgttgatattttacaatgctctctctgaggagttaaacaaaattatcattagtatgggtaacaataagtactactgaaacaatatcattttaaatgttatacagttttttttactgaatgtattctagttgaatctatttgtacaaatgtggacatttagtaagtgctctttgattattttcagactttgagtatactggcttccaagccaaattaaatttatgaaaattctaatgatactgtgattcatatctagaaagaataatttaaaaaaaactgtaaaatcactttaaacatgctttacgtgcatctctggtaatagagaatcaattaatctgatttctcaggccataaatctggcttgatatattgtaatattagttcctgtgtcagcctcttagaacttgaactgttttgtagtctgttccagctacttgtttgcttttgaactcaattctaggtgttgaactcaatttgagagcctaaaatggtttgtgccccaattaccttagaggttactgtttcatttttttatttagcctgccccaggagtaggaagtcggctacctaccagactttttccttttaacttgactgtatactttaatttttgtctctatcccatgggggagttgtgagggttattatagtatagtagcacttaatggcatattttaaacttcttgaaaagtggtaatatgtgagcacataatatttttgtactgtagcacataattttttcccacactaaccttttgtggttcagaaaaagaataaagttacttgggcttggggtacatgttgaattgcccatctcataaaatcgttaacctgattttagggagtgtctctgaaacatgtcttttgacagaccttgtgctgtttcttatttattattaataaattgatatttcatttattattcataaattaatactaattaaataattaattgtgctctagcccccagttttagtttggttttcttggtatctctgaaaactgttgagtattccccctactccttttaagtttttttttttttttaagcaggtttaaagtagcttttatcatattccttgatttctcaaatgaatagagggataaggttcctttctttaaaaatatctgcaacattgctggactgagaggtcgtatttacagttttttctttttaaaaattttttttagagatggggtcctgctctgttgtccaggctggagtgcagtggcacagctcacagctcactgcagccttgaactcctgggctcaaacagtcctcccgcctcagcctcccaggtagctgggactacaggttcgagccactgcttgttcagtctcttgcttttgtctcagtggcacagtaccaagacatagcaaatcaaagtgaccaagaggatgagtggcaattcggtggccttataggaagagatgtgcttgaaaacgacagaaggcttttagtaaattccaccaccatcaccaggacgagagacgggaccatttttcctttccataaacttaggggctggttattaatttatgaattctataagtaatttgagcttgtgttatgtaccagacattgtattaagtattaccagagatactgggaagaacaagccagacatcctttcaaggatgcatttgataaaatctcattttgagtatgttaggaaaatatttattggagaaggaaacctcctagattggttttagatcccgaatggccttagggattgaaaatggagttgtaggttagcagaggacatttctgaaaggagtaactattttgtaattaaaaagcagtttacagaagatactgtggcagagactgctagttgatcatgaaacccatctccttctcttcctcctcttcctgggcattttccagtcccccttggaatcgtgaccaaattctagccagtggggtgagagcaacgaagtgtgccacttccagacttggcccctgaaactcttgaggcatgggtatcatgccttttccttatctggcttgatgcagagggcctagtgacctagaaagtcttctgccacaaggtagaaggagcacaggcagcagagccactgctgtgagaacagtctgcccaccaggagcacctgttttggactttacctgagcaagaagtgaacatttttggtatttgagccattatacagttagcctccctaactatctaggcacgatgcctaggatgctaagcaaaactggactgagaggtcgtatctacagttttttctttttaaaaaatagtaaaggtgctaagtagtaaaggtgctaagattcaggcgcggctttaattctgtggagacctaaatattctttgtctttatttcaaagaacggtaaatacacttttcattatgctgtttctctgttccaaagcctgtaatcacttcttactatatagcatcttgtttcattaatccatcttccaaaaactctaatatatgtatatattatccatatacaatgaatgtgcctgtgtgtaacatcctgatctaggttctctgagtggagacaaaatgaataaaacatagtccatggcttcaaagagtttctgcttgatagccaggtagttactgaatttccatactgctatcatctgtcccttgttttaacctttaagtcatatattattttttcattacctttttttaaaagtattgtttcaattagatagtatactttttgaaaacagggaatatatattatagagctctgcatctctcctcttgggtatttcttttttttttttgagacggggtctcactctgttgcctaggctatagtgcagtagtgctgtcatggctcactgcaacctcgatctcccaggctcaagcaatccgcctgcctcagccttccatttagctgggactgcaggcacacagtaccacacctggctaatattttaatatttgtagagacagagtcttgccatgttgcccaggctggtattgaactcctgggcttaagcagtcctctcgccttggccttccaaagtgctgggattacaggtgtgagccaccatgcccagccttcttgggtacttccagcagaaactgggcactatacttgagtaaccatccctagagtttctactaattatcttgtgtggatattctggtatagttttgtattatgtactaacagatgaaagtactttttaaatcttctaggaattagtggaattatgctgttgaggaatgttaggattggaaggatcttttatagatcatttatctaattcctgatcttttagtttgatcatctggtttctgatactcaaggtgtggccattaattgcagcatgggcatcacctgggggcttgttagaggcagaatctcaggttctccctcagacctgtgaatcagaacttgcattgaaagaagatcctaagataacccgcatgcacattacatttggagaagttctgctcaaggtcaactactcatttgactcttgagaaaactggggaagtcagagagttgcccagtcatacaactgtttatttcagtggttctcaaccttggatacatcttgggatcacttggggacctttaaaaaaatactgaggcctgggtcccatccccagacattctgacgtaattggtttgggcatcagagttttggagatttcactagatgactggctaaggctgagaaccattgatttgattaatgatggaatccaggtttcttcatgctctaatcaagtattccttccactccaccatggctgtacattcagaaacaatgaaaaacatcctatcaaatttttacagtaatgcatcactccatttcatttcctttataggaatttacccctattggatagtgtcccatttaccatctgtcttccccccactagaatgtatctccaagaggacaggacccttgtctgtcttgttcagtgctgtgtcccagcttgcgaacagtgtctggtacatgttaggtgctcctttaatagttgtagaacaaatggaaggagctaccataaagaaggatgtgttctgtgagaggaaaacacaggctactctaaaggtaccctgtgggcgagaggcttcctgaagggtgaggggtctgagttgaagtgcagaatcagcgggggaggtgcttgaagacctgcttctgaggaaggacttgaacccagatctgacttgaaagcttgtgcttttccattccactgtgttgtcctgtggacacagtggctcactgatttgcccggacttcttagtagtgagtggtggactggaacacaccaccgcggctctgcaggtgcttaaggccagcccgcctccctctatggcagagccgccccagtattgcagacaggcgcctagagggagatcaaaacacgaagttgtcctgtgaaagttcctggcccagtgtttggcacaggggtatctagtacaaggtagccctttcttatcatggaagtttttttgtgctttggcttgttttgagaacctatggttttcaaagatagaatgacttgatttcagttttaactttggtttctttcctagttaactatggagacttcattatgcagtgctgtggagagagtgtgattggtttttgtctatgatatttctgtgtcatatgttattttagtgccaagttcttcctgttatttcagatattctgtcactgatttacttattgttagactttgaagttgggtataaaaatccttttttatgaagctattcattagtgtgtcccactgaaccaaagtgatttttaaaaacttttcacctaagaccattgttaagatatctcaaatggtaatcttataccgtcagtttttgataataggaagccaggaaatgttaagccttgaatgtaagacattatttttaacatcgtaaaatttcaagttttaattcagaaactaaattaaaatgaggtattacattcatgtgattagtgggctgttactggtgactcttaaagatgttacaagaagtcagcgtgctgctgacttttcccctattggagatcttcccatgaaccacttttcctaaggtatgatgattccatgctcacagtcatgggtagaaagtaatgttggattttccaaaggatacatgaattccgagccttgtctagtctatagggtgaatccttggacatgactgttaccacagatgttatcatagttaactactttttttgtttttgtgtcagggtctcattctgtcacccaagctagagtgcaatagcatggtcatggttcactttaggctcaaattcctggctcaagtgatcctcccacctcagtctcctgagtagctggggttacaggcgtgagccactgtgcctagctcagtatactactattggttaaattggagagggaaacagtcctagaacaagagttttacagaaatagaaaagaaagaattaaggagctcatggttatcctggtagctaggagtcacattatagagaaagactttatttatatggaccctgaaaacaatttgacttctgaagcacttgatcatgggcataagggagaggaaaattaataattcttggaagtcaactttagtcagattgcaacattttttggcataaaaaactcaggcgcggtgggtcatgcctgtaattccagcattttgggaggccgaggctggcagatcatttgaggtcaggagttcgagaccagcctggccaatatggtgaaaccccatctctactaaaaatacacaaattagccaggcatggtggcggacacctgtgatcccagctactcaggaggctgaggcaggagaatcacttgaacctgggaggcagaggttgcactgagctgagatcccaccactacactccagtctgggcaacagagtgagactccgtctcaaaacaaacaaacaaacaaataacaacaaataaataactcaggcaatcctgtttgttcttagaaaatgttaacattgttaaagctcaccctcattaactatggtaacaatagtgttttgtatttgggtggtacctttgaattgaaagcacttgggtatgtattacctaatcctcctcctgcctcagagagaaggagagagaagtatccacccgccctttttggatgaggtagtacagagaggttgaattactttcctaaggacagctagtaaatgttagaactgaactctttatattttattttaattaattaattttttgagacagggtttcactctgtcatccaggcgggagtgcagtggtgtgatcatggctcactgcagcctcaacttcccggattccagcaatcctcctacctcagtccccccaggtatctgggaccataggtgtgttgccaccatgcctggctaatttttgtatctttggtagaggtgaggttttgccatgttatccaggctggtctttaactcctaagctcaaataatccacccgcattggctccgcaaagtgttgggattacaggcatgagccaccacatttatttatttatttattattattatttttaaagatgaggccttgttctgttgcccaggctggagcaggagtgtagtggtgttatcatggttcactgcagccttaaaagtcctgggctcaagcgatcttcctaccacagcctcctgagtagctgagactacaggcacaagccaccatgcctggtagcttttaaatataaaatgttgagggtggttgttgaacttgtaaactatctttggttttctaagtgtataaatatgtggtttataatgtaggatgaataatctaaaattttatttaatactgcagccaaacaaaaaagatatttttaggactgaaaataattggccgtcaatattcaaaaaattttctttttttttaaaaagttaccgttgtgtaggttttaggtgaaatctttaattttatctgagtgaagcagcctgacagccagagaccttgtttctttcctgttaacggaattccccttgatttacttgccatgccataatactagttggcgctctgcacattttttgggtgagtcgggtgttgggtttattgttgggaaatggttaaaaatgttgttggtgttgactgagcttcaaaatgaatatgacattggttcttagcaaaaatttcctctatgtacagcacacatacttcccatttaaacaaattacacaagttatgcatgttcatcagcacagaccttttctcacatatgtatctaaaattttgaagcagccttaagcttgcagtgcaaagaacggtttccccctgagccatttgaggataaattgctgataagttccatcactctcaaatacttgatcatgtacttcctacaaacaagaacattctcctccataaccacaagaacagtaatcacaaccaggaagttaacactgagacattcctactctccagtcctaaagtcctgttgctgtttgccagttgatccagcaatggcctttgtagaaaaatatctaatcagaaccttgggtcataactggttgtctcttcaatctcttaatacagaagagttttcagtccttttagactttcatgaccttgacactcttgaggattgcaggccagtcattttgtggaatgttccttgatttggatttgtctgatgtttcctcatgattagattcaggttttgcatcttggcaggaatatcacagaagagccagattatatctttttgaaagattagttttacattttattttctgtttccttagagcgtttcccaaagtgtattctgcggaactagcacctactgtgttctcaacaccgtgccacctatagaaggtaggatttgaaaaagcttttgacttacaggaaggggtgggcttggcagtggcagtaattatcatctagtacagtggaaacagccttcagcccggactcagaagacctgggttctgcacttaactgctgtgtgatcttagatgagttacttaatccttctggggtagcaaaaagaatgctctcctcataaagtttctgtggagatgaaaaaaggcaaaagatttaatcacacggagaaatcaaagcacttaacaaatgtttgatactaatacaacacttctgtaattctagtgtccaataccaggtgacttagagtaggagcagtgtggtattttgggaaaagccacaggtcatgtttgaatcccagctgagccactcagcagctgtggatcttgggcaaattaatctgagcctcatgttcctcctctgtaaaatgggagtaattaagcccttgtgttttatcgtgaggattaaatgaaagagtgcaatgtaagatcctttctgggtgcctgatacacagtagagtcccacaagtgcttactccctaataaataatggaaaatagatttacttaatcacatgtacctccagttggaattgaatgaagtagaggaggagagaatgtcccaaaacccaaattgaagtgatggcttacagggctgctgtgccctcactttatctgttccctcatacatatttttagattgaaaatgtaaatgtagataaacagtgagaagtttattgaacctgagttatgatttgacctaagcctggacccgagattttgtaatatgatcaacaggaaaaaggtaaatctgggctacctaaaaatagaagcggtaagttgatcatcacacaactctaagaacaagaaggggattgttaaatagcaaaactaattatatttttctacttaaaaagctgttagtttctgtttctttaaccttttaaaaatcttttgtagaattactactgggtttaattcactttggagactttggaaaagaataatgcaaaatcagatcagtgtttggcacatagtgcttaattaatatgtattttggatatatggtgatttgaaggccttaggttagtaatggctgtatttgctgctgtgagcattatgctgacttgaatataacaatatatgtttatgttttcagttcctatcctactaattaaatctaagcacataataattagagctaaacagaaaattgtagagcttccttttgattttactactccatgttgttgatcaaagatattcccaataagatttagcaatttgatacactgttataccaaactgtttgaacagtttggtctagagtttgaaagattaatcgtaatcaacttgaatgaataacagtgttcatcattattcatagaaccaacattattttttattatgaatcaaagtaaaatgaatgtatcatttctagattagttaatatagttataatttaccttggcagaagtcacagaattttcgaaggaaaaggtcaaatacatttctttggatttaagtaaaggatttggcaatgtgaatctcatttttttgaaacaaaacatgaaaacagtaattctgctttttgtctaagtgaatgagcatttttttgcatattggaaagttatattatactacaccttgtaggttgactagaaaggatggttcgttctttagaattagagttgtcagtcaagcaaatcatctgtcattttcaagagcctcactagttatttttttattgtgaagtaggttagaaaattattttgtaaagtctaataccatacacatatattttgttagataatgataatgaagtgttttactgtcatttggttgacactcccacttttcagtgtcaaagttcaactatttgtattgaatactgaataatgcagtggaaaccagtatatgccttaattttactgttcactcaagatactattattaggatttgaaaactggtgcatgtgtttagttattttatcattcttagttatcccaaaacattaaaaagcagattttaatttaaaaacagatttttatgcagtatagccatgtaaagttcttttccagtgtaaaatcaaagtttctctgtatcccacttcacctgtagaaacactgaaatttaaaaatatgagttttaacattttgcctatttgaaattccagtaattcttttctcagtattaaactcgcaatccttataatgtagtaggaaaatttacccattgttatgtttcttaaaaacatccagtttatattcagcgtgaacctaaaattctggaaatggtacactttaaaaactgatcaaggggaacccactggccagtcatattcctgttccttttgactctgtggccacacctccgtgtaaagtgtaatgtttagaaactagattgagagagtgcttacacagccctgccctttggtcacatttaccactgcctgatttggtatcagagtggaagactgaagccttttctatagcagttaattgtgctgttgagaagagtacctttattacataaataccacacacacacacacacacacacacacacacaaacacacacacacgcacactctttatataccgcacagtagctgggttcctcgaagaggctaaaagaacagaaaattaacatcagattgtgatcacaaacatagaagctggggtttaaaactctgctcgtaagtgttcagaattgtacttcaaactgatagctttctcagagatatggctattcatatacaattcagagcaagcccatccattgagcaaccagtatagtgccgttttcataaaaggtacctgtaaatgttgaatatttgaattgagtatagattttagaatttcacctctattttcagaattgtacatatcatgggggattttaaaaaatggaaataaaagtactttaggggaagagagaagggaggtaaaggctcacgtgatctggtattctctgctttaaagttttatggcccgtggaacctccctcgggaggatgaagtgcagggagcataagcacataagattaccgaggttttatagtgtgtaattcatacagaactttctatgaactttcttttagttgaacagtttccttttggtttcacaggaagattttttgaaaggtttaatcttattttcctattaaattaaaatttgaaattcttgaaagcagtcagtttttaggtttttaaagtttttatactgcttatagaaatagaggatgggtattataattcaattggttatgtagttcatggaccaaaaaagatttagtatgccaaaactctcttaagttcatctccataaaatctttctatatgatgtagtaaattttttagactttatttctatgcccaatattttccttttaagatcttttccttgagaagaagtgtgttaatcagatgaaaaatgtttggagaggattttgtgaccttagaaaatattttttgttctttgatgtttttcatctgttcaaaaaaatagactgtactgaacaaagccgtagtaaataactggaaaaagatattgttgtatttcacttttaagattattaaccaatgcctgtatacttatgtaaggttgcttaattgtaaggcctattaagttatttaatgacagtaaattttatagggatttgtgtctggagaagaattagagataatctaatcttgttgatttgggaaaactgaaactattaagtaacttacccaaggtcacacaattagaaagtagcagaactgggccagatcttggactcttgactctgagttcagtgttataaaaccttattatatcatgaaaagttgtttcaactgtgacttactggagcaaattaagtctttgatgttttaatgtgcagctccttagtacctagttatgtgtaccctttgtatattggggatcttatgtagcataaaaagcctgggatgaataatttgtaactttgacctaaatgtgccaaagcttgtgagaaattttgagtcaggcaaagaaactttgttataggagtgaaaaaataaatgatatgtaagcaaacaaatgagtgaaataaatgttatataaaggaaatgatctcttctagaaatcatcaggtagactgattattaggtagtcagacataccatctagtctgaaagtaattattttttctctaactcatttagaagagttacattttgatgaaatacattaattatgtagatatgtatatgtaaatcaagttaattaaaatgatgattttatgttcagacctagaaaggccagcttctgtattacctgagtagctaactgcaggcttaaatcccttatatttataagatttgtgatttgcttttgaaaggataaatctcttttatagtctaggggatgaagtagtatttacgaacaaaatagtcatatattactataattcttcttacctaagaaacttaacattttttcaactgcttaataaaagatttttgggctttgtgaggttaattttataatttttatgtgcttcatcaaaacatggggaaagaaccttttaaaataactttcggttatgggcagctgcggggattttccctgttcactcacatgtcagggagcacaagcccgatcctgttttaaatcctcttgaccagattcctgctgccatcaatctgataaatgggtaaatgagtattattaactaagaggaatagtggggcctctgatgctcttggtctcacattgactaaactgagctgctatttctgactttgtcagtgtactttaaaggagattttatctattattttctctaaatttattgttttcttctttgtagatgatcatgggaacagcaatagtagtcatgtaaaaatctttttaccgaaaaagctgcttgaatgtctgccgaaatgttcaagtttaccaaaagagaggcaccgctggaacactaatgaggtagataagtttctttttttaagggtataattattttaagggcaaattttttaggttgcttcacatagtcctactttatgttagctttaaatttaaaatactgatctaggaaattgtaaatgacattatttaatctggatttgacagaaaccaaccaacatgttttttgatctgtctctgatctgcttggcttgcattgaaagatacacaatgtgcacgttgacttaactaaagtagcatgagtttctgtctgtgttttcttgcattttagtgtcttgcatttagtggttaaccctgcctgcatgccagttaaacgttagttgttatgtcttcatgaattaataaatatacagtcccactgttccacagaatgtgtagtgtcttgacaatgtgaatttttgtagagttggaaagggcaggtttcataggagtgaaacagcttttcgtcctttctaatgaagaaagtttgcttaatgctaagaatttttattaagattgaaggctgtacagtagattatgtatttagcatccaattagaaagtagatttatgaagtagaatgaaaaaagttaatcatcttggatgatgtttccttttttggtaaattttaatccaggagtcttactgttaggagtggattgctttgtcatcttttttattttgaaatctgaatatttcaatttaaggtaatacccgtttagtgtggtgatgagaattgggtatacgtccatcaatttgggagttatattcctttaattcagatggctggggttgctggttttgccaagttccatttgtgtgccttggctcaacattgatgtccaagttaaagcaaatttagcaccctatccttattggacactcagttctgttaaaagacacaagaagaaaatagtgctgcctattgagccttattttttaaagattctttggcgctaactacttcctgattcagaatgcttttgttttgcgtggtgggaggttatgtggataaaagtctctttccttatcacaggttagatttaaatactcactggaaccttacagctttgttaacttgtctcaactgattgtaaaattctttgaaggactctatgttttgatcattttcataaattacattttcccgtcagacagaatgtttttgctttgacaaatgtttgctagtttagaggcctgctgtttaaccagttatttattaactatttcagacatttttagacgtgaaaatgaagtagatatgcttaaaattagtcttaatcatagtttgttactctttcagcaaaatagtattatataatttggaagccatttaataagtcggaacttgattatgaattatttaaaaactcagtgtatttcttagtattccctgaaacgtagatttgataccaaattattatacacgttagttctagtttatttataaatgtaacccaacccataataagtatgtatttttccatattatatttcctgtggaattggcagcttatttattttattttttcccatggacccatgtcttgtggcagtttattttaactatgatttgacattatatttgaaaccagaaattgcttagtgaattaaaatcagtggcctgaagagtcttataaagctggatgtagcagtgctgggaatttagttggtagattatttccatcagtggcttcaaaactttttgaaacttttcagcataacccttcaactttcacatgtttaataaaacctctaaattatttacatgttgcaccttactagtatattagatacgttttaaagcatccgataaagaatttttatagaggatgagattaaaagaaaaaaatgagaagtttttccttattttctttctggacctcagtccacatactcccttggaggccagaggctgccataattcagattacagagaggaaaatgcatcccattctctcactggtgtaatgcaaatttgaggatctagatgggaaaacgtggattgttttgcatcagctatcactcatgctgaaatctaggtagaggagcgtatgttctgaagggtggaggcagcaggaggtggcacagctgatgggtgaagccatgcagcaccctttcccttgggatgggctgttctttcagttaattgtcagctcagctgacaaaagctcctatgagggaactgaatttacaggttgactcatttctctgtagaggaccttgacttttttcttgttttattttttggctttggaaaaatagaggaatattaagtgtgacagcgaagacttaccctacgaattgttaattctgcagaatgttatgtggcgatgataacctgctatttttttttttttaaactggctttggtaatataggtggaataaagcaatcagcggtgttactaaagcacttctttgatctagctgggaattggcattttcttacgttcttcagcctgccattcttcatgttgacatgaaaacctgaaggaaacgtagttcagtggacttgtttctcattggggctttgtggtcctatgtcatgctaaatcatatttagtcaaaattgcccgtgaaatcccttgacttgctcataaagtaaagtttagtcagactgcccttattaagagcccgttttccttccagagttggaatagatttctgtgttttggatgaggaccacatgaagtagttggcttgtatttagaagctgtgttgtacaaaaactctatttcttagatcccactgaaggggctcacactggaagaggcgtgtgggaatgcgcacagttgagagcacagtagatttgtgttttccatctcactccctgtacagcatatgttcacaaagtaagactggtggctcgagctgcctgtatgaaatgtcaactgtcatctttctctgttctccatgttcgtgtgtgctcgctcgctctctctgctggatgtgtacagttgaatttctgggtataatgtgactcctctatactaataaggaattcctttactcagacctgtgtttaaatatttgtgattgtttgaaaaaaccttttatactgtgtgtgttgtgagtgagattgtgctcattccatccttttttttttttttttttttttttgaggtggagtctcactctttcaccaggctggagtgcagtggcatgatcttggctcactgcaacctccgcctcccgggttcaagcggttctcctgcctcagtttcccaagtagctgggactacaggtgcgtgccaccatgcccagctaatttttgtatttttagtagagacagggttttaccatgttggccaggatggtctccatctcttgaccttgtgatccgcccacctcagcctcccaaagtgctgggattacaggcgtgaaccactgcacccggccccatcctaccatttattgagcacctgttctttactactgactgggtattttatataattatttgtaagccttaaaatagtattgcaaggtgggtaacatttccttttagagatgagggagtgtaggtagacagtagttattttttggtcaagagagcatacttgatagagcctgtctctgagcttaattgcatctgtgttgcttgttaattcttaggaactttcattctattgtttactctataggagtttaatcaaaggcctacaaacctaaactacagcaagtctattctgtaacgtagtttttttttttttttttttttttggagacagagtctcactctgttgcccaggctggaatgcagtggtgtcatctcagctccctgcaacctccacccctcaggttcaagtgattcttgtgctttagcctcctgggtggctgggattacaggcatgtgccaccacacctggataatttttgtattttataattttgtagagatggggtttcgccctgttggccaggctggtctcgaactcctgacctcaggtgatctacccgcttcagcctcccaaggtgctgggattacaggtgtgagccaccgttcctggcctgtaatgtagttttgaattaaaaagagttaatatagtcttaatattgtggattcatatgcaaatgtttggtgaagctgaaagtcactaaaaggaagactctaagaaggtaagagagatcgttggacctacttaagctacttttaaccttttctaacccattggaatacctaaaatcctttcccttcttggatgttatttgcaattgcagaataaattaaatgttacatctgaaaccaaatcaattttagattgtgctcccgcagccaccaatactggtcctcaggtggtaaagatgacacaaggagtgaaggtgatgatggctgcactaattatggaagccagtatgtattgaacatcctttgtatgctaggcactagtgagtcctttacatgaatcatcacatttaatctttcagttaatcctatgagatagattatttgactatccttatcttatagatgaggaaactgaagccatggatatgttaactaatgtacccgcagtcagagccgggaagtgggggacgggggagttcagccgctgcagcccgactttgagtcccataatccctcattttgtcccacagagcaatatcaagttgacttttccaagatcttgtagctatttagttctaatcctttcgttttatagaattgtttggcttcttcatctgattttaaaatgttgtaacaaagttaatctaattttgcattatgattttttaaaaagtggcagacactcatttcttaggaaagtagttttgattcctttttttaaaaaaagttttctcctacgtgtattttgatagttttgattctttttttatttatttattttttatttttttttttgagacggagtctcgctctgtcgcccaggctggagtgcagtggcgcgatctccgctcactgcaagctccgcctcccgggttcacgccattctcctgccgtagcctcccgcgtagctaggactacaggcgcccaccaccatgccgggctagttttttatatttttagtagagacggagtttcaccgtgttagccaggatggtcttgatctcctgatctcctgacctcgtgatccgcccgccttggtgtcccaaggtgctaggattacaggggtgagccaccgcacctggccttgtttttttttttttttgagatggagtctcactctgttacccaggctggagtgcaatgacgtgatctcagctcactgcaacctccacctcccgggttcaagcgattctcctgcctcagcctcctgtgtagctgtgattacaggcatgcgccaccatgcctggctaattttgtattcttagtagagacagggtttcaccatgttggttaggctggtctccaactcccgacctcaggtgatccgcctgcctcagcctcccaaagtgcttggattacaggcgtgagccacggcgcccagcttaaaacaatttattgaggtttaatttatgtattacaatataaactgcacccatttgaagtgcataattcaatgagtttttgacaagtgtatgctggtgaaactacctccaaaatcaagacacggcacatttctatcaccccataagtagcttgagagagtatttttttgtttgtttgttttgttttgtttttttgagatggagtctcactctgtcgcccaggctggagtgcagtggcgtgatctcggctcactgcaagctccacctcccaagttcacgctgttctcctgccttagcctcctgagtagctgggactacaggcacccgtcaccacgcccagccaattttttgtatttttagtagagatgggctttcaccgtgttggccaggatggtctcgatctcctgacctcatgatccgcccgcctcagcctcccaaagtgctgggattacggacgtgagccatcgcgcccggcccgatagttttgattcttaatgactattagtatgtggactatggatagtgaaaaaactatattaaaaatagaaattttgtacctgtgtgtaacttgagcattaagcctgacttttatattcagggcaagggagaaagaatgtattaaacacagagcacattcattaaagaacctactcttgtttcataatcagtttggtgttcacatcttcatcaggtgaactgctataaggtttctgcattttaagttagtatttttaaggcctagagccagaaataattatgctaacacaactgtctgaattcacaaatgactatttcataattacgtatattagtactccatatatgttgtccagactgaaaattgttttgtttagtcattaattagctgtttgacttaaaatataactactgcattccctagtctctggatctagatttcacttggcattcttccaaagccaaactaatgcagcaccatgaaccttttataatgaaaatgttctccctaaatatgttcaaatcacttttgtgtgttactatttttgaactaatgttctttttttgtttttcctgtaatacacagtttctctagagtaagcaaacaaaatagaattctagtttgtactgatccttaaagaaagtttcatcagatgtttttagttggtggtagctttagagtgtcatattaaatgcattttttaatggtaaaaatgtctatgtagagagcagtataggttgatacattctaagccacaccaaagcgtctgcaggagaaaaaacaaaacaaaacttgagtaataattataatgctttttataggaggaaacttactctttaaaaatcttgagtactttttccccctaactttttatatttaggtaagaaaaatggcctttaacactgtaagaattattaaataataattaatttcaactgtttttaacatcaagccaccttatttttttttattttttttttttgagacagagtctcattctgtcacccagactggagtgcagtggcacaatcttggctcactgcaacctccacctcctgggctgaagcaatcctcccatgtcagcttctgaagtagctgggattataggtgctcgccaccacggacctggctaattttttgtagagacagggtttcaccatgttgccaaggcccatccaaacaactgagctcaagcaatctgcttgccttggcccctcaaagtgctgggattacaggtgtgagccactgtgcctggttaccttaccttttaaaaaatttatttagtctttttttggtgtcgatacataatcttgagtgtttcttgtgtttttaattttttttcctttgtgtaactttgtgttaggtttagggctgtaatttttcagtgattggtttttctagtgtatttatatgttatctctttgaaatatagacacacattttggggggatcatttaagactcttcagacttcctaaatgtgagctaagctgaaaagcaccagtactctaatcataaaggcaggtgagatatttcagttttgatggcgtggaaagtcagttaacctttaggtagggcttggttttgtttagcttttggcagggctagtggtttgaacggtcccagattattttgttccaggcagggcttttctgattaaattgcaaaaatgaaaatgcatataaacaacacagagagccaagttttaagagtgacattatgtgatttttgaacacagtatatagtacgaagtttcaaattaaaagtgatacttgtgtagcagttaggttaaatatagttcctctgtttgctttgctagtgtgaagtgagatacatgatactgaaatacaggtaggcacaagcctggagatcaggcagcctgtgtcaagtgtgcagtgcctcagcagcagcagcagcagcagcactccacaggatatattgaaaagctggggcggaatgtcctcccacacaggtgaggggagacaggtgaaggcaggtttgacactgaggaatagtaagagaagtaaattgcaccctcagagtacagcaatatttatagcatttgaataagatgttaaagaacattttcttttaaggaagaaattcctgtgggtcttcctcagtttcaatctaaactagttttattatactattacttcagcatgtggcacttaacctggccatagtcagtgttcaataaatatttgttggatgaattaacgtaaaaacacaaaaaactcagtataaaattaattcttggagttcttttgcaaatataaaactcagatatatgcattacataaaaagaaaatacaaaactaataaagttttatattaacagggttagttaaatgcaatagatgatgttttgccaaaactaaattgtctcgcaacatgagtatcatactgactgttctcaagcaggttcttttgaatttggcatgcggtactatcttgtgtcctgcaattattttatactgagaagctgttttttacatatcaagcatttgtataagtctgtcattaagccttggcacaaatacatcatttagttttaaattcacttctggtttttctcattagcccaagaaaaatttaaatgacactactgggtactaggggaaacgtaaccacaaatcacaaacttgagcaatgagtttgtgtgttagaacatactcggttcaggtgttactttttcagattatacattaaattaagatgcaaagttaaaaattttatatggacttacagccccttgataatacttccacagagccgcagttgagaaacactgctctcttggaaagggtgcagagctggtgtcagaagcagattcgagtcttggctctgccgctactcagctgagtgttgggtaaggcacttaacctacttggcctctcttgggtcttaggtgatggcgcttggtgacctttgaagatttgtctttgaagattattgttgcttttgaaggttttctttaggaatgttggactttccagggaggcttgggtccagcttcggagtttatttgattaattttttttttttttttactgttaatcatctttttacttacttttaagttgtacaattcagtagttgtttatttttatttataaatttaaaaatttattttttaatttttattttattttttgtttttttttttaaaaccagaacatttactgcatgactaattgttgaaattcttaagctgatcaaagtgctccaacagctgccctctttggtttaggtgttgtttcctcacggagtccatgcctgaatctgtggtgtacaatttttaggtgcctcgttcggccagtcctggtggcattttgtcttttagccttggcactccagttatacgtcctcctgcacttggcggggtagccacatttgccacaggtcaacttctgaaggtggtaggccttcacgccacagcggtggcacaatgtgtgtgtcctattgcaacactttccaaacggtcatctcacttctgtggctgagaccagagagacctttttaatttttttttttgagacagagtcgtgctctgttgtcctggctggagtgtagtggcgcaatcataacttaccgcagcctcgaccttccgggctcaagctatcctcccacctcagccttctgagtagctgggtctataggcgtgtgccacgcccagctaatttatacattgtttttggagatggaatctcgctcgccatgttgcccaggctggtcttgaactcctgggctcaagcagtcttcctgcctcagcctcccaaagtgctgggattatgggtgggagctcccgcccacactcggccaattcagtagtttttaatacatctacaaagttgtgtagccatcgccactacctaagttcagaacatttttcatcaccccgcagccttctggactgagtggagtcagcatgctcaggggttggcagcatctgttcagggggctcgaggttcttctttggtgtcttttcaagtttctatacctgtccagtactgaagctggaattggagattgaccttttgtccaagtcataacttaatatgctatttcctgaaactgcttttaagaaatgttaaggtgcaaatgaggatccagtttgggcccacatttttctaagttggatgaagagcagttgagtggagtttctagttgcactcgagactctgtactgtgcagacagtttattggtggagttgcctcaggataaaaatacccagctcttctcagtagtgggtgggagactttgggtgatggtgatttccgtaaaggagaagctgagcctggttggaaggaaaaaggaagaatatacggagaggctggcattctttagctgagtggatttaggcttgagctggagtcagaatcacctgggaggcttgttcaaacacagattgctgggccccatccccagagtttctgttccagtaggtcctgggtggggcctgaggatgtgcatttctaacaagtgcccaggtgaaagctcacttagaggaagaatctcagcctcctggaagtgtgttctaattaacttcactggactgtaggctcagctttgccatccccataccactcatgcatgttttggtgtgctttggctacataggttacagttgagctttctagagcttttttctcatgtctttagctagtaggcacctaaaagttgtagaatgcataggttttatttttggcatttatctgaagtatctgttcatgtcttgacatataggaagctcttttaaagtttgggtggcagtggagagggcatatagaagcatattctaatttttcaatgttttttgaaagggtagcatgaacaatagtctccccactccttcttcatatccgtttggctcaagtagctgaaaacagcagaaccttaaagctgagtgtcacagtctgcctgcctacctgcctgtctacctgtctacctgcctatccagctacctgcctacccaccttcaagtcttttcgaatactgcctaccccaggtttctgatgataaattctgttatcttggtaattatgaagttattttgaaggttttaaaagaagctcctaaaaaataacctaagttttacagtattagtgcttttagaaagctggaaaagcaagtgaagaaacaacaaaaagaaatcctttctagatggatgagaaaccacagatgggttggggtgaatgcgatgaaatagaaatgtgtgtttgggagagtgttttctctgtaaggaagaatattctctgtaaggaaggcaggctatgtggctttcatgaggtcttcttagaagcttctgtggtaatgttcactggtctggcgaagggggtagacttgaaaaaattgtaaaatggcgagaacctggaatttacatttggggagaaaagaaactgggaggcccttcagctctggggaattggacaaggtgaagcagagtccacatgtgtgtgtatgtgtgtgtatgtgtgtgtgcatgtgcgcgtatgtgcatgcatgtgcactcatccaggtggggcgtctgcggtagcaccgaggtggattctgaggcaagcttcatttggccctgagttcattttattgtgactccaaaggagttcatgggggaaataaaggctctcatgtgcaagaaacaaggaagcagaaaagtcatttgacctaggctagaaaaggcggccacctctagtctatagtcagaagagaagcagctgttcagaggggctgagacaggtaatgctggtcccaggccaagcctcttgaggaaagagaacaacattccgaaattctgtgagtagctcataccctgaaggagttcttttttttttttttttgagatggagtctctgttgcataggctggagtgcagtggcgcaatctcggctcactgcaatctccgctcactgcaatctccgccacccgggttcatgccattctcctgcctcagcctcccaagcagctgggactacaggcacgcgccaccatacccggctaatttttttgtatttttttagtagagatggggtttcactgtgttagccaggatgggctcgatctcctgacctcgtgatccacccgcctcggcctcccaaagtgctgggattacaggcgtgagccaccgtgcctggcaggagttcccttttaagatcgctgtaggaagagtcagaaggtcaaggacaaggcgccgaggtgcctaccctcttagtactttgtgttggggagtggaggctgtccagagaggctggccaaggggaggctccccctgggaagatggggatcttttttaggtggtgctgcaaagggacactttttcagagagacaaggggaaaacactcgcatatatttacttctttagaagttgagaaagttaaaagaatgggaagatgccatctgcttcccatttctgagaaagggtacattaaaatagcttgaaattaagcagaatgtataaaattaacgtctgagtatagtcatttcccgtttttcctgacacatctttcagctgtgtagcaacagatccgcattcctggtgtcagaagacagttgttaatgtgctagttaaaattttattttatttttgtactgttgagcaaaatttagacttaactctgttttatttaagaagcatttttgttaaatgctttaattattattaatcaaatttttttgtatttaagcagttttcaacaatctattcctcaagcaattcagagaacctgctgtgtggtgattatgtattttttatttcataaatgggggtagtgaggcataagtgttttggaattagcatttgtcatcatctaatatactgtgtaaattacatcttttcactgtgtattgtctggctgccactgctagactcttaagttccaggtggacagggatcttatgccaggtggacatggcatacatgtatgtatggcaggcactgttctaagtatatacaatagtccctggagtgtccagggactgttcattgaatgaatgagtaaagacttctgtcaacaaatatcatttagtctagtgctcaagtgggctgtaatactctgtttctgaattaaacagtctggcttggtgatagtcactgacagcaccaagcagatccatgggagctaccccagaaaagcttgtgatgcagaggagaggagcaaaatgtgcgctccctgtgtgcaaatggattcccacaaccacggaaggaagaactgcggcagacatgcttggttcttaatctcagactcatcagtcagggaattcactcctgtctaaggggcgagtgagggtgaggcaggaagccagcatgtcccctgtgaaggagctctttccaggtagaagcatgaagcccaggaaaggcaatttatacagcacatcaccaatagagagatggccaaaccactctgaactctaccatctgaagtgaacaatttctaattatgtatcttcagatttttttctttcagatttctttctgatatatgtatctacagatatttctctgtgccggtgtgggcattttttctatatttattaacccagaataggtttactgtacatgtagttctataacctggcttttctcttaatatgttatatatctgttaggcattttttgacagtgatccacagcatcatgtttgtttcttgattgactgagacagattctctctctgtcacccaggctggagtgcaatggtgcgattatagctcactgcagcttcaaattcctggacccaagagatcctcctgcctcagcctcctgaatggttaggactacaggcatgggacaccatgcctggcaacgttttttattttttgtggagacaggatcttgctgtcttgcccaggctggtcttgaattcctggcctcaaatgatcctcttgcctcagcctcccaaagtgctgggattacaggtgtgagccatcgtgctcagccaacattatgtttatcgactgtttattaatgttccatttaattttggctgggtatggtggctcacgcctgtaatctcagcactttgggaggctgaggcgggcagatcacaaggtcgggagatcgataccatcctggctaacatggtgaaaccctgttcctactaaaaatacaataaattagctgggcatggtggcatgtgcctgtaatcccagctactcgggaggctgaggcaggagaatcacttgaacccgggaggcagaggttgcagtgagtcgagatcgtgccactgcactccagcctgggcgacagagcgagactctcttaaaaaaacaaaaaacaaaaaacaaaaaacccccccaaaattccatttaatttaatgccatcatttatgcattcagcaatatttttgagggcctactatgtgccaggcactagttggagttgctgagggtataagatgaggttccaattctcatggagcttatcgtttagagggaaaacaatacaaaagtaaacaagtaggtgaggatttctgagtgtgctaagaacaaagtagagcagggtactgaggtgtgagcacatcagtagatttcgtaggaaaggcctttcttaggaagttatatttgagctgagaactgaatgataaaggaaagccagctacttgagtatctgggggaggaatattctaggcaaaggtaatagcctgtgcaaaggccctgaggcaggaatgtgcttgctttgaggaaatgtgaaaaaaaaagttgttgattggaacagtgtggggatctggcagatgagctgggtgaggtaggtaagggctagatcttgttgtgccaagtaggcataaagagttgagattttgggtcgggcacagtggctcacgcctgtaatcccagtactctgggaggccgaggtgggcagatcacctgaggtcaggagttcaagaccagcgtgaccaacatgatgaaaccccatctctactaaaaatacaaaattagccgggcgtggtggcacatgcctgtaatcccagctactcggaggctgaggcaggagaattgcttgaacctgggaggcagaggttgcagtgagtcgagatcgtgccattgcactccagcctgggcaacaagagcggaacaccgtctcaaaaaaaaaagagttgagattttgttttaagggcaacatgaagttattggaggatgagctattaggaagtgagcaacataatatgaagctttatgttcaaaggctttcttggctactgtgtggcagtcaggggaagcagagagaccagttaagagtctgttgcgataactggtgatcttggtaagaaatgacggtgggggtggagggagtgagaagtggatgtatttcagaggtggagctgtcaattcatgggattggatgtagggggtaaaggaaaggagaaattttgtggcctcagctactgcgttggtgctggggctcgtcagtgagacaaggaagtggagattaagagtgttcttctgggatgtcctggttgtgagatgtctgttagacaccagagtgatgatgttgaataggcaacttccataagtctggggagaggtcctgtctggagataaaaattggagagccgtcaatgcgcaggtgacatttaaagccatagactaggtgagatcacctgggatgcagaagatagatggagaaagggagactaagccccgagcagtgcaggaggagccagcacaggaggctgcaggggagccagggaggcagtgctgaggcaggcaggtgtgaagtggaagccaggagaaggacatgttttaaggagggtgcgtcacttttatgtttgctactgtaaccagttatcacaaatttagtggcttaaaacaacacagatttcttaactgttctgtaggtcagtcatctgacatgggtctcactgggttgccatcagggtgccagcagggccatgttctttatggaggccctagagaggaatctgtttccttgtttgttccaccttctagagtctgcttaatgttccttggcttgtggctccctccttcatccttgatgccagcgacgtagagtctttgtgaccctgctctcttctcattcactcaccctgacctcttctgcctctttcttccacttttaaggacccttttaattacgccgagtccacctggataatccaggataattttcctattttaaggtcagctgattaacaacctaaattctatcttcagccttaattcccctttgccttgtgatgttatttatttacaggttctggggattagggtgtgtatatctttggggttcctgttcttcctttcacagagggtatcacaaaggttactgggaagttggataaaatgaggacggagaagtcattgttggatttggtcaactgattagtaacctcaatgggtggttccagtggagtgttggtgcggtggcccaatgggagtgagttgaagagccagcgaggtgaggacgtggaggctacacatcttaatggttcttggtggcagttttgctttgaaggaaagtaaatagtggcaagaattacaaaggaaaagcacagaggacagctctgagaggatgaaatgggagacggaatgtggaacagaggttcagggacgactgctggaaggaaggggcattagtgtagtgtctactggaagagattaactggatgaagaacctggagtgaaaccaagaaatggtttatagggatggggacatatgaaagtgaaattcacagggttatttttaatagaacagcagaaggtactgatgactcctgttgcttgcgcctgggtcagtggacaggatccttgtcagcagccactacagggcccgcaagcccacctcagatgctgtcattccacgggtggtggccaaatctttgaagtcagtgtagaacctctgccctttcttcctggggagcctggatcagccatgatcttgcccagactcagcgccatggtggagggacatctcctttcctctcctgccccccaaccacttcccttacacttctgctcttctctcctcacccgctaaattgtaggcctgcctccatttctttctttactttgttacgttttaataacatttattcactccacaacatgctcacagaggtggaagaccaagttagtgcagacccattcattcctggacccagtggctctcaagtgggagaggtgctggtcttaaagggtgtttaggaacaagtgggcgtcatagtgagtgtaaaaacgccctcgccgtgaggctcagaagagccaggcctcctcctgctcctagtccagtcagtgctcctccttcatatgggtggttcgcagccctgctgcatgttagactcaccaggacagatttgtaaacatatcacgacctgggccctaccacaaactaattcaactggagtctcagggatagggcccaaactgaggattttaaaaagctccctaggagattctgaagtgcagccagggctaagaactacagccttaaatctactgttgactgctttcaaaagaagtcttcactgtgcttaaacaaattgtggttaaaagtaagcaaaagggccaggcgtggcggctcatacctgtaaatcccagcactttgggaggccgaggcaggtggatcacctgaggtcaggagttcgagaccagcctggccaacatggtgaaaccacgtctctattaaaaatacaagaaaattagctgggcatggtggtgcatgcctgtaatcccagctactcgggaggccaaggcaggagaattgcttgaacccgggaggtggaggttgcagtgagctgaggtcgtgccattgcactccagcctgggtgacaagagcaagtctccatctcaaaaaaaaaaaagaaggaagcaaaaggaaatctggaggggaacatttgtaataggcaagtggtcattattaaatgtacagttatattattaaaatgtagatcatttgaatcaactgacacgtctgaatttggattaaaactcctaagcagtatacggtactcaaagcttggtactggtagggcacagtttgttcatttctgtttttcacgttgccttctttacacttttttcctttctgaatagcctaatatgacgaagcagctatttgtaacatgtgggaattattttttcttcttttcctcccatagtctgtctccatctttgagctgctgttctttctacagcttaaggttcttagatgtccattccattccctacccagtcttggaacactgtgagatgagcattcctgataagtggtcatccaatttggaaagacagtattttacaaggtgatcagtttctgaggaatttcagttagaaaactttgtgtttttggtttggtcagggaaagatccagaaaagtgatcaagaggttagctcaaacctgatatagggagttctcagaatagagattggctgttaatggtctcttataattttttccttgaggatagttttattagtatgagagtaacttaaccatcctcattgtgcagttcttccgcctcagtctcccaggtagctgggattacaggcacgcaccaccatgccctgctaattttagtatttttagtagaggcagggtttcaccatgttggccaggctggtctcaaagtcctgatctcaggtgatccacctgcctcagcttcccaaagtgctgggattataggcatgagccactgcgcccggccccaaacttttttataattctctatgacattgacatactcccacaacagcttcagtataatttagatgcccttatacatctgcgtggccaaattaaaaaagacaccatcaggtgtcagcaagaaacagagcagggggagctttcatgtactgctgatgggaatctacattagtttaaccactttgggaaactagaattatctatgagagtggaagatttgcacaccataaagcccagcagttctactccttatgtatattcttgacagactgtatagctgtgaaaactaatgaattgatgaatattcaagaagtgagtaactctcacaaacataatgttgagagaaagaaaccagacactcagaatatatattgtttgattctgtatacaggttcaaaacaaaggcaaaattaatttatggtgttgcaagtcaggagatgtagttacctttggagagtagggaggatatattagcagggcttctggggtgttggtaatgttctttcttgatgacaggtgtgatacacatgcacacatacacacaaatatatttacaatttgtgctgtttcctgtttgtatataatattttaataaaaagttcactgaaatggggctgggcacagtggctcgcgccagtaatcccagcactttgggaggctgaggcaggcagatgctggagcccaggagttcaagaccagcctgggcaacatgacaaaaccattgcattacaaaaaaaaaaaaaaaaaaaatgcaaaaattagcccagcatagaggtgcgtgcctgtagtcccagctacttgggagcctgaggtgggagaattgcttgggcctgggaggtggaggttgtggtgagctgagattgtgccactacactccagcttgggtgacagagtgagagagaccctgtgtccaaaaaaaaaaaaaaaaaaaaaaaagtttactgaaatggtatatggtgtagagtagattattgaacagcagtgagaaatgagcaaaatacagctacatgcagcaccatagaagaagattctcacagaatacatacgatcagattctagttttctaaagttcaaagagtcaatgctaagctattgtttaaggacacataagtaactcgtggatatcagtcaggattcagtcagggaagcagaaccactgtattatgtaataagggatttattttttatagcaataagatattttacaactgtggggaaaagctggaaaaatgacagtctggaaggaagaattagaggaccagagaagagccacgaaagcacctctcctgaagcacctgtacgggtggctgagttagaacttgtgggaggctctgagaagccaggcatgagcagctgctagaacgggaccacaaaggaaagctgatgaaaaagtctatgaaaagctattacctctgcatagcaatcacttctctaggtctgctggccagcagctgatggtccaggggcttctgttcgctgacaaggccggcagttgggggaaaaagctagtgacagaagcagcacgtggacaagctggaaccctctggcatctccgtttatatctgctaccacctctaactacctcggccctcaggaagtaatggtggttttacttttcgctttttaaatcttgtccagattcagggaagggaatcctgagaaaattctagcctaaccaaattgagttaaaagctgcaatagtgatggttgcacaactctgtgcatatattaaaaaatatactttaagtgagtggactttatgatttgtgaattatatctcaataaagctgttatttacttaaacaaaactgccacatgttgaaaactttaaagaaacaatgttaccatggatgatttaagtgctgcttcttggagatatggaagtttcagtttagtaattgcttcttagcaggttgtatctatgttactctacactgctattctttggaaagctagagcgtagtaactaagatctgtttgttaatgacagacctcaaggtctcctgacaggtctgggaataagttttgaaaataggttaatgggatattgtattagtccgttctcatgctcctagtaaagacatacctgagactggataatttataaaggaaagaggtttaatggactcacaattccacatggctggggaggcctcacaatcatggcagaaggcaaaggagaagcaaaggcatgtcatacatggcagacgagagaatgtgcaggggaactcccgtttataaaaccatcagatctcttgagactcattcactaccatgagaacaatatgggggaaacagtccccatgattcaattatctccacctggccccgcccttgacacatgggaattattacagttcaaggtgagatttgggtggggacacagccaaaccatataagatacattttctcacttttcaccatgtatatttggttttaaaatttgaactaggatttctttacttatacttaaaagtaggttttacagattcattaaaactttcatatcaaatctgttttgataatctgagatattctcatcatctcaaactattggaaaatgcccttatctactctccatttacgtggagccacttttcatttgaatgtttgttatggctctttttattctctttataaggagacaattgcccaaataaagatatgcagctttcctgcctggggctgtagttgtaccatagtaaggaaatggatatgaaggttttttaaaaagttcaaaaacagagtagcttgtatcatttatatgcaaaaactagaaacatttttagctgtagttacgaagacttctagctttttgtcaactttttaactaaaaggagtcccaaaacacaggttatttctacatggattaaatttataataataaagaatcattagtattactaaaccatattgacagaattcttgctaaaactaggctagacagacaaggatggatactgaaggttgacactgaagacctagttgggaagaggattcagaggagcttggctagagtttggtcaaggagacactcttggtcagtatgtaagtctggctaattggaagtaaataaaaggcagccatagtcttggagggaagacagacataaaaaatgattgcaatatggtataaaaggtataatagaattataaagtatgtgtgtataagatgtatctgcggcaaaaaggagcagtgatggtctgcttgagcacatgaaggatggatttttttttttttttggagacggaatcttgctctatctcccaggctggagtgcagtggcgccatcttggctcactgcaacctctgcctcctgggttcaagctgttcttttgcctcagcctaccgagtagctgggattataggcttgtgccactgcgcctggcttatttttctactttttagtagagatggggttttgctgtgttggtcaggcatgtctcgaactcctggcctcaagtgaaggatggattttttttttaaaaatgacactaaagctgtattttgaagatgattagaaagtttgctaggcagacaaagagaatcagcaagaaaactttctgggctgaaggtactacgtttagtcaaactattaatacttcctttcctgtgcaaaggaacggaagaaggaagtagtttgagttgcttggataattcgctatggctagtttagggtttaaggagagagatggatgagttaaggttagagagtagcagctagatcatagaaggctatgtatgccacgttgcgtttaaattttgtttttttttttttgagacagagtcttaccctgtcacccaagctggagtgcagtggtgtgatttcggctgactgcaacctctgcctcctgggttcaagcaattcttcctgcctcagcctccctagtagctgggattacaggcatgcactgccacccccagctaacttttttttttttttgagatggagtccccctctgtcacccaggctggagtacagtggcgggatctctgctcactgcaacctccgtctcccgggttcaagtgattcttctgtctcagcctcctgagtagctgggattacaggcacgcatgtggcacccagctaatttttttttttttttgtatttttagtagagacggggtttcagcatgttggtcaggctggtcttgaactcctgacctcgtaatctgcctgcctcagcctcccaaagtgctgggattacaggtatgagcctccgcgcctggcctaagatttttatttctagtagaaaaagagtttcaccatagtgaccaggctggtctcaaactcttgaccacaggtgatccacccacctcaccagtgtgccaggattacaggcatgagccaccacaccagcctgggtttacattttaacagatttttttgttgttgttttctttgaaggtctcactctgtctcccagcttgatcatagctcaccatagacttcaactccttggcctcaaacaatcctctcatacctcagcctccagcgtggctgagaccacaggggtgcaccaccatatctggctaatagttttatttttattttgtaaagacagagtctccctacatttccccggccttgaactcctagtctcaagtggtcctcccgtttcgtcctcccaaagtattgggattacaggcataagctactgcatctggccttttagcacagtttaatcagaagaggaaaatgagcagatttttattttatgcagttaccctgtggaccatgtagagaatggtttggaagaacgctgggagtctggtgaggaatccatcccagaggtagtaactaagacctgtttttagacattggcagtagcgaaggatctgacttgggaggtagagttagtagcatttatgtgacctctaagacgtgatcctgtcacactttttctctactctgttaggttcagtacttgagggcctttgaattaaactgacagatgatagattagcaagagaaaaggtagattttaattttgtaaatacttaggggagttcacaaataaatgtgactgaaaagagttgttagaatttggggtttatgcaccatcttaatagatgaagaggagagggagaaagggtacttccgggaaaacaaagaactatttggaaagataaatgggctcataggagaataaatggaagctgtatattttcgtgacattttctgtttggttgtcttctcatctcagatgattagagttgcccctgtgggaaagggttcatgacaattgagttctttgagttcttttgggaggctctgcttttaggcagataaggggtttcaggaactcaaatgccttcagctcaaaataatttttatgctatagtggcttattctggatcctttcacggtgaaggagaggagaaattcctgagattctggtttgagtgatggtggtactgtagataatgaaatacataaagaagagcaggtttcaggacatactgtattttcatttgtatggttgagcttggagcacctggggaacatctagagatcctagaaagcagttggatgtagatttgggacctagagagagctcaaagaagctgagagtacggataaaattttccttggagagtaggagaatgagagaagaaagagcttccagaaatgaactgaaggaggctggaaaatgagagaggatgaaatgagagaggggacatagaaaggaaattgagcctacaaaggagactaagaaggaatagttgaagatgaggggagctgggagagttacagaaaccaaggcaggacatagtagcaaggagactgagcaatagggatcagcagtgccaaggtgcagagtaaaattatagaagtgttaaggaaaaaaaaaattatatatatatatatttagtatatgataaaggtacagttttgaggaggaaatggagggctgtttatttaaatggacatttgggacaattggcttaccacttaaaaaatattaggttaggccggatgtggtggcacatgcctgtaatcccagcactttgggaggctgaggcaggaggatcacttgaagtcaggagttcaagactggcctggccaacatggcaaaaccccgtctctactaaaaatacaaaaattagccagatgtggtgacgcatgcctgtaatcccagctacttggcaggctgaggcacgagaatcacttgaacctgggaggtggaggttgcaatgagccgagatcatgcaactgcaatccaacctgggcgacagagcaagactttgtctcagaaaaaaaaaaaaaaaaaaaagttagtttaggtccccacctcatgccttataccaaaataaatctaaaaattaaatgtagaaattgaaaatagtaaaaatattaggagaaaacgtgggtcaatacttactttgtgttcaagttaggaaggaccatacccattctaattataacagaaagaaaagactaagaaattttcatgtaaatccagcatgtctgtgtgctaaaaatatcataaaattaaagtgtaaatggcaaactaggaaaagtatttgccatagatttgacaggcagaggtttaatatccttcatatctaaatgatctatcaaaaaaatgaataactgaaggtttctggttaagtaggactcattgaagatgtctttatcttccatccttccaaaattttgataaaatgacaggaattacagaaggggtagacccacaaagagtgaaaaagggagagtagggaagatttttctggttgatgatagactaagttgttgggccttatttcctgctgagagcaagtcgagatgatggacaaaatttaaaacaaaatttatgtgaaggaaatggagagttaacaaaatagtgaagatttgtgggtgtaagaggtggggcgtggtgatgaggtagggaagcccaagatgtgagaccagcatttgcagtcatttctttcccagaggaatctgctcattccagaagaattaggcagatgagaagctggacggctgaacagagtttttgttagactcagagggcggaggacaaaaattggagtttggctcagatcagggagcaggaaaacttcttaggctttgagtaggagacccaaaagcctatatcttagagatagtagctcctaacaggtattgaagtccagctccagaccctctcagttcctggctggatcaaggtgttctggaaagaagcaagtataatttctttcattaatagaagaagataacatcactcagaacctcagatgagctctatgtttatttacaatgtttggcactcagaaatcaccaggcagatgaggatttaagacaatgttactgaacgccaagagaaacaacagactatggaagtggatcgacagggatccagatagtgaagttattagaaaagggtaaggtatgtagtatgtttacggagttaaaagattaagaatagggaaattggaaccacaccaccccctccccagtagaaaaaccaaatgtaaactgtagagttaaaggactgtaaatgaaattaagatgtcagttaatgggtttagcagtacattagtaataagtagaaaacaaatgttcagaatgaaatatggaaataaaaatggtctggacatacattatagagtgagtcttagggattctgtggaaaggtctaaccaacatgtaattgaaatcctagtaggaaaggaaggaggagtgctgcagaagcagtatttggagtgatgatagctgagaattgttcataacaggcaaaagccatctcatcacagatttaaaaaatactaccagaaatctaagataaggagaacattttaatagtaaccagaggccaggtgcggtggctcactcctgtgatcccagctctttgggagactgaggcggatggatcacttgaggccagaagtttgagatcagcctagccaatgtggcaaaaccccatctctactaaaaatacaaaaattagctgggcatgatggttcatgcctgtaatcccagccacttgggaggctgaggtgggcagatcagttgaggccgggagttcgagaccagcctggctgacatggtgaaaccctgtctctactaaaaatacaaaaattagccgggcgtggtggtgcacgcctgtaattccagccacttgggaggctgaggcacgagaattgcttgaacccagaaggcagatattgcagtgagccaagatcccaccaaagtactccagcctaggtgagagtgagactctatctccaaaaaaaaaaaaaaaaagtaaccagagaaaaactacgtactacattgaaaagagcagtgagattgacagctaatttctcaatagatgtaatagtgcatccttctcagaaggcaatgaactaatgttttaaaaatgtaaaaaagaaggtaaacagccaaactagaatgttatacccttcaaaagtgaggacaaaattatcacttctttagatcaacaaaaatgagaaggatttaaaagaaaaagccaaaaccccaattctctttcttctacactcacaaaacttctcataccaaatgtgtagggtttttttcataccaaccaattctccagttctctgtggactccgggtattctgcaatttaactcaatttggatactaactgcctggaattacttgcttcacaggttgagagcttggcctcacaagattgcttagaaaccaattgcaagtccaggtctccgatatttcttaccgactgctatgaagtgattcctataaccccctcctcagattcagtgatttgctagaatggctcacaaaacagggaaacatttacctaggtttacctgttgattatacagaatacaattcaggaacagctaaaagagagatgcatagggcagggtatggggaggaactcagaacttgcacaccctctccaggtgagtcaccctcccagctcccctatgtgttcaccatcccggaagctgtctggactctgttgtttgggtttttatggaggctctattacgaaggcatgattgatcaaatcattggccattggccgttggttattgaactcagtctctaacctctctcccttcccaggaggtggtggggtggggagcagagtgacaggggatgaaagtctgaatcctctaatcacatgattggttgctttggtaaccagtcgccattctcccgagagtcctctcatcataaactcaggtatgtctgctcttcttactaccgtgtttcagggctcaatgccaggaacttgaaatgaagaccaaatatatgtttcttattatatcacagtatcacagagttaattacaccagacctgcactaaagggaataatagaaagattggtctttggcagaagagaaatgatcctgcatggcagctttaagatgcgtggaaaagtgaagaccaaagaaaggagaaataagatggtaaatgtaaatgaacactgttgggtaaaataattatttgtggtttaaaatacacatagaatttaaaaatatagtagtagcatataagttgtgggggtgttaaataaaagttaatatcttacggtcttttcattgcccaggaagtggtaaaaatattaatttacttgagactttgataagtcaaggacacatgttgtaatctctaagatagtcattaaaagagtagtaaaatatatgtaattaacaaattaatagaggggaaatatggaatagtaacagcagtagtagtagtaaaacttgattaatctgaaagaaggcaagacgaccaaaaacagaaacagagcatgtgggaaaaataggaagtgaacagtaagttgttagatttaaacttagtctatcagtaattatattaaataaaaatgaaccaaaatttctaattaaaaagcaaagattgggaaattggataaaaaatcaaagcagatcacaactctgtaccgctttcaaggatgtagaaaagttgaaaataaaatggtagaaaagccatattactcaaacattaaaagaaaactggtgtacctttattaacaaagtgggctttagggtagaaataattgcttgggataaagacatacataatggtaaaatactcaattcagttctccaggaagttacaacagttctacctctgtatgtacctaaaaacactatctcaaaatacataaagcaagaattaacaaaaatgacaaagaacagacaaatctgcaattcatagtggaaagttttaatataccgtcttcattaactcagaaacaaagtatcagtaaggacatagaagatttccataacataatgaacaaacttgacctaattgaaatctcagtgggtttatgtgtaatctagacgtactactgtcctgtgcttcataacgatgtttcagtcaacaagggactgactaaatatatgatgctggtctcataagattttattggaactggaaaattcctgtctcgtagggatgtcatagtgtcatagtgtaacacattactgtttctatgtttatatgtgtttagatacagatacctatcgtgtcacagttgcttgcaatattcagtacaataatacgcagattcatagcccaggggcaataggatataccatatggcttaggaatgtggaaggttgtactatctaggtttttgtaagtacatctttgtgtaagtacgtttgtgtaagtacattgtcatctttgcacaatgatgaaatagcctagtgatgcatttctcagaatgtatccctgttgttaagcaacaaaagactgttgaaaataagatacattcaaaatgaaatatggaatataatgaaatatgaaatacaacactgcacccaataactgtagactgtacattcttttcatatgcatagggaacattgatcaaaattgttgatttatagagtaaatctcaacagatttcgaaagactaaattcagaatatcatacttacaaagacaggtttaatatttgaaaaattgatcagtataaatcactaaattaatagagtagagcagaaaaatcatgtgataatgtcagaggtgcaaaaattgcctttggcaaaatccaatacccattcaaaatggaatctcttaatacattatgaatgaaagttaacttccttaatttgataaagattactcagaaaaatcctatagcaaacaccatgtttactggtgaaatgttggaagttttcttttgagacagggaaagagaagttgttttcactgtcaccaattctgtttattattttactggaagtcctacctagttgagtatggcaagaaaaatagtacagggatgagaaagggaagaataaaactgtgattttgtagatgacatgattgtatatgtagaaaattaaaaaaaacctctttataacttattataaataataagctaggttgcaagattcaaggtaattctggacacaattgcaattttatatgccaacaacaaacacaaattccaaatttgtatcaatctggatccaatcaggagagagaaaccagttgtattagtttgtcctcatagggctataaagaaatacccaagactgggtgatttataaagaaaagaggtttaatttgttcatggttccacaggcggttcaggaagcatggtgccggcatctgcttggattctgggggaggcctcaggaaacttacaatcatggcagaaggagaaggggaagcaggcttgtcttacatcgccagagcaggagcaagagagagagagaggaggggaggtgctacacacttttaaacagtcggatctcctgagaactcaatcatgagaacagtaccaaagggacggtgctaagccattcgtgaaggtgcacccccatgatccagtcacctcccaccaggccccacctccagcactggagattacagtgtggacatgagatttgggtgtggacacagattcaaacttcatcaccagtaaattgaaagcagcgtttaatgtggataattactaattataacagggaatcgaagtaaggagggatttggttaggctagtgaaaagtgaagagaattgtaaagaatatgaaaatagcagataaacagagcaactgctgcccctggggctgaggtagagtctgcaaggaagagtctctccttcccccaggaccaagatccagacctcatccagagagggcatggctggtttactgcatggccaagaagttgctggcatgtcatactagtggaacttaatggaaatccaccctctgatacctgccagaagttgctcactagggcgccacacaaaagctcttcatggggaggtgtctcactggaggtaccctgctacaaaacctccagagtgggatgctggggggagctgctggctgctgggtatggcctgctgttgtgtgctgtagtctctggaggctggagcagctgcaggtgcttgtagagatgggtactggagaagccacctgcgttgcaggagctggacgccatacaattaacacaatgtagagcaatctggaaggctgtatatatcaagatggccaagatggaaccagtgtttttttttttttttctctgtgacagatagaattatgatgcttccccctgccgcttttttttttttttggtattcattcagcatttatttaatgaatgttgagtattttctctattccagacaatgtgtttgttacgagatacataacagcagacaaaatagacattgaacttgtttttgcagtttataggctgataggacagtcagtcattcatctgagctcttttgtgccaggcactattctagtcactggggggatagatggatagattaaatagattggttagatagatgggatggatgtatggatagatagatggatcaagataaaatcttgctttcaaagggagacagccattgagcagataattaattataagaatgggtacatacttacacagtgctataaagggtgtaagaaggaaaaatacaggctgctacaagagaggacaatgtaattcagatgagaagccagggcagacttctcttagaaagtgatatttttatgatgaaagtgatgaggaggaggttagcttggtgagatgagtgatcagagaagaatgatctagatggaggggaggcttgcgggcagacttcatgatgggaagagctcggcatgtctgaagtgaggagtgggaggtctctagagggtagggggaggtagagagtggcaggagaagaggccacagcaggggtcatgctactcacagccataggccaccttggaaactagggtgtccctgtgaagggttgcccgtgatagaggtctgaaataggagattcttggactgttttgctatttacagccaccgtgtggggtgctgagtggtcaggggattggaggcaagaatggaagttgagagaccactgggtgcaatttgcaggaatccagtgaaagttaacggtggaggtggcgccaaggcccagcagtggagctggagataactggatggcttggagatggggtttggaaatagagtcattcagaactggtgatggattgagtgtgggctgggagagacagggagacattgagaataactcccaggtttctggcttaagtcattacatggcatgtgatgccattttctgtgtacttttgtagtgaatacgaattacttgttcaattaaaaaagtaaaataagtttggatttgcagatgaagaaggctttggtgaccaaacaaacaaaaccaaagcagttgcagtgaaagtgaagaggtggagatagttgctacagactactgcagttctgcatcttcaaagaagccagaaagtagcaggcaaggtagggtcgggctgtaggacaaggacatgtgttttgtttacagagtaggatagatgtgagcaactttcattgggagagagagctagaccatagagggaagagaaggcattcgttaactcaacaaatatttgaatgtctgtatgacaggcaatactctaagctcttggaacatacaaaacataaaaaacattcctgtcttctggagcttaatgttctaaagtggggacactgaaaatcaaatcatgtgccgagtgcactgtaaaaagaaaaaaaaagcctattaatggggagatctagggatgttgaggtgggacggccagaaggatgtaattttatgttgtgggtggcactgatggatttgatgccactagaatgcaagatatgccagggcagagattttagttttactcactgctgcatctccagtttagaatggtgcctggcacatagtaaatgctcaataaagaattgctgtgcgaatgaattaatgattcaggatcccaggaatgggaaggaatgaggagtgggatactgaagaaagaaagataggccagtcataaatgaagacatattgtagggatgttagtactgatatctccaattcaaattacagttgtttttgcttttaaaggattttaactgttcaattgtattttgaattctttgaattagctttgtttcatggcattcattttgtttactgtatgtttcttagacacagtaatatagtttacagaactacttatccttagggacattacccacttaagaagtgactgttttcagtattattacaataaaattgagattacatatcactttgtatattgaggttctgttacaacctgtcttttcagcattatccttaaagtggtgtgtgtggtggtggtggtggtggtggtggtggtgtgtgtgtgtgtgttggggggggggtgttgtgattgttttatgcccattacagaaaccagtttagccggcattatactggtgtggttatatattaaataagttaaatttcttgcagctactcttttgatcagttaattggtctgatcctatagtgggtattttcatgggtctctgctaagtttagcctcacaatgattttgtgtgtctgaaatcgtattgacaggctgtagctccttctaatttatgcatgcgtgaagaagattgtcctctatttgctgagtcttatgcttttatatgaggaccccagtgtcgtaactttgccataactcaggaagatctaacttctgactgtgcagtatagagcattcctttgtctaaaaaaataatatggatgttttaagaccattcagtcataactggaagctgccttatagttaaaggactttacatattaatgaagaaagggaacatacaaatcattatgtcctttttgccatagattgctgtcccctcccatagaaattatcttattatattttattacaacagtgtatgtaaaatatatacttataaaagtaataaatggtctttgaaaaattctaataacaggagtgtagagattataaactgattttatcctaaaattgtacatcctaggagataaccattgtgagcaatttgatttatatccttttttggactttacaaatgcttgtgtaaatcgcgtgtgtgttgtatgtatatatgtttgagtgtacatacaagaggaatcatatacagcttccctgttttttcctccccatttatacaccatgttgtggacatttttgtgtcagtgcctgtgtgtgggtatgtgtgtgcataaagacatagcacgggtatgccataaaaagttttcagccaatcccttattggttgtcgtcatattttgctcttacaataagtgatgcacttaacatctccagttatgttctaggacagaagtgcttgtcagagtgtaaatatttgacatatgcccttagaaatgttgtaccaggccaggtgcagtggccactcctgtaattccagcagtttgaaaggtctgggcagaaggatcacttgagcccaggagttcaagaccagcctgggcaacatagggagacctggctttacacaaaataaacaaaattagctgggcatggttgtgcgttcctgtggtcccagctgctcgggaagctaaggtgggaggatcacttgagcccaggaagtcgaggctgcagtgagctgtgatcgtgcgagtgcaccccagcctgtgcaacagagtaagtccgtgtctcaaaaaaaagaaaagaaaagaaatgttgtagaataccaatttggactctcattagctaaaagtgagagcatccatttccccaaacccttaccaatggtaagtgttgtcagtcttttaaatcctttctcagcccaacaggtagaagactcagatctccttttaatttacatttctttgtatattcctgcaatttagcatggtttgaccatttatgctatttttttggatatgttactttttataatagtcttcagtctttttttctagtaggttcttcgttctttttctttctgatttctgtttttcttttaaaagaagtatgtataatatttctccctttagtcatctgtatttcagtcttagttttcttaactcattatgtcctcatgccaatcctatgagtcatgctcccaaactctgaatctttttggccttgatggcatgtgtacttggtctttcccacaccagtaattaagtattctccctagattttcttctttgttttgaatttttatccttagatgtttaatatagctgaactttttttatatgtgaatgggatgagttagagctctaatttcatttttctccaaataagatggttattattgagtcattgatcattttctactgatttgagatgttgccattaccatgtgctaagtttccacaaatatgtggttttttacctgaactccttgttcattgatctgtttattctgtgcctacaaaattaccacattgttttttctttccttatacactgatttagtttttgtcattctaacatattgtaaagaggaaagtattgctcctattctgttcttaaaggtctatcagggccgggcgcaatgactcacacccgtaatctcagcactttgggaagtcgaggtgggcggattacttggaggtcaggagttcaagaccagcctggccaacatggtgaaaccccatctctactaaaaatacaaaaaattagcctggcgtggtggtgcatgcctgtaatcccagctacttgggaggctgaggtgggagaactgcttgaacccgggaggcagaagttgtagtgaccccagattgtgtcattgccctccagcctgggtgacagagtgagactccatctcaaaaaaacaaaacaaaaaaaccaaaaaactgtcagaagtggagtgtgacttacttttttttttttttttttgggtcagagtcttgccctgtcacccaggctggagtgcagtggtgtaatctcaactcactgcaacctccacctcccgggttcaagtgattctcgtggctcagcctcccaagtagcaggcacatgccaccacgcccggctaatttttgtgttgttggtagagatggggtttcacctcgttgtccaggctgttcttgaactcctgacctcaagcgatccgcccgccttggcctcccaaagttctgggattacaggcatgagccactgcgcctggccatggagtgtgactttacagtagagattcatttgtctaacatctctgttactggtttcagtaagatcacatcatcttttttgtcctttggcagcagaagttgtaggttaacgaaaactaaagcaacttttcttgtcactgagatggaattgaaatgatctctaacccatacttcttcagccatgacttctcacatcttagaacacattaaaaataagaatatttgtaggacgtactggagaatgaatgagtatccttgaggtcagaaaccactggtcaggggttagcgtggcttagttcccctcacaaggcacgtgtaacccatttacattgaactgcatgtcagtagggaagtgtttaggaagtgctgctgtaggctaatgttcttcaactttaaaattttctcatgacacgtcattgtagcttgatatggattggccaaactgctttaaaaaatttttaattgtggtaaaatatacatatataaaatttgttgtcttaaccatttaaacattcacattgctgtgcaaccatcagcaccatccatctccagaactcttctcatcttgtaaaaccgaaactctgtacccagtcaacagtaactccccattctccctacccctcgcccccggcaaccacccttttactgtctgtctgtatgaatttgactattctaagtacctcataaagtgaagtcatatagtatttgtcttttttttttttttttgagacggagtcttactctgtcacccaggctggagtgcagtggtgcaatcttggctcactgcaacccctgcctcccgggttcaagctattctcctgcctcagcctcctgagtagctgggattacaggcttctgccacaatgcctggctactttttatatttttagtagagacaggatttcaccatgttggccatggttggccaggctggtctcaaactcctgacttcaggtgttccacctgcctcggcctcccaaagtgctaggattgcaggcgtgagccaccacgcccagcctagtatttgtctttttttgtgactggtctatttcatttagccttatatcatcaaggttcgtccatgttggagcatgtgttagcctttcctgccctttaaaggctgaattcgttatgtgcacaccacattttgttgatttgttcatccatccatgggtgcatgggttgtttcagcctttgggtattttgaataatgccatgaacataggtgtaaaatctgagagccagacgtcttgaaagagttttgttttttttctttcattttttaactattccaatttgaatttagcttccattattccgccaaaccttctttcttagatcactattaagtagaaggaacatttttcctttttaatgatttttcagacatactcacccactttggctgtgccatcctcccttggctcttgggatggtgcatgccccctgtttctctcccacttaggagatttcctttgtgaccctcctctcgcatcatttaaaggtggaatttccccagagcttgaccctgggccttctgtctgtgaccattaaatgtgggtatttctcagcaattagagcgaggctcttttcttttcccttgttttggaaagaagagagtcaaaaaagcttaatcaaataatctcatcttttacccaaaaaagataactattttcttcgggaaaaaaggtgacaagaatataaatcatcagaattacactaatttgtttctgaaggaaatgataaactttcccccagctttgttgaggtataattgacaagtaaaaggtgtatatgttcaaagtatacaatgtaatttgatgtgtgtgtacattgtgtaatgattagcacaatcaaccagcacgtccctcactatacggtgttttactgtgtgtgtatggtggaggagaggagtgaggacacttaagatctgcttattaatttgcttagcaaatttcaaataaacaatacagtattattagctgtagtcaccgtgctgtacattacagccccagaaaatattcatcttataaccaaaagtttataccctttgaccaccatctccccattccctccccaacccctgtgagttcaggcccttctctatattccttcttattctaggtgacccccatctgcttacagagatccaatctgctgatggctcctaggtttgtttcatgaggtcagagctctttgctgagccccactccagagctgcctccttgctgtctatgctgagtgtctgatgggtgctccagcctcatgtctgagatagagcttcatgattttcctcccacgtccccttccgtgttctcagtgaagggtacttgagcctcccaggcgatcaagtcaaatttcagggatcagttttaaagtaaactttttaatttaggatagtttcagagttatagaaatgtctgaagaatattaaggagagttcctgtgcactccacacctgtttcccctgctaacattactgtggtacatgtttcacaccagtgaaccagtaccaacacattatttacactgaactctacacttcattcagatttccttaattttcccctaaagtcttgttctttttcagaatcccattcaggatgccacgttacatctagttgtcatatatcttcttaggctccattagactgacagtttgttagatttcttcttgtttttgttgaccttgacagactaagtattttatacagtgttcttcaatttggatttgtctactgtttttctcgtgattagacttggataatgggttttggggaaggaagaccacagcggcaaagtaccattctcatcacatcatatcaagggtacctgctctcaacatgatttactactgatgatattaaccttgatcacctggctgaggtagtgtttgttagatttcttcactgtaaaattactgacatttttgacactttcctcttctttttatctgttttgaatccaaaacaattcctgctggttctttttcccaaataaatttccattctgtccaagtcactctttgcagccactgctgcagtccaagccacaattgcctgtgcgcagacggtattgagcgatcttctgactcatgccctgcttgtgcccttgccttctccagcccagtctccacccagatgccaatgtggtccttttcaaatgccagttggtcagtggtactcttgttcccaagcctttgagcggcttcttgttgtacttgagataccaccccaccttctagacacagtctgccaggcctgcttaagctcgtctcttgtcacctctctcatctcctgccaagcccctctcgccttgtcctctgttccagccaccggtttcttgcccgagtcccttcaacactctcagctcccttagacatgtcgttgcctctgcttagaatgatggtcgccctccaccttggttcccttgggaccccagcttacatgccatttacatgttgtttcttcaggggacatttcccatccacttgcagggtccatggggcactcttgctgggtgtttctggagcatgccacactgtacccctgatgctgggagttacttgttctatgtcggaattgttcctcagtgctggggtggacaaggctgagacgtgcctcggcatgtcactgtgtgtccctgttacctgtactgagcctgtgccagagtggatgcttgataagtatttgttgactgggtgaaattttttaaaaattaaaacatttttaatagaaatggggtctcactatgtggcccaggctggtctgaaacttctgggctcaagcagtcttccctccttggcctcccaaagtgctagaattacaggtgtgagccaccgtgcccagcctgaatgggtggattttatcttttgaatggaaaacactcttcatttttagcatgccagtatgcaaaaaagtacttgaatttatttttcttagtccattgatttaaatcccacatgtattcttttaaatctgtcacataaggtgctgtggtgggtacagtagtggatctagaaagtgtgttcagcctctgccactcctgagggcccattcattcattctctcattcaccagacagttactgggaacctgggtctgccaggcctagtgcagagtgtggggttatgagggcttgtgagtgagcctgttgagggagagggagaaacttatagatccttcagcatttccagttgtggttaggatagatttgggcggatttagtttgaattctggctctaccatttttaagatctgcactcttgagcttaacctctacccgtctgcaaaaatgtgggcagcattgtctcccttgtaagttgtggaaagaatcagctaagaaaaggaatgtaagaggatcagtataatcatagtaatcacagaactaatggtttttgcctttgaggtcctgagtactagcctaagtagttacattaattatttttgtttattctcacagcaactctgtgaggtagggatgttactgttctcatgttgtaaatgaagaaagtgagaccttagttgaaaaattaaatactttgtccaaggcacagaagtagtaagtgggagagctataacctgaacccaggttcaaggacggcgtgattttaaagcccagaaaggactccttacattctgtgtagctaccccatcttccagtgtggctttattctttaaagttgtaaagactttttaggtatcttggcatttaaaaaaatgtaatagtctttagagggacgattaccttaagctattatcaacttgaatttgtttctttattcacattttagcagctttgacatctgtgacttggtgcctgtgttgaggagagagggtatatgttgggactggaggatgaagtttgaagttagacccatctgggcagtatttatcttaaagtgagaattgtgaacttgtaatcagactcacctggaagatttatcaaaaacgtaaattccttaaccacttctttggtaccccacattataatctcttaggggtaggacttagaaaacatttttgcaagtgatgttatttagatagtggattctttttcattctgaagtttgagaatcagtgaatagagggaatgggaaatgtcaactccttgatgatccagactgccctacaggaagccagtggaaagatgaaagtgaaccctggtatgcctggctagtaagtttaaaaacaagtaatgtggaaataaaatcaacagtcggtgaatttgtctccctgttgttttactttttatattatttgtgtttgggaggaatttgatttgtattttatgatcatttttccctagtgggtagtggggtagcacgagaaatgagtgggtctagactatgatagagttggtgcaatgcagcaggccaatcggaagaaaaaaatttaagcatattttgtggattagcatgtcagttgcaaaaataggagtatatctaaagctgatttcagatagtctctttttagcgaaactatgtcagactgtgcccggacttttgctttggaaaatatggtaatttcaggtttgtggctaatttgaaaattagtaatcaatactaagggttttaaatatgtagcatttatgtgtttattatgtatttctatattcataaacattgaggattcttttattgtctcatgtaacaagaagacaagcagctcagggatggcggctcccgtgtgcttctccatgatctctcagcttcctttgtgtggatggccacagcatggctgcgtgcctaaagcacgcggagagggcagcattcttgtctcaggctccccacccaccattcttaagcagctttgttgaggtataattggcatactaagttgtgcattgtcttgtacattttgcaagtgtgcatctgtatacaccgcacaaccattaccatactatgataatgagcatgttatcactctccaaagtttcctggtgccttttgcgattccttctgcccacccttctcctccttttgtgaaagctttgatgtttttagggaaaaaaaaagttacattattgaggataaaatactaggtagaaagatatttaacttgtagttttcgctttttttttctttttgaggagtattgtggaaataatatgattgtaggtataggttgctgtaatatttatagaaagttttgagaaacagattctctgaacagaccatcttggaagagtttgacaggaaatatattttcggaaaggctggaatagaggtggagatggtgcctgctggcaggagagggagagaaagggaggacagcacctgccggccacttgcgggtgagctacagacatgaaagccaaaggctgcgcttttctttggtttttcaatagatggcatttttatcatgctagaaagactaacatgaattctaacatgaaatggtaataaaaatgtaatccccactaactgtagtgtatacatagctcaagtgcatttttttgttgttgaatggcatgctggtgattgatttatttatatttatagattaaaaataataaactttgctctcattgtaatcacctctttttttttcttttttttccctcccccagagactgggtcttgctctgtcacccaggctggaatgcagcgagtggcacagtctcagctcactgctgcctccacctcctgggcttgtgttccttctgcctcagcctcctaagtagctgggactgcaggcatgtaccaccacacccagctaatgttaattttttgtggagatgggatctccctatattgcccggctagtctcaaacttctgggctcaagtgatcctcctgcctttgctttccaaagtggtgggattataggcgtgagccacagaagcgtgcctggcctgggtagttctttttaattgttgaatatacttgctgaggttagtttctgctgcagaaagcattatataatgttgagttaacagcgatcttgtaaagagttagtagaatgtgtaaagttttacctgggaggcggaggcagcagtgagccaagatcttgctactgcactctagcctgggtgacagagcgagactcttttttttttttttttaaaaacaaaacaaaacaaaacaaaacaaaacaaaaaacgactgtatagggttaaaaaacgactgtatagggttttattttaatgggtttcttcagctgtctccttttagcttctatgactctgcattttcttggctctttgtttttcatttctttacagttcttccatgtattttgttttgaaagtaatatgcctgaggtgaaaatggcggcatttctgtcatgatttaaccttactagaaatgacattctttgttctttgtctgtttagttgagaagtgaaccaattccctgtgcttaaagtactactccttggtgtggggcagggagggaggggggaagatttttaacatagaatacaaattgagtttgttggaaaaggtatccctataaaatgttgtccaggtagttagagcttaatatgggtgataatttccctagaagaatattctttgctgtaacactgatgacttgatggacttgtgaaagtgaaacttggtgtgtttcttctttcagcctccatgtaactcacagatagggcagtgtagagtagatttccagttttagattaaggatagcttgtatcctatgcaaggttttgggggttggttagggtctttgagtatttcctgtctaattcacttactagttacaaagagacaagctgtaatgtaaaaagtcttccttgagctagactagctttctgtactctttgatttaaaaatacctggtagttctgccagttggggatttgtttggggtgaatgaaaacccctcaggctcagtctgttcatgcactggtgtgtattaattcagtccattcatagtcatgagctgactgtgccttattgaagaaagggaggcttctggaagagagaggaagatggataatcttggatcctgaagcactgctgctggcgcctgggagtggggcaggaagacaggaggttctgaagagagggctttgtatccaaagttaagacttaggccagcccttgatggggagagaagctactcaggcccaataacctcaaatagttcaggttaaatcgacagttgtcaagtctaattcctctttacagcattatttctgtgggaaaatgtgtgtggcttatatacttgcctcagcaaacagaccggactcagaatcagctctttgttgtcataatttaagtggaattagttactccctagggttgcattgccccttggatggcttctagccttctttttacttattaaattatattccaggttccttgactgtgagggacatagtaaactcctagtagcctttaccttcccctccctaaatagcaaactcatgtagaaaacattagctaaaatcctttgcagatttttttgaaatcacctaaaatgttgttattggcaccatttcatttggagccattttgtcagaaccactaagtatttaggtgaggcgattgatttcattcccacgtgggaatttggttggttgtaatattcaggcactcagagcaattcctgcctggacgtcacgttcaggtagtctggtgtctgaaacttttggcagagattaagctgatagaagatttgggctaacattttttagtgtgtgagttggtgaattttcaagatgatttagaagactttaaaaaagcatctgtgaatactgcatcatcttgatgtcaagaagagattgttatttaatacatacatgttttagtaatgaaggaggtacatagagataattgatttgaaccggtttactttttcccctttttaatgcaaaatatttttgggaaacagaacttgactcgtgttacactactcgcttcttgttttttgttacaaacatgctgaaatggtctaaataatgatgctactaaaacaacgtatgcattgttttcatggggtgttgattccttctgcagtgttcaaaattacttgcatgcctccgagcaacaaacacatatgtgacagactttatgtgagatgagcattccagagaaatgaaatgcaagtttacttttcagtagctatgcaacttaaaaaaaaaacattgtgttttttgaaacatggctttagggcactaacactcggaccgagtgcatgagctctgcaagttattttaacaaaacctaatcacaggaacaaacatctggcatttatagagtttgtttatttattgattgccgtaagcctctagaaagaatattctgtttcttttaataaaatccttttggaagttgtctatattttaatatctaagtgtttttggaatttagttttaacaaggttaactcaaatgttaaatttattgtgggctacagctgaagtaggagaatgtaagaagaaatggcaagtgggaactcttgtaaaaagaatggtaactaagttctttttcctggttatgctcctgccatttactcttctgtatggcaggccatcatttacactgctttgtagaatctgctgtctagtaagcactaaggaatttggatccctaaaccagggagcatatagcctgctaaagcttaatttttagacaggagacactaaagatgattgtgttatgatactgttcattttatatactagtgaaatgaatactgaaattatttagtataaccattaattatagtgcttaccattactgcaaagtttgtcatgatttgggtggtagcttcatgtttcaaaacaaaaccataggtctatccttttaaaaaacataaactgctttagtttgttaatgggaaaagtgagtaaataataacacttattgatgaaatgaagcctgtcagatacaggaaaaacaaaacaaaaaacccttgtagatattcctcgtgtcaagcccctattaattctgtgtaattccagtagaactagcaagttattttgcttaaaatgtcttttttttcccctgtgcagtgaaagttgaatgtgagaccacatcttaatagatatagttacacggtttattttatcatgtatcactttattgctgtcttctagaacattgttatactaaatgttccaataatggaaattttatgcagctacttcaaatgaaacaaatttgcaaaaactcaattttggaactcattccttgaggagaggaaaaactcaccatgctgtgaccacattagatttctgatatgttggcaacttatcaaacactgtcatttccagaaaacaggttatggggtcaaattgaaatatcagcacttttggtcactttcagttgaagatattttaggttttaatgattgaatggttaaattaaaaaaaaattgttggtaacaggtaatgaaagtgtggttttgtatgtaaataaaaatggctctacacgacatcaggaatgatggggttcagttacagtggaatcttttcaagagcttgattttaaattctcagagatactagttttacttactggagctcctttgttttgcagagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtaacacgctgatttcctcaaatagagatacccctttgagtgataaatttgcaaaatgctgtcttcattttctgtattaaaattcatttcagttttaaaataaagtgtaatctgtgttttcatccttttaa

SEQ ID NO: 2383 - DNA, 102879 bp, Homo sapiens
ggacgctcctcccggagagtagtgagacccctggtgcggggcgattggcggcgggagcgatgagtggcagccgcacggcccaacgggagctgtgcgtgggccgcggggcggggccagggcgggtgcgcggcggcggcggggtggctgggccggcggcggcggcggtacgaggcgcgcgctcggggtcccggtcgcgaggaggaggaggatgtggcgcgcggaggggaaatggctgccgaaaacaagccggaaggtaagagccggagcgcgaggggctggggggcggcgcggcgggcggcgggacccggccccgccggacatcccgggcatcggcggcgccgggcgggagcgcgggggcgcggcgggcgggcgggcgggcgacccggccggggagggggccggcggggtgggggggcggagcgcggccgagtcctgaggtgactcgcggggccggcggagcgcggcgccccacaccccacccccgggggcgggctggggccggagggggcggggggctcgcggggcggggaccgggcccagcgaggaggaggagccggcggagggccggcgcctcccccacccggaccgggcatccccgccgctcccgagcccgctgcgcggcccccgcacccccggcgctgggtccacggtgggggccgcggggcggaaagtttatccgcctcgggtcctcctggccccgcgccccactgctccgggccggtccccgtcgggcggcagcggccggcgctcagccctcgccggccccctgctctccggcgggcagggccagatgtactctctccggcaccctcttcagccccgtggacacctccctgagcgggcggggggtccccgagcttctccccgccagggggaccccgtcctgccgagcgtccctcggccgaagggcctcgtgtgacccctcccccttcgcttcccgggaagggaagggggcctgcgcagcatccccgcccctcgcagtcgttcacatcctactcttgcccttgcaccctcacagccaggagggtggggtctccgtttctatggcaagtgaggatctccacactcccttgccctttaccttccgtgaccccgatccttccttggcacaggggtccgtctgatctgctcatcttctttggattcttttggggcctctgcacactctccgttgaccctttttgccaggacaaggggactcaggctgcccatgttcttctttcctcacccagtggatagtgggggcttgtgcagctctgaagtcatttctaaataggaaagcagacacttcttccagatcatgcatactcttacactttgctgggttagggcgagctcatttcctaaataccctttgagttgccctccttttcttatggagacaactggacgttcaccgtgctcctttcgccatttgtgtgtctacactgacttgttctctcttctcggagttccttgtctgggtgagagtgggcgccccaataagatgtagggcagggcttccattgtgcctagtgcttgagtgaaaaggggccacactagttgctcctgtgtctgaggaagaccggggtatatttttgcctccacttgactcttgtgtctcaggagggggcaaccttcatcagttgacactacctcactgggaaaagggtcatgtggccttgttttttgatgttttgattactgtcttctgtgcagtgagaaccagactttgtccgtcccacactcaagagtccttgaacctttcctggatataaacttcccgattgttttttgagagaactcatatcctcctctgtggcttctgcttcgcagtcagccatatttagtgagcctgttactttgactttttctaattttctcaaattgtattcatgttggctgggtaaggagaagccatatgcctttccattcagaaaagggagtgtagacacccgtgtcgcccacatgccatcctggaagaggttgcttgtgtgctccttgttgtactagaaccttcctttggctctggtgttgtctcttgtgggatccagacatttctttagatcttgtagctttcagaagggggaatttgaatgctttctgttttttgctgttccggttctgctttggagaaccagatcatgatgctatattcatttgtttacatatacatacatgtaggtatacacagatgaaatcacattcattacatatacagtgcacaggaagttggaagggtcagatgactagctctacattttgggtgcatatggggacctttatgtgtaatgatacagatagatattaacgttgttggtaactcttcaggcttagaagcagcagcagaagaatcacggataaatggccaattctgactattctttggtttgtaatgtgtactgtactgaataagcagaacgacatcctgcgtgttcaccaagtccctgaatgtgcgaagcgtacagtgcctgcccatacgcatcgcaactttggcggtctgaatttaggggtggtattcgttgcttgattctgcatagagtgaaaagttcttgatttctttactgcagtgtaggggaaagagatttcgtgtgtttggacaaacgacaggagatgggtgagaagaatatgttttcctgtgacagaactaggaacgaatgaccgtaaatatgtcccttttgtattttggccatttaaataattgagagaggttgtgaaattagcaaaatgtacctgtggaaaggccctcgacgcttcatgagaggatggggaacgttattcttcaagttcttttctcttggacaggggaatgatttgagccctgtcggctctagtcaggtgctttgcctcctcaggtctccctccctccctccctccctccctttctccctctttcacgaaattcagaatggctgctagccgctgtcactcagcagggaagtcttactctttgacaggcttagtgtggagactcatcctccccaacaagttccgttgggctctggggctttggcctttaaaactgttctagctcagaggctcgctttgcctcagtttactgtgtaaggagaagtggctcatcggagattgggtcagcgctagttctgtgacttctggactttgcctttcagttagcattgagtcgtccagtgggcctgattcccaatgtcagaaagtagagcttttgagctcattttcttgtttttggttttaaatgtttttatgctgttcgtattctgtgtctgtagtcagcttgatgggattgtgtatttttagggggtgttattagggaacttcggaaaaacgaagagtcgaatacctgctgtagatggtgtagactcagcggagtcatcccgtttccagtggtggttcttcctaccgtttcctccatggccccatggagactttgggagttttccctggtaagcagggggctccgtgcaaggcgcagtggaaggaaaagtggtaaagattggttggaagaagacacttgaggttattgtctgaagctgggccctttttcttgagtttgatgtggttgtgtttctgtgtcactggtcgccacagatgattggaaattagctttttccttttaccttgtagtgcagaatgctctgttgcagttgggcagactagacgggttctctgaaccacatagtttaatctttctgttcgactttctgttaggacatgactctttcctctccttcaccccttacctccagtttttgggactaggttgggtgacctcttcctcctttgtcttcttggaaaccttacttatcctgcttctgcaaatgttgggtttctccatctcatcattgagtggattcaaagtgttgacatacacagagcaacctctactcaaggtcagattgggtcagcttttccttttcaaaagagtagtgttgctcttacttgctctttgagacatatttatgcatcctgctcagctgtgttttctgtttccttagtttttaggctctggcgattttaggctttcccccagaaatagcctattctttagagagtagtgtttagtttagtctcctgtttatgctggatgtccgcccatgtgtcctgctcggtttttaattctttgtgactgattttgaggtagcccatctcaaaatcttaacgtttttttccccactgtttcattactttgagccattcttcctttcctgtttgggggaaatacccctttgtgtgcagttgtacttctttctcctttccttatggaaaaagcagtagaaggtgattctcttattttcttctgttcccctcatagttgtgtcagttgactcttttgtggaacctttgaatttgcccttctggggagaagtcgtttttgtatttatactcccatgactggagtcattcattcaggagacctttaccgagcttctgttatgtacaaggagctgtagggggtgatgtgactttgcttgagaccatattggatcttgttagccttttatattaatgacattttagtgtatcttttttttttttttttttttttttgagacagagtctcactctattgcccaggctggagtgcagtggcacgatctcggttcgtgcaacctctgccttccaggttcaagcaattctcttgcctcagcctcccaagtagctgggattacaggcgtgcaccaccatgtccggctaatttttttttgcatttttaatagagacggggtttcaccatgttggtcaggttggtcttgaattcctggcctaaagtgatccgcctacctcagcctcccttgcctcagcctcccaaagtgctgggattacaggcgcaagctgccacgcctggccttcggtgtggtgcttgtcttaatgcttgtcttttatatagtcttgcaaggaattttttttttctgatttttaagtttttggattgttaacttacaaagatatagtgtaatagtgtgctatcttgttgaaccttttttcctcctcagcaggagtgggggtggtgaagagggtgggagggtggactgggagaggcatttagcagctttcccccagactgtgtgcagagtgtgagagagagagagagagagtgtgtgtgtgtgtgtgtgtgtgtgtgtgtgtgtagacaaaagtaaagtcagccttcttaatctgattgtgtaggcataacttttaggttgtttagatacatgattggttggaatgcttatttaatatttgaacggcagcatcgcactaggcattctatagaacatagagtcaaatgtattttttatataaggaagtggtagaaaaatatttttttcttcggattaactggtatggttcatagtagatagtgagaactgtatgagctgctgttacattttcactgccatgaagaattatatccaaatttaatacctaattgatgctcattcttaggctaggcatctgatataattatcacttttattatatgacttttaatttatgctttttaatggtattattatttttgtaaattgcctcaaattctttgtgggtacaggttaggtataaataatgataataataaaaattactaacaatttgaaataccccttttcttttttcctctattaaattagatttaccatctccacaacgtatatagaaaccaattctgctactatttcactcttgtgaaaactcctgtgtgaggtttgtaatatgtggtttggcagtatgagtatgtgactgagtgtattttgtgttgacaagtgatgtgtgtgtttcttttgcatttccattatacagatcttttcctaaggtggtgtgtatcttctagaatcatgtaccctgtcctttttttttttttttttttaaatgttctaggtgacttaaatccgacctccctttcttttcttcggcctttccttttattttttgtcctttcccacatagagaggtttcttcactgacctgtcattattataaaaaagtgtttgttagatgtactgtatttgtagccttttagtaagaaggggatgcccaccatccctttgtcctgtagcacaaggcattgcttcttgtttccctaagaataggtagatggaatgagatttaagccagaaggccgctggtaatagtatttgtaactagatagcatctctagataaaacactgggtcctttctgctctgggcctccccatgtaggattttggaaatttttttttgctgcatttagccagcttctttctgtctctttggcttgatacaataaatttctttaagcacagccaagtatattatttcatttggagccttcatttacaaggaagtatgggggcctctcctaatgttcctttgcctgttatatatagtactgcctttagtttttggtgtgtttgagagtgagagtgagaagcattcttgctctgctactttgtctgtgtaacttgaataagagtgtacggtcattcactctattttccagatagtgtataatctttctttttatttttcttgaatacctaatcaggttcgagctagaggttgatccgactatcatatccttttattttgtgccatccctggatatagtgtcccttagtcctgtgattaagccatgttcctattttgtcattagagagagggacttacaaacatatagatggtctcccatgataattgtcatgcatttataaggaaagtgtttcttttctttttttttttttgaggctgagtcttgctttgttgcccaggcacgatctccgctccctgcaacctccgccttccaggttcaagcgattgtcctgcttcagcctccaaagtagctgggattacaggcgtgcaccaccatgcccggctaattttttttcgtatttttagtagagacggggtttcaccatgttggccaggttggtcttgaattcctggcctcaagtgatccgcccacctaggcctcccaaagtgctgagattacaggcatgagccaatgtgcctggccggaagtgtttccttgtataaattgacaatggagagcagttcacgtgatgggacaaagtaaagggtgagtaaagggtggttttgggtttttttttttttttgccatcagtatgctagctgtatatttctaaggttgtattgcatccttctgctttgaacaccattgcttgtagaaggtcatgggcctcctgtgtaaagattggtactgtttcctgagcatttttttttttacctcattaccctggacttacagagaaatattatgtaccccattgcaaagagaggccaagggtcagccacattatttccccttttgctctttttctggaggattgttcatttacttcgaactgattgacatggcataagatggaatgactagagatttttttttttaaaggttcctccatattcaacctcagtgtttggctctatcctgacatggttgcttgttctcctgtacatgaatccttttgcagttactttcttgtttttgtttttcaaatttagccagggctttcaagtcacgtaacatatcctttcctgagactgtgagccgaaggtaacttcaaggaagatatgcttgtttggggctgtattcatcactctgctctctacggttttgtagttttcatgtgtacaaagtgacatttcttgaaagaaacgtttggggctgtgttcttaatagttttaaacatgttattatgtggagactaagtggcaaaggtctcaccccaacttcatttcttcataccactcatatatatcttatatatatataccccactcttatatatatatataccccactcttatatatatcttatatatatctcccctacctgcaaatcccaaaacaatagtcatagcaacagaaaagcaaaaccttgtgaagcccagctctgattggttctgctgtgcagttcagtcgctagttttggacaggtgcataagcagataatttttggatgtgtaatattctcagtggggctgatgtgtgacttttgggacatagagcattcattcgttcagcagaccatgcagtatctcttccatttttttccccttatcagttaccacaaggtaagattatgtattcagtcacttaaaaacacttgcaaagtggatttttccccatttattcctatctaaccattggaataaatgttgacagtagtaaattaccatgtccctatttttgtgttcaacatgtctaagagaatggggagctaacttccagtaagggcagtacagtcagtcatgactctttctccatgtagcctgtgcattgtgcagtgatgatttatactttcagctaaatttagtgtctatgataagggatacatcagatgtttaagttcacttaatctcttttacagtgtgcattcaacaaggtgtatttgtgtcttatattagaatgaaatgcagatacaaccagaggtattctttcaacgtagagagagagagaaagcctttctttttacaagttttgaaaaaaagttattgtctatttttccttcatggtgcttgatttagattgccaggagtcatttctgaaggtatattaatacaatcaagaattaatgttcttaaaacttaaatttgttttttaatccttttctgaaaagtcatttctgaggatatatgtgccctgttggttttctgggcacttggatatcaaatcatttgggagtgataataagaaattggtacaaagtgtgaaattatcagatagaaagaaaaaagatgttatagtggaaaaaattactcatttatgattaaaaataatctcaaagtgatgactggaagtataaattcagatatttgaagaagaaatggaatgttgatagggttattgtattgaatcaacacatgcacacgtataaagaatgctccccaaaatggggacgcttagaggacaaataagttgattggattggttttaagaaaaatattgtttgtctttttaaaaagtaattgaaataacccttcttagtgaagaaaatgaaaactttgatggaagttcagcagaatggaatatttaaaaagattcaagagaaggatttttttattgcgaatccacaagggggtagtgatgttctttcaaagatatttgtggtggcaacaatgtgagatgatctcttcacattttagatttacagataaaactggcatgtttgcattttaacttaataagatcttctttttaaaatgtttattggcaaaattgtttattgcttaaattaaaaaaaatccattttgggtgaatggctactttaagccatatgaatggtaaagaagagagaatgtccttacagttttgtgctttggagaggtcaccaaggatgtgagggtcactgttattttctaagaatgtaataatcttaaattccctgggaaacattagacatctaggaatcagttacttaagtgtcctgaataaaaggattttagtaaattgtgtctaaactttacagaagtttgtattactagttgtattttcagtgctgccgagagatgaaaaatatgaacaatccatgccactagccacttttaatagttctaagtaaatcaaatttttataatcttttttattagtttatattacatcattagataaaggctttttttttgttttttttgtttttttgtttttttgttttttcttccctcacataaaaattcaggagctttcttctggtcactgagttccaccccatattattcagaattacttaaaatcaggtgtggtaggcctgtgctgggtcattttcagtggaggactgcctagctgtattatgcactcatttttgaaagttatgccgtgtggtgggagaaagatttaaagttggggggcggctgtgtcctacttatttagagacacaactagtcatcacctgtaacaaatgtgacttcttttaaaacttattttatcttacttttttttagagacagggtctcgctctgttgcccagactagagtgcagtagtgcaatccatagctcactgaagccttggcctcctgtgctgaaatgatcctcctgcctcagccccctgagtgactgggactacaggtgtgtgtcaccatggctgcttaggttttttttttctctttttcgtagaggtggggtcttgctgtattgcccaggctggtcttgaactcctggtctcaagcagtccgtctgcctcagcctcccgaagtgctgggatttacaagtgtgagctaccatgccctgcctaaaaaatattatttctaacaataacacaaaataattatgtggtttagaagttatgatagtttgtgccatatacattgtatatttttcatttttggtttgtggaaaaggttgttaattgagcttttctctttttttctccattccctcattctgagcaaggaatgactttttcttttatttcctttacgaaatgactttggtgttttaacattccagaagatacactgttttttatatgctactctaaactctgctgggaactgaactatgacgtcagcattttcattcatgaatctgattcttctaaatttttttcctgttttgtattcctgagctgacttctggcacatgcacaaatcagtttaccattagtcagcccataaatcactgataaaaggtaaaacaaaagataagatactggagttattttgatagtgctatagttctcatgctgatttgcatcagtacagtttggataaggtttctggctaaacagattgaaacctaaaaagtcaatttaattatctcatgattttgtgacttgaactgtgttgtgaacatattgacacaatatttttgttcttacaggaagttgagagtgctatgctatggctcctttgttataaaatagcatttcttttttttttttttttttttttttttggagacggtctcactgtgtcactcagtctggagtgcagtggcatgatctctctcggcttactgcagcctcgacttcttgggctcaggtgatccctcagcctcacaagtagctgggactacaggcacgcgccaccatgcctggctaatttttgtattttttgcggagatggagtttcgccgtgttgcccaggctggtctccaacttgtgaatgcaagtgatccacccactttggcctcccagagtgctgggattacaggcgtgagccactgagctggcctaaagtagcatttcttgtataatttgactaagttggaagattatataatgctttatttcagagaggttaggcctagagattaaatgatgttttattcaaattacctttgtaatggatttagatttttttttggagcattttcttgcctttgacatattttaaataacttcattgtttgatacttttattttaagatattattattgtggtggaactagcctagtattccttgtattggacttagggtgcatctaccctggattgtgcactcgtgtagctgttgactccggtttctcctctagggaggtcactgcttgcagttcagtactacgttagaacagttcttgaagaaatcttatttggagttttcttctgcaggccaaatttcaggctaagcctccggcccatagtatctttcaagcctgctgtagctgatgaatggtgagccgtaaaaaagtttattttctctactttcgtgggggatttgctgactttctggatactcaattgccaagaaacatttagaaataaaacgtgttatatttaggaatcatcattttagctaaataataatgcatgattagaattgatgattcaagctgcaaccactttgattgatacccagtcttactcttgagatcacttttttttctgagacagtcttgctttgtcacccagactggagtgtagtggcgtgatcttgtgtcactgcagcctccacttctcgggcctaagcagtcctcctgcctcagtcccccaagtgactgaggctataggtgcgtgccaccatgccaggctaatttttgtagagacggggttttgccctgttgtccaggctggtctcatactacagggctcaagtgatcctcctgcatcggcctcccaaagtgctgggatgacaagcatgaaccaccacgttcggctgagatgactttttattttttatttactgggtttttttttttttgagatggaatctagctctgtcacccaggctggagtgcagtggcatgatcttggctcaccgcaacctctgcctcctgtgttcaagcaattctcccacctcagcctcctgagtagctgggattacatgcatgcaccaccacgcctagctaatttttgttttttttagcagagacggggttttaccatgttggccaggctggtctcaaactcccgacctcagctgatctgcctgcctctgcctcccaaagtgctgggattacagacgtgagccaccgcgcctgtcttgagatgactttttaaatgccataacaactcacagatcctgtgtcctcccattcttaaatgaaactagagctttgtgttcctttaggttaaactaaattatctaataggtaacagaagagtggtctgttagctggctttctcctttcagtagatttgctaagagaaaggaaataaaagcaagtagactgtgaataaacattgaagatgacttaaatgacattgttttccctaataatgaaataatttatatattatttaaatataatttctataaaagaatctatttgcaagtgataatgaagaaaggaatttttttttttttttttgagacaaagtcttgctcttgtcccccaggctgcagtgcgatggcgcgatcttggttcattgcaacctccgccgccttggttcaagcgattctcctgcctcgccccccaagtagctaggattacaggtgctgaacaccacgctgggctaatttttgtatttttagttgagacaccatgttggccaggctggtcttgaactcctgacctcaggtgattcacccacctcggcctcccaaagtgctgggattacaggtgtgagctaccgcacccagcctaaaaaaggaatatttaatggtagagggctctgtaaaaaccccctaattttcaaagccatgtgccactgtagaatttatgaaaagttatgggctattattattaggtttcaaaaagtctggaatactggcggtagcatcagaattatttatttatttatcttttgagacagagtctatctctgtcgcccaggctagagtgcagtgatgcaagctccacttctcgagttcacgccattctcctgcctcagcctcttgggtagctgggaccacaggcgcccaccaccacacctggctaatttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctctatctcctgacctcatgatccgtccgcctctgcctcccaaagtgctcggattacagacgttagcctccacctccacgcctggctaaagcgttatcatttttatctaaccctgaaccaatcagtgattggttagttctctagctgtgaaggctttgcacttcctagacagcttgtagaacaagcccacttggattcccagctcaaactctttcctttttactatttatttattatttatttattcgttacttattattaattaaaaaaattttttagagacaagagtcttgatctgtcacccaggctagagtgccatcacagctcactgcaaccttgaactcttgggttcaagtgatcctcctgcctcagcctcctgagtagtgaggactacgggcgtgtgccaccacacccggctaattcttttttaattttatggagaaagggtcttgctatgttgcgcaggcttgtcttgtactcctggcctcaagcagtcatcctgtctcagcctcccaaagtgccaggcttacaggcatgagccgctgtgcctggcttgtactctttcactagctgggaatgctggtgagcaggactcaaggatcccagcagagctgcatcctgtgctgtctttgctgccacttaggtggaccaggagctagaagcctttctctccatggcctccataccttcttttaccagatggtatttctgcatttatcactcttgattccagcacagcttttcctcatcttgcttttctcagacctcagctcttatgtaatgagatagttggtagtcattttgaggggattcatgtgttgggtaaagggttttcctagcgatgacctcgaaagttccttcccattaataataattactattaataattaatagcaataactaatgataaaacagaacagttgcagcaatatactgtaataaaagttgtgtgaatgtggtctctctctctctctgattatcttattgtaccatactcacctatttttggaccttagttgaccgcttgtaactgaaaccatggataagagggggactattgtgtaaggaaatgaagtcggagatatggaatttcatttcagggcttgctttcctgatattcagctattctgtataactgtatcttttccttttgaggtccttgctccaggacaagaataatatgttgactcaagctgtatggggggatttgaactacagacactcagatatctcctttctgaggtacatagagggcttaattttttaggtctgtctgtttaatatactatatttactttaaaaaacgtaggccgggtgctgtggctcggtgcctataatctaagcactttgggaggccgagacgggaggattgctttagccctggagttcgagaccagcctgggcaacatagtgagaccttgtctctactaaaaatagaaaaaattagccagatgtgttggtgtgcgcctgtgatcccaggtacctgggaggctgaggttggaggattacttgagcccttgaggtcaaggctgcagtgagctacgatcacgccactgcactccagtctggatgacagagtgagatcctgtctcaaaacaaacaaaatgtaaaaaaatttaaatttattaaaaaagatgtacaacaccaaaatgttcatagttattctgtatgacagatctgaggtctttgttcagacatagatgagggttcatagttttggaaaatagacttaaataatatatgattacagatgaaaaatatttgctaacctcagactttttatgtttaaggtagtatttatattcatttagttgtactttctggagttgattaatataactgttattaaaatctatcgattcccagtaattcagtaaatgaagactcttcctatttagaaactcgtgtggattggggagttgctgtgggcccactgtcattgatcatatcacatcttcacttgaacctgctccctgggcctcctataggcctcgcgtttggagaggccgtgaacataatttatttttggaagtttctttcatttttaaagatactgagaggcaagttgaagttcctggtgttcgtgtaaacattccctgccttatcctttccatctcagccattatgaaatgttctggctgaatcatttgctttcacaaagctttgatgaaagtttcttcctcatttggttttcttgatagaggctgttgtgctaaaaagaaagctataacaagttagaagggtggagagtgggcacttaacatttttgaagtacttgtctttcttcctaggggtcctccagaaattgatcatagataacttgaccaaattcaaggcccagagatttcttccaggcattctgggagggaaggaacatcaggctttctgtactgaatctaattattctaaatatttcccactgcagcttgtatgagtgttttctgatgcaaatatggtgatagtggcgacctctctaactgggctaaatatccttgacagctttttatctgtcctctccaagtatttttagtctctttagcttctgtggccatgtctggaggaactgaggatggatttagctgctctggtgctgctccaagttgttgtgggtgctctttgctaccttcgtcactgtcctgccacagtcctgccactgatgaggctcctggcccttgtcatttgatgagggaacataaacacttgtttaataaaaataaaaaagtcatgattttcagaatgctttgaaaataagctatggctaatggtgatacacaataggaatgtccctaatttcactaaattgtatgctcaaaaagggttaaagtggtaaattttatgttatgcatattttgccacaattaaaaaaataaaaacttcaaatggatttgaagcttaatgagaaaactagttataatgtcctaacagtaaatatatggccaatattttcatgaccccaaggtgggaggctgtgccttaaataaactgtcagaatcacacattaaaaaaaaaaaaaagtgatggtaatcaggccctgaggttcatttatacagaaagtgatttttaggtgagattttaatatttgcaatatttatatttgtaaagaggattggctagctcattcagaaaagtctgaggttcttaataaacactaggaaacagatggtttggggttgatgtcagggaaggtaagcaggccgtgctttagattagagcacttttgattgcaagtcccatgagccacacagtttaggccaagtgaaagcagttttagtctaagaagagcagaagcaatcgtagcctctcgggacagaaactgaagtgcagctgggcagtgggaactggatctggagagtctggagtacatgtcttctctggagctgggctttttccattcacatgtagcttccttgcttgagttacatgtagtggccttagtcatggctcctgcatgtcctgactctagttccagtactcatcatcatctgactcccatttctatggctcagtacaaaaatattcaagactgggtattggactgactcctctcagccatttgctttgtttccataggccaggtgatcatctcactctggtcgactatgaaagaaggttggttagatccagcagcctgctgatcatttagagggtcttagagtgagaggagattgtgtgagaagctggttatcatagcagggggtcctggcacctcaaactctgtccccatcaaacagtgtaaaagaaaagatattgactcctaaaggagtgtcttatgttcagatgctatagagttttgcagagaaagtgttcagtgtagctacagatagaaggccaagtgtccttggtcagccagcctgggtgtgtgtggagtaagttagtggtaggtgtagtaactgtctcaaagctttttctttgtctctctctctctcttttttttttttgagacaaggtcttattctgtcgcccaggctggagtgcagtagcacaatttcagctcactgaagcctcgacagcctgggctcaagtgatcctcccacctcagccccccaagctgaggacttagctggaaaacacaggcatatgccacaacgcccggctgatttttatgtttttagtagagacaggggtttcattatgttgcctaggctggtcttgaactcttggccagctcaagcaatccacctgcctcagtctctcaaagggctgggattacaggcgtgagccaccgtgcccggccccagaactttttctttgaatagtggagaagcagaacaccttggaatgctatggtctgtgcggtctttgccctgtgggtgttctcaggtggaatcaggcagtttgggtgatgtcagtatcatttgaggtcttccacagttcagctatttgggtgggcttccccacttttccccttgttttgggtcggtaaacataaaaggatggagatgtgtatccttagtaagaatgggagacgttgccttcagaatgggtagaaagcagaaaacaagcggggaagaaaacagaaaacagcctctctttaagtgtatgtggctgcctgtgtgcacagtccttcaccttttccttagtatatccctcctgcctctgatctcttgttgttcttgatttttcatggtagaaggaggaaacaaaattatagaagacaggtggaatactgtgaaagaatagtagtttggagataactatgtaaagggctactagcctgcgcaccgttgaattctctgaatttacagctgtttagtcattgatgtttcatagtgttgaccttgagtaaattcagaaaagcaatactgagtatgttctgctaaacaaaagaggaaagtgtatgtttttaaagaaacaaccttcacagtggtttcagtagttacagggatttggttcttttttaaattattttatttctttttaaagatggtctcactctgtcatccaggctggagtgcagaggtgtgatcgtagctcactggcaccttgaattcctggactcaagtgatcctcctgcctcagactcccaagtggttaggagtacaggcatgtatcaccatgcctagctgattaaaatttttttttttttggccaggcatggtggctcacgcctgtaatcccagcactttgggaggctgaggcgggtggatctcctgaggtcaggagttccagaccagcttggccaacatgggtgaaaccccttctctactaaaaaaaatacaaaaagctgggcatggtggcgggtgccagtaatcctagctacttgggaggctgaggcaggagaatcagttgaacccgggaggcagaggttgcagtgtgtcgagattgtgccatcgcactccagcctgggaaacgagcgaaactctttttttttttttttttttttggtaaagacagggtctcaatatgttgcccaggctgatcttaaactcctggcctcaagtgatcctccagccttggcctcccgaagtgctgggattgcaggtataagccactgtgcccagcctgatttgttttttaataatagcttaagatgtaattcatatattataaaattaacccttttaaaatatataattgagtgggttttcttttgtatatttacatgtttcgtgcaactgtccccactctctaattccacattttcatcactccaaaaagaaaatctgtacccattagcagccactccctgttgcctcctcctcccggccctagtcaattactaatctgctttatttctttatgcatatttatgcctagtgtgaacatttcatataaatagaatcatgtagtgtttgtccttttgtgacttgactggcttatttcccttagcataatgttttcaaggtttttatctatgttgtatgtagcatgtactgttacttcatcccttttttaaaattaaaaaattttaaatttaatataatagagatgggggtctcgccatgttgccaggctggtcttgaactcctgggctcaagtgatccttctgcctcggactcccaagtgctgggattacaggtgtaaaccactacacctggccacttcactccttttatttttgaataatcctctgttgtgtggatatataccacattttgtttatccattcaccagttaatagacatttgagttattccactttttggctattaagaaaaatgctgctgtgaacatttgtgtacaagcttttatatggacatatgttttcatttctgttggaaagatacctaggagtggaattgtggtgtcgtagttaactctgtttaactttttgaggaactgttttccaaacttttccaaagtggttagatcatattacattcccaccagcaagtatgagagttgtaatttctccacattcttgcaaacacttgttattgtccatctttttgattatagccattgttgtagatgggaagtggtatattattgtggttttgatttgcatttccctagtgactaatgatgttgagcatctgttcatgagcttattagccatttgtatgtctgctttgacaaatgtctattcaaatcctcttccatttttgaattgagtcaattgaatttttgctgttcagttgtaggaattctttatatgtgttctagatatcagtcccttatcagatatgtgatttcaaatgtatgattgacatgtgatatgtgatttttctctgattctgtgtgggttgtcttttcgcttttgttttttgagagagggtctcattctgtcacccaggcaggagtgtagtgatgcagtcatgtctccctgcagtcttgcctgcctgggcttaagcggtcctcccaccttagtctcctgagcagctgggacttcaggggggcaccactggtctggctaatttagaaattttttaatagaaacggagtctctatattatattatgcccaggctggtcttgaactcctgggctcaagtgatcctcctgccttggcctcccaaaatgctgggattacaagtatgagctgctgtgctggcctttactttcttgatagtgtcctttgaagaacagaagttttaaatttgattgtgtcccatttatctgtttttttgtttttttttttggtcacttatgcttttggtatcataataagaaaccattgtcatatccaaggtcgtgaaggtttacacctgtgtttttttgttagagttctgtagttttagctctgacatttagttctctgatagatcttcagttaatttttgtacacagtgtgaggtaggcttccagcttcatttttttgcatgtggatattcagttgtcctagcccatttgttgaaaagaccattctttcctcactgaagtgtcttggcacccttgttgaaaatcaactgactataaatctgtgggtttatttttagagtcttgattctattccattgatctatatgtctatctttgtgccattaccacaatgtcttgattctgtagctttgtagtaagttttgaaatcaggaactgtcagtcctttaactctgttcttctttttcaagattgttttggctgtgctagctcccttgtatttccgtatgaatattaggatcagcttgttagtttccacagaagagacaactgagatataatggggattatattcaatctgaggatctatttggggagtttaaattcattttatggatttgctgtatgcttaggaagtcctggctaactcagacacccaagcatcttgccttaaaaacacaaaattttgttttaatttattgatgtagtaggctgccttggtgaaacactgtaattcactgttagactggaattggacttttcaggttctaagagagcaaacagctcttccacgtagcgtgtaggttgacttcctgtagtaaatgtttttttgatgtgaaagtttgctgataccttgcatgttttaaaaaaaatgtggtattctggttaatatacattctggttaatagagaactagcagattatatatatgaatatttatcaaagagttaggacatgttacaataaaattgtgacattaaaatttatataattgttattattactggaggaatcagaagatattttaggaccttgtagtcccgcaggggccacgtgaacattggttattgttatacttttaagtcacttcatttactcaacaaataacaaagtgcctatctgtgccaggcacaaggaaggacagacccagtctctgtccttatggagctaagggggagacggacattaatcaagatgccatatgaaatttcagctgggactcagtgctgtgaaggtgcgtgcaatatgtcataaagggatttgactaatctgcaaggttgggggaggcttcttgagagctctggaggaaaatgggaattaattgtgggaagaattaaggagaaaagttccaggtaattgggtgagtttgttagtgagttgtgtggagatactctggttatatcctgtttatcacttttgggaaagagtatctgaatacttggctctggcctttactctgtcccttaaatgccttgtggctgagcaggtactctttctgagcttgttcacatactgttttttaaatttctgtagccatttttatttacagatacttacatgaaaacatacagaaatctaggcttttggttgattgttttcatataattaaaaaatcattcactttgggaggccgaggcgggtggatcatgaggtcaggagatcgagaccatcctggctaacatggtgaaaccccgtctctactaaaaatacaaaaaattagctgagcgtggtggcacgtgcctgtagtctcagctacttgggaggctgaggcaggagaatcgcttgaatccaggaggcggaggttgcagtgagctgagatcgtgccactgcacttcagcctggaggacagagcaagacttcatctcaaaaaaaaaaaaaaaaaattatttctttgtgaccttccatggttagctatttagaactgctttagtggtaaattgaatacttttctgaacatttttcctagactttgaaattaggagtcatttctgtttacacatacttcagaagcctgtcagggacagagtctgtagtgacagaagtctgtagggaagcagatatggatgtaagtgattcaagacaagtcataatgctttaataaggctctggaagggaagatggaaagacttccgggaggaggtggaatttgacctgaaatcattgacgggcaaacatggtagttggaggagaaattccaagcagaggaaatggaacagaggcatagagccaagagagtacagggagtgggtggaattcatgtgcatatgggtaggtaagcctcggaaagtaggtaggggtcatgttgttaggggcctgaaagtcagaccgaagaatctggatttaattctctgctcaggagaggcttttagaagttttttttttttagtagaggaatggaattgattggataaagtcgattctcctgaaacaggtgctaataagggccacctagttacttctccagcttcctctctacagtcacgtcacattttttagactctgattgttccaaggtcccacagtgtctggtggttttaggcctcccacattgctgttgccttgatttagaagttgcacctgcctcaggaacacaggcacacacgctcacccatgctcttgctgactttctgtgtcttctgtgtttcagcttaaatgaaacttccaataggagaagccttcttgaccttgcccctcttttcagattggatcggatgcccttcctgtgtgcaccatagcactacgtggttttcctagtcatggcacattttagtttgcattggagttgcttgtttacttctctttctctctcaattagatgtgcatttctggaggtaagaggcttgagtacctagacttagtaaatgcttgttggctgaatgaatgaatgaatgaatgagcaaataggaaggactagagtcgggagaaaatcacttctggcaagagttgtctgtagaattggggtgaggaaagagctcgcatggctgaggagtgtgtgtgtcacacacacatgcaattttgtgactgactgaatgtgggccttgagggaaggtgactcctaggttttgaaccataactggggatttagtgaggccagactgagatagggaagacaaggcaggtatatttggggagaatggctgcaaaggtaccactgtttttcttcttcttctttttcttttttttttttttgagatggagtttcactcttgtcgcccaggctgcagtgcaatggcatggtctcagctcactgcaacatccacctctcaggttcaagcaattctcctgcctcagcctcccgagtagctgggattacaggcacccaccaccatgcctggctaattttcgtatttttagtagagacggggtttcaccatgttggccaggctggtcttgaactcctgacctcaggtgatccgctcaccttgacctcccaaagtgctaggattacagacgtgagccaccgcgcctggccggtatcgctgtttttaaggcgtcattgggtagctttagaatgtgtatatacagcgtgacattggagatgtgggtcaaagatcagggagtccttcatatcaccctgctttttttcttcattgttcttccagagggcaagggagggagccttggtgctggagtccttagaggtcagccccctgggcttggggcagggagagaagggctgtgaggaggtctggaggggcagatgcagtggcagcagcacagcacaaaaggtacagacagtacctttgcaaccaatgaatgaatcagttcaaaacaattagaagtcacagttgtgagtgagattggaaggggagcagagaaggggcctgagggcagaaatgtgatgaatgcttacattttaatgccaccagaggggagagaaccagtagaggctgagaaagaatggtcggagaggtaagggaacaagcagaatatgaattcagggttgctgagtgtggagggttgaaaggaggttgtcagtcgtaatgctgcagagttgagtagactgaagactaaggaagggtattggttttgtcaattcgataatgagagaataaaggagtagagatagggtggatgattatttcagaaccgtggtggcatatacagagtactggtagaaatgatggtgaaatgattgatccagtccaagatgagaaaagaaaccactgtggcctgatgggctgtgagtgtattagttatctatagctgctgtaaccaatcatcacaaacccagtggcttcaaacagcccagggtggaatctcctggttcccatgggtcaggcatttgggcagggcagggctgggtctgctggattgggactgctgaactgtggtcgaggtgctggccaggactgggctcaccttggaaacctctggtaggggaggatccacttccaggctcccttggccatttgaaggactcctttctttgggctgttgggctgagggctcagcttttcgccagctgttggcccgaggctaccctcaattcctgccccaggggcctctgcaacaccatagcttgcttcatcagagccaggagggacagtctctagcaagacagaagtcacagtctgcccattacctttgccatgttctgctggttagaagcaacttgctaggtccagcccacactccgggggagggggttacacaaagctgttaacagtggctgggcgcggtggctcatgcctgtaatcccagcagtttgggaggctgaggcaggcagatcacgaggtcaggagatcgagaccatctggctaacacggtgaaatcccgtctctactaaaaatacaaaaatttagccgggcgtggtggcggacacctgcagtcccagctactccggaggctgaggcaggagaatggcatgaacccggaggcggagcttgcagtgagctgagatcgtgccactgtactccagtctgggtgacagagcgagactccgtttcaaaaaaaaaagctgttaacatcaagaggtggggatcataggaggtccatcataaagtttgtcctccaccgtagaggggtggtgacgggattagaaggcattataacagttcttcaggtgaggccttggaggatgcagatggaaaaacgggagctttcagaggcggaagttttggaagtgcagttccagttgaaagttgggatagtcaggtggtgacgcttctcaggaggccttctgtgccctttgtcttcatgtgccttctatgtgctctctcctgttagacaaatgaacattctgtgttacagttgccaccgataaatccatctgtctggctaaaatggaattatttaccagccaattcctggccagtggaggtatctgccctcttgccttatggttttgttgaggatcaaatgaggtaattcatatgaagtgttttatagactacaaagtaatatgcaaacaaaaggtattaaacggtgctacctttttctctatgttaagtagaacccatggaatttaacttacattttccttaataacttgggttcattatgttgtatgtagcttattaaactgggctttatttaacactgtgatttgggtttttggagtagagagtttacttttatgataaatgaccccaaactgctatacctttcaaatccttgtgtcccatttttattgtttaaaaaaacaatctcaccttgccgttgcctgtcactcttttgcttctgtgtgtcagttttgagctacattttttcccctccgatttgttgcttctgatctctgggcttggcaacctgataatgaagcatattagagctgtgagtagttttatagtaatcaagctacgaatgtgggtcggagaaactcttctcacagtggagtacataagcttttgtgcatggacttcgtaaaattcacttttggccttcagagtgttcttggcttccttcctagttctggctgtgttcggattaagggaggttcccagatagccgacctccattccggggctgtggctgccattttcttggcgtccacctcattgctctgttacgagaaacagtgtcattctcttctttagttttgatgaggttttagttctttgggcagtagcaagtagtgataggtgatggtggtctgtggttcatggaccaaaaaatgtttgagaggcatggaggatctttagacaagatcaccttctaggtgtatgtggtagcattctgttccaccgctctcttctccttcaggatgtctccctcccagctaacctgctcggtgttcctcagtgggagcgtttgccttagctttctctcagagcatcgtacttactttttctgcccgcatttttgcattgctgctttgtggagaagcgttgctgcattattagggagagaaccgtgttttcttgtggaaatcacacagtagtatgggagaactggtctggttctaattctgccccgtcctagcttgtggcctttgcccagtgccttgttacccatgtcttggtgtctccatttctagaataggcttaatgtgtgctttgctaccttttaggatcgaaataagattttatatatgaaaatgcttgttatacgtacataatattgaatagaatgcctagtttgttgggttgattttgttgatattttacaatgctctctctgaggagttaaacaaaattatcattagtatgggtaacaataagtactactgaaacaatatcattttaaatgttatacagttttttttactgaatgtattctagttgaatctatttgtacaaatgtggacatttagtaagtgctctttgattattttcagactttgagtatactggcttccaagccaaattaaatttatgaaaattctaatgatactgtgattcatatctagaaagaataatttaaaaaaaactgtaaaatcactttaaacatgctttacgtgcatctctggtaatagagaatcaattaatctgatttctcaggccataaatctggcttgatatattgtaatattagttcctgtgtcagcctcttagaacttgaactgttttgtagtctgttccagctacttgtttgcttttgaactcaattctaggtgttgaactcaatttgagagcctaaaatggtttgtgccccaattaccttagaggttactgtttcatttttttatttagcctgccccaggagtaggaagtcggctacctaccagactttttccttttaacttgactgtatactttaatttttgtctctatcccatgggggagttgtgagggttattatagtatagtagcacttaatggcatattttaaacttcttgaaaagtggtaatatgtgagcacataatatttttgtactgtagcacataattttttcccacactaaccttttgtggttcagaaaaagaataaagttacttgggcttggggtacatgttgaattgcccatctcataaaatcgttaacctgattttagggagtgtctctgaaacatgtcttttgacagaccttgtgctgtttcttatttattattaataaattgatatttcatttattattcataaattaatactaattaaataattaattgtgctctagcccccagttttagtttggttttcttggtatctctgaaaactgttgagtattccccctactccttttaagtttttttttttttttaagcaggtttaaagtagcttttatcatattccttgatttctcaaatgaatagagggataaggttcctttctttaaaaatatctgcaacattgctggactgagaggtcgtatttacagttttttctttttaaaaattttttttagagatggggtcctgctctgttgtccaggctggagtgcagtggcacagctcacagctcactgcagccttgaactcctgggctcaaacagtcctcccgcctcagcctcccaggtagctgggactacaggttcgagccactgcttgttcagtctcttgcttttgtctcagtggcacagtaccaagacatagcaaatcaaagtgaccaagaggatgagtggcaattcggtggccttataggaagagatgtgcttgaaaacgacagaaggcttttagtaaattccaccaccatcaccaggacgagagacgggaccatttttcctttccataaacttaggggctggttattaatttatgaattctataagtaatttgagcttgtgttatgtaccagacattgtattaagtattaccagagatactgggaagaacaagccagacatcctttcaaggatgcatttgataaaatctcattttgagtatgttaggaaaatatttattggagaaggaaacctcctagattggttttagatcccgaatggccttagggattgaaaatggagttgtaggttagcagaggacatttctgaaaggagtaactattttgtaattaaaaagcagtttacagaagatactgtggcagagactgctagttgatcatgaaacccatctccttctcttcctcctcttcctgggcattttccagtcccccttggaatcgtgaccaaattctagccagtggggtgagagcaacgaagtgtgccacttccagacttggcccctgaaactcttgaggcatgggtatcatgccttttccttatctggcttgatgcagagggcctagtgacctagaaagtcttctgccacaaggtagaaggagcacaggcagcagagccactgctgtgagaacagtctgcccaccaggagcacctgttttggactttacctgagcaagaagtgaacatttttggtatttgagccattatacagttagcctccctaactatctaggcacgatgcctaggatgctaagcaaaactggactgagaggtcgtatctacagttttttctttttaaaaaatagtaaaggtgctaagtagtaaaggtgctaagattcaggcgcggctttaattctgtggagacctaaatattctttgtctttatttcaaagaacggtaaatacacttttcattatgctgtttctctgttccaaagcctgtaatcacttcttactatatagcatcttgtttcattaatccatcttccaaaaactctaatatatgtatatattatccatatacaatgaatgtgcctgtgtgtaacatcctgatctaggttctctgagtggagacaaaatgaataaaacatagtccatggcttcaaagagtttctgcttgatagccaggtagttactgaatttccatactgctatcatctgtcccttgttttaacctttaagtcatatattattttttcattacctttttttaaaagtattgtttcaattagatagtatactttttgaaaacagggaatatatattatagagctctgcatctctcctcttgggtatttcttttttttttttgagacggggtctcactctgttgcctaggctatagtgcagtagtgctgtcatggctcactgcaacctcgatctcccaggctcaagcaatccgcctgcctcagccttccatttagctgggactgcaggcacacagtaccacacctggctaatattttaatatttgtagagacagagtcttgccatgttgcccaggctggtattgaactcctgggcttaagcagtcctctcgccttggccttccaaagtgctgggattacaggtgtgagccaccatgcccagccttcttgggtacttccagcagaaactgggcactatacttgagtaaccatccctagagtttctactaattatcttgtgtggatattctggtatagttttgtattatgtactaacagatgaaagtactttttaaatcttctaggaattagtggaattatgctgttgaggaatgttaggattggaaggatcttttatagatcatttatctaattcctgatcttttagtttgatcatctggtttctgatactcaaggtgtggccattaattgcagcatgggcatcacctgggggcttgttagaggcagaatctcaggttctccctcagacctgtgaatcagaacttgcattgaaagaagatcctaagataacccgcatgcacattacatttggagaagttctgctcaaggtcaactactcatttgactcttgagaaaactggggaagtcagagagttgcccagtcatacaactgtttatttcagtggttctcaaccttggatacatcttgggatcacttggggacctttaaaaaaatactgaggcctgggtcccatccccagacattctgacgtaattggtttgggcatcagagttttggagatttcactagatgactggctaaggctgagaaccattgatttgattaatgatggaatccaggtttcttcatgctctaatcaagtattccttccactccaccatggctgtacattcagaaacaatgaaaaacatcctatcaaatttttacagtaatgcatcactccatttcatttcctttataggaatttacccctattggatagtgtcccatttaccatctgtcttccccccactagaatgtatctccaagaggacaggacccttgtctgtcttgttcagtgctgtgtcccagcttgcgaacagtgtctggtacatgttaggtgctcctttaatagttgtagaacaaatggaaggagctaccataaagaaggatgtgttctgtgagaggaaaacacaggctactctaaaggtaccctgtgggcgagaggcttcctgaagggtgaggggtctgagttgaagtgcagaatcagcgggggaggtgcttgaagacctgcttctgaggaaggacttgaacccagatctgacttgaaagcttgtgcttttccattccactgtgttgtcctgtggacacagtggctcactgatttgcccggacttcttagtagtgagtggtggactggaacacaccaccgcggctctgcaggtgcttaaggccagcccgcctccctctatggcagagccgccccagtattgcagacaggcgcctagagggagatcaaaacacgaagttgtcctgtgaaagttcctggcccagtgtttggcacaggggtatctagtacaaggtagccctttcttatcatggaagtttttttgtgctttggcttgttttgagaacctatggttttcaaagatagaatgacttgatttcagttttaactttggtttctttcctagttaactatggagacttcattatgcagtgctgtggagagagtgtgattggtttttgtctatgatatttctgtgtcatatgttattttagtgccaagttcttcctgttatttcagatattctgtcactgatttacttattgttagactttgaagttgggtataaaaatccttttttatgaagctattcattagtgtgtcccactgaaccaaagtgatttttaaaaacttttcacctaagaccattgttaagatatctcaaatggtaatcttataccgtcagtttttgataataggaagccaggaaatgttaagccttgaatgtaagacattatttttaacatcgtaaaatttcaagttttaattcagaaactaaattaaaatgaggtattacattcatgtgattagtgggctgttactggtgactcttaaagatgttacaagaagtcagcgtgctgctgacttttcccctattggagatcttcccatgaaccacttttcctaaggtatgatgattccatgctcacagtcatgggtagaaagtaatgttggattttccaaaggatacatgaattccgagccttgtctagtctatagggtgaatccttggacatgactgttaccacagatgttatcatagttaactactttttttgtttttgtgtcagggtctcattctgtcacccaagctagagtgcaatagcatggtcatggttcactttaggctcaaattcctggctcaagtgatcctcccacctcagtctcctgagtagctggggttacaggcgtgagccactgtgcctagctcagtatactactattggttaaattggagagggaaacagtcctagaacaagagttttacagaaatagaaaagaaagaattaaggagctcatggttatcctggtagctaggagtcacattatagagaaagactttatttatatggaccctgaaaacaatttgacttctgaagcacttgatcatgggcataagggagaggaaaattaataattcttggaagtcaactttagtcagattgcaacattttttggcataaaaaactcaggcgcggtgggtcatgcctgtaattccagcattttgggaggccgaggctggcagatcatttgaggtcaggagttcgagaccagcctggccaatatggtgaaaccccatctctactaaaaatacacaaattagccaggcatggtggcggacacctgtgatcccagctactcaggaggctgaggcaggagaatcacttgaacctgggaggcagaggttgcactgagctgagatcccaccactacactccagtctgggcaacagagtgagactccgtctcaaaacaaacaaacaaacaaataacaacaaataaataactcaggcaatcctgtttgttcttagaaaatgttaacattgttaaagctcaccctcattaactatggtaacaatagtgttttgtatttgggtggtacctttgaattgaaagcacttgggtatgtattacctaatcctcctcctgcctcagagagaaggagagagaagtatccacccgccctttttggatgaggtagtacagagaggttgaattactttcctaaggacagctagtaaatgttagaactgaactctttatattttattttaattaattaattttttgagacagggtttcactctgtcatccaggcgggagtgcagtggtgtgatcatggctcactgcagcctcaacttcccggattccagcaatcctcctacctcagtccccccaggtatctgggaccataggtgtgttgccaccatgcctggctaatttttgtatctttggtagaggtgaggttttgccatgttatccaggctggtctttaactcctaagctcaaataatccacccgcattggctccgcaaagtgttgggattacaggcatgagccaccacatttatttatttatttattattattatttttaaagatgaggccttgttctgttgcccaggctggagcaggagtgtagtggtgttatcatggttcactgcagccttaaaagtcctgggctcaagcgatcttcctaccacagcctcctgagtagctgagactacaggcacaagccaccatgcctggtagcttttaaatataaaatgttgagggtggttgttgaacttgtaaactatctttggttttctaagtgtataaatatgtggtttataatgtaggatgaataatctaaaattttatttaatactgcagccaaacaaaaaagatatttttaggactgaaaataattggccgtcaatattcaaaaaattttctttttttttaaaaagttaccgttgtgtaggttttaggtgaaatctttaattttatctgagtgaagcagcctgacagccagagaccttgtttctttcctgttaacggaattccccttgatttacttgccatgccataatactagttggcgctctgcacattttttgggtgagtcgggtgttgggtttattgttgggaaatggttaaaaatgttgttggtgttgactgagcttcaaaatgaatatgacattggttcttagcaaaaatttcctctatgtacagcacacatacttcccatttaaacaaattacacaagttatgcatgttcatcagcacagaccttttctcacatatgtatctaaaattttgaagcagccttaagcttgcagtgcaaagaacggtttccccctgagccatttgaggataaattgctgataagttccatcactctcaaatacttgatcatgtacttcctacaaacaagaacattctcctccataaccacaagaacagtaatcacaaccaggaagttaacactgagacattcctactctccagtcctaaagtcctgttgctgtttgccagttgatccagcaatggcctttgtagaaaaatatctaatcagaaccttgggtcataactggttgtctcttcaatctcttaatacagaagagttttcagtccttttagactttcatgaccttgacactcttgaggattgcaggccagtcattttgtggaatgttccttgatttggatttgtctgatgtttcctcatgattagattcaggttttgcatcttggcaggaatatcacagaagagccagattatatctttttgaaagattagttttacattttattttctgtttccttagagcgtttcccaaagtgtattctgcggaactagcacctactgtgttctcaacaccgtgccacctatagaaggtaggatttgaaaaagcttttgacttacaggaaggggtgggcttggcagtggcagtaattatcatctagtacagtggaaacagccttcagcccggactcagaagacctgggttctgcacttaactgctgtgtgatcttagatgagttacttaatccttctggggtagcaaaaagaatgctctcctcataaagtttctgtggagatgaaaaaaggcaaaagatttaatcacacggagaaatcaaagcacttaacaaatgtttgatactaatacaacacttctgtaattctagtgtccaataccaggtgacttagagtaggagcagtgtggtattttgggaaaagccacaggtcatgtttgaatcccagctgagccactcagcagctgtggatcttgggcaaattaatctgagcctcatgttcctcctctgtaaaatgggagtaattaagcccttgtgttttatcgtgaggattaaatgaaagagtgcaatgtaagatcctttctgggtgcctgatacacagtagagtcccacaagtgcttactccctaataaataatggaaaatagatttacttaatcacatgtacctccagttggaattgaatgaagtagaggaggagagaatgtcccaaaacccaaattgaagtgatggcttacagggctgctgtgccctcactttatctgttccctcatacatatttttagattgaaaatgtaaatgtagataaacagtgagaagtttattgaacctgagttatgatttgacctaagcctggacccgagattttgtaatatgatcaacaggaaaaaggtaaatctgggctacctaaaaatagaagcggtaagttgatcatcacacaactctaagaacaagaaggggattgttaaatagcaaaactaattatatttttctacttaaaaagctgttagtttctgtttctttaaccttttaaaaatcttttgtagaattactactgggtttaattcactttggagactttggaaaagaataatgcaaaatcagatcagtgtttggcacatagtgcttaattaatatgtattttggatatatggtgatttgaaggccttaggttagtaatggctgtatttgctgctgtgagcattatgctgacttgaatataacaatatatgtttatgttttcagttcctatcctactaattaaatctaagcacataataattagagctaaacagaaaattgtagagcttccttttgattttactactccatgttgttgatcaaagatattcccaataagatttagcaatttgatacactgttataccaaactgtttgaacagtttggtctagagtttgaaagattaatcgtaatcaacttgaatgaataacagtgttcatcattattcatagaaccaacattattttttattatgaatcaaagtaaaatgaatgtatcatttctagattagttaatatagttataatttaccttggcagaagtcacagaattttcgaaggaaaaggtcaaatacatttctttggatttaagtaaaggatttggcaatgtgaatctcatttttttgaaacaaaacatgaaaacagtaattctgctttttgtctaagtgaatgagcatttttttgcatattggaaagttatattatactacaccttgtaggttgactagaaaggatggttcgttctttagaattagagttgtcagtcaagcaaatcatctgtcattttcaagagcctcactagttatttttttattgtgaagtaggttagaaaattattttgtaaagtctaataccatacacatatattttgttagataatgataatgaagtgttttactgtcatttggttgacactcccacttttcagtgtcaaagttcaactatttgtattgaatactgaataatgcagtggaaaccagtatatgccttaattttactgttcactcaagatactattattaggatttgaaaactggtgcatgtgtttagttattttatcattcttagttatcccaaaacattaaaaagcagattttaatttaaaaacagatttttatgcagtatagccatgtaaagttcttttccagtgtaaaatcaaagtttctctgtatcccacttcacctgtagaaacactgaaatttaaaaatatgagttttaacattttgcctatttgaaattccagtaattcttttctcagtattaaactcgcaatccttataatgtagtaggaaaatttacccattgttatgtttcttaaaaacatccagtttatattcagcgtgaacctaaaattctggaaatggtacactttaaaaactgatcaaggggaacccactggccagtcatattcctgttccttttgactctgtggccacacctccgtgtaaagtgtaatgtttagaaactagattgagagagtgcttacacagccctgccctttggtcacatttaccactgcctgatttggtatcagagtggaagactgaagccttttctatagcagttaattgtgctgttgagaagagtacctttattacataaataccacacacacacacacacacacacacacacacaaacacacacacacgcacactctttatataccgcacagtagctgggttcctcgaagaggctaaaagaacagaaaattaacatcagattgtgatcacaaacatagaagctggggtttaaaactctgctcgtaagtgttcagaattgtacttcaaactgatagctttctcagagatatggctattcatatacaattcagagcaagcccatccattgagcaaccagtatagtgccgttttcataaaaggtacctgtaaatgttgaatatttgaattgagtatagattttagaatttcacctctattttcagaattgtacatatcatgggggattttaaaaaatggaaataaaagtactttaggggaagagagaagggaggtaaaggctcacgtgatctggtattctctgctttaaagttttatggcccgtggaacctccctcgggaggatgaagtgcagggagcataagcacataagattaccgaggttttatagtgtgtaattcatacagaactttctatgaactttcttttagttgaacagtttccttttggtttcacaggaagattttttgaaaggtttaatcttattttcctattaaattaaaatttgaaattcttgaaagcagtcagtttttaggtttttaaagtttttatactgcttatagaaatagaggatgggtattataattcaattggttatgtagttcatggaccaaaaaagatttagtatgccaaaactctcttaagttcatctccataaaatctttctatatgatgtagtaaattttttagactttatttctatgcccaatattttccttttaagatcttttccttgagaagaagtgtgttaatcagatgaaaaatgtttggagaggattttgtgaccttagaaaatattttttgttctttgatgtttttcatctgttcaaaaaaatagactgtactgaacaaagccgtagtaaataactggaaaaagatattgttgtatttcacttttaagattattaaccaatgcctgtatacttatgtaaggttgcttaattgtaaggcctattaagttatttaatgacagtaaattttatagggatttgtgtctggagaagaattagagataatctaatcttgttgatttgggaaaactgaaactattaagtaacttacccaaggtcacacaattagaaagtagcagaactgggccagatcttggactcttgactctgagttcagtgttataaaaccttattatatcatgaaaagttgtttcaactgtgacttactggagcaaattaagtctttgatgttttaatgtgcagctccttagtacctagttatgtgtaccctttgtatattggggatcttatgtagcataaaaagcctgggatgaataatttgtaactttgacctaaatgtgccaaagcttgtgagaaattttgagtcaggcaaagaaactttgttataggagtgaaaaaataaatgatatgtaagcaaacaaatgagtgaaataaatgttatataaaggaaatgatctcttctagaaatcatcaggtagactgattattaggtagtcagacataccatctagtctgaaagtaattattttttctctaactcatttagaagagttacattttgatgaaatacattaattatgtagatatgtatatgtaaatcaagttaattaaaatgatgattttatgttcagacctagaaaggccagcttctgtattacctgagtagctaactgcaggcttaaatcccttatatttataagatttgtgatttgcttttgaaaggataaatctcttttatagtctaggggatgaagtagtatttacgaacaaaatagtcatatattactataattcttcttacctaagaaacttaacattttttcaactgcttaataaaagatttttgggctttgtgaggttaattttataatttttatgtgcttcatcaaaacatggggaaagaaccttttaaaataactttcggttatgggcagctgcggggattttccctgttcactcacatgtcagggagcacaagcccgatcctgttttaaatcctcttgaccagattcctgctgccatcaatctgataaatgggtaaatgagtattattaactaagaggaatagtggggcctctgatgctcttggtctcacattgactaaactgagctgctatttctgactttgtcagtgtactttaaaggagattttatctattattttctctaaatttattgttttcttctttgtagatgatcatgggaacagcaatagtagtcatgtaaaaatctttttaccgaaaaagctgcttgaatgtctgccgaaatgttcaagtttaccaaaagagaggcaccgctggaacactaatgaggtagataagtttctttttttaagggtataattattttaagggcaaattttttaggttgcttcacatagtcctactttatgttagctttaaatttaaaatactgatctaggaaattgtaaatgacattatttaatctggatttgacagaaaccaaccaacatgttttttgatctgtctctgatctgcttggcttgcattgaaagatacacaatgtgcacgttgacttaactaaagtagcatgagtttctgtctgtgttttcttgcattttagtgtcttgcatttagtggttaaccctgcctgcatgccagttaaacgttagttgttatgtcttcatgaattaataaatatacagtcccactgttccacagaatgtgtagtgtcttgacaatgtgaatttttgtagagttggaaagggcaggtttcataggagtgaaacagcttttcgtcctttctaatgaagaaagtttgcttaatgctaagaatttttattaagattgaaggctgtacagtagattatgtatttagcatccaattagaaagtagatttatgaagtagaatgaaaaaagttaatcatcttggatgatgtttccttttttggtaaattttaatccaggagtcttactgttaggagtggattgctttgtcatcttttttattttgaaatctgaatatttcaatttaaggtaatacccgtttagtgtggtgatgagaattgggtatacgtccatcaatttgggagttatattcctttaattcagatggctggggttgctggttttgccaagttccatttgtgtgccttggctcaacattgatgtccaagttaaagcaaatttagcaccctatccttattggacactcagttctgttaaaagacacaagaagaaaatagtgctgcctattgagccttattttttaaagattctttggcgctaactacttcctgattcagaatgcttttgttttgcgtggtgggaggttatgtggataaaagtctctttccttatcacaggttagatttaaatactcactggaaccttacagctttgttaacttgtctcaactgattgtaaaattctttgaaggactctatgttttgatcattttcataaattacattttcccgtcagacagaatgtttttgctttgacaaatgtttgctagtttagaggcctgctgtttaaccagttatttattaactatttcagacatttttagacgtgaaaatgaagtagatatgcttaaaattagtcttaatcatagtttgttactctttcagcaaaatagtattatataatttggaagccatttaataagtcggaacttgattatgaattatttaaaaactcagtgtatttcttagtattccctgaaacgtagatttgataccaaattattatacacgttagttctagtttatttataaatgtaacccaacccataataagtatgtatttttccatattatatttcctgtggaattggcagcttatttattttattttttcccatggacccatgtcttgtggcagtttattttaactatgatttgacattatatttgaaaccagaaattgcttagtgaattaaaatcagtggcctgaagagtcttataaagctggatgtagcagtgctgggaatttagttggtagattatttccatcagtggcttcaaaactttttgaaacttttcagcataacccttcaactttcacatgtttaataaaacctctaaattatttacatgttgcaccttactagtatattagatacgttttaaagcatccgataaagaatttttatagaggatgagattaaaagaaaaaaatgagaagtttttccttattttctttctggacctcagtccacatactcccttggaggccagaggctgccataattcagattacagagaggaaaatgcatcccattctctcactggtgtaatgcaaatttgaggatctagatgggaaaacgtggattgttttgcatcagctatcactcatgctgaaatctaggtagaggagcgtatgttctgaagggtggaggcagcaggaggtggcacagctgatgggtgaagccatgcagcaccctttcccttgggatgggctgttctttcagttaattgtcagctcagctgacaaaagctcctatgagggaactgaatttacaggttgactcatttctctgtagaggaccttgacttttttcttgttttattttttggctttggaaaaatagaggaatattaagtgtgacagcgaagacttaccctacgaattgttaattctgcagaatgttatgtggcgatgataacctgctatttttttttttttaaactggctttggtaatataggtggaataaagcaatcagcggtgttactaaagcacttctttgatctagctgggaattggcattttcttacgttcttcagcctgccattcttcatgttgacatgaaaacctgaaggaaacgtagttcagtggacttgtttctcattggggctttgtggtcctatgtcatgctaaatcatatttagtcaaaattgcccgtgaaatcccttgacttgctcataaagtaaagtttagtcagactgcccttattaagagcccgttttccttccagagttggaatagatttctgtgttttggatgaggaccacatgaagtagttggcttgtatttagaagctgtgttgtacaaaaactctatttcttagatcccactgaaggggctcacactggaagaggcgtgtgggaatgcgcacagttgagagcacagtagatttgtgttttccatctcactccctgtacagcatatgttcacaaagtaagactggtggctcgagctgcctgtatgaaatgtcaactgtcatctttctctgttctccatgttcgtgtgtgctcgctcgctctctctgctggatgtgtacagttgaatttctgggtataatgtgactcctctatactaataaggaattcctttactcagacctgtgtttaaatatttgtgattgtttgaaaaaaccttttatactgtgtgtgttgtgagtgagattgtgctcattccatccttttttttttttttttttttttttgaggtggagtctcactctttcaccaggctggagtgcagtggcatgatcttggctcactgcaacctccgcctcccgggttcaagcggttctcctgcctcagtttcccaagtagctgggactacaggtgcgtgccaccatgcccagctaatttttgtatttttagtagagacagggttttaccatgttggccaggatggtctccatctcttgaccttgtgatccgcccacctcagcctcccaaagtgctgggattacaggcgtgaaccactgcacccggccccatcctaccatttattgagcacctgttctttactactgactgggtattttatataattatttgtaagccttaaaatagtattgcaaggtgggtaacatttccttttagagatgagggagtgtaggtagacagtagttattttttggtcaagagagcatacttgatagagcctgtctctgagcttaattgcatctgtgttgcttgttaattcttaggaactttcattctattgtttactctataggagtttaatcaaaggcctacaaacctaaactacagcaagtctattctgtaacgtagtttttttttttttttttttttttggagacagagtctcactctgttgcccaggctggaatgcagtggtgtcatctcagctccctgcaacctccacccctcaggttcaagtgattcttgtgctttagcctcctgggtggctgggattacaggcatgtgccaccacacctggataatttttgtattttataattttgtagagatggggtttcgccctgttggccaggctggtctcgaactcctgacctcaggtgatctacccgcttcagcctcccaaggtgctgggattacaggtgtgagccaccgttcctggcctgtaatgtagttttgaattaaaaagagttaatatagtcttaatattgtggattcatatgcaaatgtttggtgaagctgaaagtcactaaaaggaagactctaagaaggtaagagagatcgttggacctacttaagctacttttaaccttttctaacccattggaatacctaaaatcctttcccttcttggatgttatttgcaattgcagaataaattaaatgttacatctgaaaccaaatcaattttagattgtgctcccgcagccaccaatactggtcctcaggtggtaaagatgacacaaggagtgaaggtgatgatggctgcactaattatggaagccagtatgtattgaacatcctttgtatgctaggcactagtgagtcctttacatgaatcatcacatttaatctttcagttaatcctatgagatagattatttgactatccttatcttatagatgaggaaactgaagccatggatatgttaactaatgtacccgcagtcagagccgggaagtgggggacgggggagttcagccgctgcagcccgactttgagtcccataatccctcattttgtcccacagagcaatatcaagttgacttttccaagatcttgtagctatttagttctaatcctttcgttttatagaattgtttggcttcttcatctgattttaaaatgttgtaacaaagttaatctaattttgcattatgattttttaaaaagtggcagacactcatttcttaggaaagtagttttgattcctttttttaaaaaaagttttctcctacgtgtattttgatagttttgattctttttttatttatttattttttatttttttttttgagacggagtctcgctctgtcgcccaggctggagtgcagtggcgcgatctccgctcactgcaagctccgcctcccgggttcacgccattctcctgccgtagcctcccgcgtagctaggactacaggcgcccaccaccatgccgggctagttttttatatttttagtagagacggagtttcaccgtgttagccaggatggtcttgatctcctgatctcctgacctcgtgatccgcccgccttggtgtcccaaggtgctaggattacaggggtgagccaccgcacctggccttgtttttttttttttttgagatggagtctcactctgttacccaggctggagtgcaatgacgtgatctcagctcactgcaacctccacctcccgggttcaagcgattctcctgcctcagcctcctgtgtagctgtgattacaggcatgcgccaccatgcctggctaattttgtattcttagtagagacagggtttcaccatgttggttaggctggtctccaactcccgacctcaggtgatccgcctgcctcagcctcccaaagtgcttggattacaggcgtgagccacggcgcccagcttaaaacaatttattgaggtttaatttatgtattacaatataaactgcacccatttgaagtgcataattcaatgagtttttgacaagtgtatgctggtgaaactacctccaaaatcaagacacggcacatttctatcaccccataagtagcttgagagagtatttttttgtttgtttgttttgttttgtttttttgagatggagtctcactctgtcgcccaggctggagtgcagtggcgtgatctcggctcactgcaagctccacctcccaagttcacgctgttctcctgccttagcctcctgagtagctgggactacaggcacccgtcaccacgcccagccaattttttgtatttttagtagagatgggctttcaccgtgttggccaggatggtctcgatctcctgacctcatgatccgcccgcctcagcctcccaaagtgctgggattacggacgtgagccatcgcgcccggcccgatagttttgattcttaatgactattagtatgtggactatggatagtgaaaaaactatattaaaaatagaaattttgtacctgtgtgtaacttgagcattaagcctgacttttatattcagggcaagggagaaagaatgtattaaacacagagcacattcattaaagaacctactcttgtttcataatcagtttggtgttcacatcttcatcaggtgaactgctataaggtttctgcattttaagttagtatttttaaggcctagagccagaaataattatgctaacacaactgtctgaattcacaaatgactatttcataattacgtatattagtactccatatatgttgtccagactgaaaattgttttgtttagtcattaattagctgtttgacttaaaatataactactgcattccctagtctctggatctagatttcacttggcattcttccaaagccaaactaatgcagcaccatgaaccttttataatgaaaatgttctccctaaatatgttcaaatcacttttgtgtgttactatttttgaactaatgttctttttttgtttttcctgtaatacacagtttctctagagtaagcaaacaaaatagaattctagtttgtactgatccttaaagaaagtttcatcagatgtttttagttggtggtagctttagagtgtcatattaaatgcattttttaatggtaaaaatgtctatgtagagagcagtataggttgatacattctaagccacaccaaagcgtctgcaggagaaaaaacaaaacaaaacttgagtaataattataatgctttttataggaggaaacttactctttaaaaatcttgagtactttttccccctaactttttatatttaggtaagaaaaatggcctttaacactgtaagaattattaaataataattaatttcaactgtttttaacatcaagccaccttatttttttttattttttttttttgagacagagtctcattctgtcacccagactggagtgcagtggcacaatcttggctcactgcaacctccacctcctgggctgaagcaatcctcccatgtcagcttctgaagtagctgggattataggtgctcgccaccacggacctggctaattttttgtagagacagggtttcaccatgttgccaaggcccatccaaacaactgagctcaagcaatctgcttgccttggcccctcaaagtgctgggattacaggtgtgagccactgtgcctggttaccttaccttttaaaaaatttatttagtctttttttggtgtcgatacataatcttgagtgtttcttgtgtttttaattttttttcctttgtgtaactttgtgttaggtttagggctgtaatttttcagtgattggtttttctagtgtatttatatgttatctctttgaaatatagacacacattttggggggatcatttaagactcttcagacttcctaaatgtgagctaagctgaaaagcaccagtactctaatcataaaggcaggtgagatatttcagttttgatggcgtggaaagtcagttaacctttaggtagggcttggttttgtttagcttttggcagggctagtggtttgaacggtcccagattattttgttccaggcagggcttttctgattaaattgcaaaaatgaaaatgcatataaacaacacagagagccaagttttaagagtgacattatgtgatttttgaacacagtatatagtacgaagtttcaaattaaaagtgatacttgtgtagcagttaggttaaatatagttcctctgtttgctttgctagtgtgaagtgagatacatgatactgaaatacaggtaggcacaagcctggagatcaggcagcctgtgtcaagtgtgcagtgcctcagcagcagcagcagcagcagcactccacaggatatattgaaaagctggggcggaatgtcctcccacacaggtgaggggagacaggtgaaggcaggtttgacactgaggaatagtaagagaagtaaattgcaccctcagagtacagcaatatttatagcatttgaataagatgttaaagaacattttcttttaaggaagaaattcctgtgggtcttcctcagtttcaatctaaactagttttattatactattacttcagcatgtggcacttaacctggccatagtcagtgttcaataaatatttgttggatgaattaacgtaaaaacacaaaaaactcagtataaaattaattcttggagttcttttgcaaatataaaactcagatatatgcattacataaaaagaaaatacaaaactaataaagttttatattaacagggttagttaaatgcaatagatgatgttttgccaaaactaaattgtctcgcaacatgagtatcatactgactgttctcaagcaggttcttttgaatttggcatgcggtactatcttgtgtcctgcaattattttatactgagaagctgttttttacatatcaagcatttgtataagtctgtcattaagccttggcacaaatacatcatttagttttaaattcacttctggtttttctcattagcccaagaaaaatttaaatgacactactgggtactaggggaaacgtaaccacaaatcacaaacttgagcaatgagtttgtgtgttagaacatactcggttcaggtgttactttttcagattatacattaaattaagatgcaaagttaaaaattttatatggacttacagccccttgataatacttccacagagccgcagttgagaaacactgctctcttggaaagggtgcagagctggtgtcagaagcagattcgagtcttggctctgccgctactcagctgagtgttgggtaaggcacttaacctacttggcctctcttgggtcttaggtgatggcgcttggtgacctttgaagatttgtctttgaagattattgttgcttttgaaggttttctttaggaatgttggactttccagggaggcttgggtccagcttcggagtttatttgattaattttttttttttttttactgttaatcatctttttacttacttttaagttgtacaattcagtagttgtttatttttatttataaatttaaaaatttattttttaatttttattttattttttgtttttttttttaaaaccagaacatttactgcatgactaattgttgaaattcttaagctgatcaaagtgctccaacagctgccctctttggtttaggtgttgtttcctcacggagtccatgcctgaatctgtggtgtacaatttttaggtgcctcgttcggccagtcctggtggcattttgtcttttagccttggcactccagttatacgtcctcctgcacttggcggggtagccacatttgccacaggtcaacttctgaaggtggtaggccttcacgccacagcggtggcacaatgtgtgtgtcctattgcaacactttccaaacggtcatctcacttctgtggctgagaccagagagacctttttaatttttttttttgagacagagtcgtgctctgttgtcctggctggagtgtagtggcgcaatcataacttaccgcagcctcgaccttccgggctcaagctatcctcccacctcagccttctgagtagctgggtctataggcgtgtgccacgcccagctaatttatacattgtttttggagatggaatctcgctcgccatgttgcccaggctggtcttgaactcctgggctcaagcagtcttcctgcctcagcctcccaaagtgctgggattatgggtgggagctcccgcccacactcggccaattcagtagtttttaatacatctacaaagttgtgtagccatcgccactacctaagttcagaacatttttcatcaccccgcagccttctggactgagtggagtcagcatgctcaggggttggcagcatctgttcagggggctcgaggttcttctttggtgtcttttcaagtttctatacctgtccagtactgaagctggaattggagattgaccttttgtccaagtcataacttaatatgctatttcctgaaactgcttttaagaaatgttaaggtgcaaatgaggatccagtttgggcccacatttttctaagttggatgaagagcagttgagtggagtttctagttgcactcgagactctgtactgtgcagacagtttattggtggagttgcctcaggataaaaatacccagctcttctcagtagtgggtgggagactttgggtgatggtgatttccgtaaaggagaagctgagcctggttggaaggaaaaaggaagaatatacggagaggctggcattctttagctgagtggatttaggcttgagctggagtcagaatcacctgggaggcttgttcaaacacagattgctgggccccatccccagagtttctgttccagtaggtcctgggtggggcctgaggatgtgcatttctaacaagtgcccaggtgaaagctcacttagaggaagaatctcagcctcctggaagtgtgttctaattaacttcactggactgtaggctcagctttgccatccccataccactcatgcatgttttggtgtgctttggctacataggttacagttgagctttctagagcttttttctcatgtctttagctagtaggcacctaaaagttgtagaatgcataggttttatttttggcatttatctgaagtatctgttcatgtcttgacatataggaagctcttttaaagtttgggtggcagtggagagggcatatagaagcatattctaatttttcaatgttttttgaaagggtagcatgaacaatagtctccccactccttcttcatatccgtttggctcaagtagctgaaaacagcagaaccttaaagctgagtgtcacagtctgcctgcctacctgcctgtctacctgtctacctgcctatccagctacctgcctacccaccttcaagtcttttcgaatactgcctaccccaggtttctgatgataaattctgttatcttggtaattatgaagttattttgaaggttttaaaagaagctcctaaaaaataacctaagttttacagtattagtgcttttagaaagctggaaaagcaagtgaagaaacaacaaaaagaaatcctttctagatggatgagaaaccacagatgggttggggtgaatgcgatgaaatagaaatgtgtgtttgggagagtgttttctctgtaaggaagaatattctctgtaaggaaggcaggctatgtggctttcatgaggtcttcttagaagcttctgtggtaatgttcactggtctggcgaagggggtagacttgaaaaaattgtaaaatggcgagaacctggaatttacatttggggagaaaagaaactgggaggcccttcagctctggggaattggacaaggtgaagcagagtccacatgtgtgtgtatgtgtgtgtatgtgtgtgtgcatgtgcgcgtatgtgcatgcatgtgcactcatccaggtggggcgtctgcggtagcaccgaggtggattctgaggcaagcttcatttggccctgagttcattttattgtgactccaaaggagttcatgggggaaataaaggctctcatgtgcaagaaacaaggaagcagaaaagtcatttgacctaggctagaaaaggcggccacctctagtctatagtcagaagagaagcagctgttcagaggggctgagacaggtaatgctggtcccaggccaagcctcttgaggaaagagaacaacattccgaaattctgtgagtagctcataccctgaaggagttcttttttttttttttttgagatggagtctctgttgcataggctggagtgcagtggcgcaatctcggctcactgcaatctccgctcactgcaatctccgccacccgggttcatgccattctcctgcctcagcctcccaagcagctgggactacaggcacgcgccaccatacccggctaatttttttgtatttttttagtagagatggggtttcactgtgttagccaggatgggctcgatctcctgacctcgtgatccacccgcctcggcctcccaaagtgctgggattacaggcgtgagccaccgtgcctggcaggagttcccttttaagatcgctgtaggaagagtcagaaggtcaaggacaaggcgccgaggtgcctaccctcttagtactttgtgttggggagtggaggctgtccagagaggctggccaaggggaggctccccctgggaagatggggatcttttttaggtggtgctgcaaagggacactttttcagagagacaaggggaaaacactcgcatatatttacttctttagaagttgagaaagttaaaagaatgggaagatgccatctgcttcccatttctgagaaagggtacattaaaatagcttgaaattaagcagaatgtataaaattaacgtctgagtatagtcatttcccgtttttcctgacacatctttcagctgtgtagcaacagatccgcattcctggtgtcagaagacagttgttaatgtgctagttaaaattttattttatttttgtactgttgagcaaaatttagacttaactctgttttatttaagaagcatttttgttaaatgctttaattattattaatcaaatttttttgtatttaagcagttttcaacaatctattcctcaagcaattcagagaacctgctgtgtggtgattatgtattttttatttcataaatgggggtagtgaggcataagtgttttggaattagcatttgtcatcatctaatatactgtgtaaattacatcttttcactgtgtattgtctggctgccactgctagactcttaagttccaggtggacagggatcttatgccaggtggacatggcatacatgtatgtatggcaggcactgttctaagtatatacaatagtccctggagtgtccagggactgttcattgaatgaatgagtaaagacttctgtcaacaaatatcatttagtctagtgctcaagtgggctgtaatactctgtttctgaattaaacagtctggcttggtgatagtcactgacagcaccaagcagatccatgggagctaccccagaaaagcttgtgatgcagaggagaggagcaaaatgtgcgctccctgtgtgcaaatggattcccacaaccacggaaggaagaactgcggcagacatgcttggttcttaatctcagactcatcagtcagggaattcactcctgtctaaggggcgagtgagggtgaggcaggaagccagcatgtcccctgtgaaggagctctttccaggtagaagcatgaagcccaggaaaggcaatttatacagcacatcaccaatagagagatggccaaaccactctgaactctaccatctgaagtgaacaatttctaattatgtatcttcagatttttttctttcagatttctttctgatatatgtatctacagatatttctctgtgccggtgtgggcattttttctatatttattaacccagaataggtttactgtacatgtagttctataacctggcttttctcttaatatgttatatatctgttaggcattttttgacagtgatccacagcatcatgtttgtttcttgattgactgagacagattctctctctgtcacccaggctggagtgcaatggtgcgattatagctcactgcagcttcaaattcctggacccaagagatcctcctgcctcagcctcctgaatggttaggactacaggcatgggacaccatgcctggcaacgttttttattttttgtggagacaggatcttgctgtcttgcccaggctggtcttgaattcctggcctcaaatgatcctcttgcctcagcctcccaaagtgctgggattacaggtgtgagccatcgtgctcagccaacattatgtttatcgactgtttattaatgttccatttaattttggctgggtatggtggctcacgcctgtaatctcagcactttgggaggctgaggcgggcagatcacaaggtcgggagatcgataccatcctggctaacatggtgaaaccctgttcctactaaaaatacaataaattagctgggcatggtggcatgtgcctgtaatcccagctactcgggaggctgaggcaggagaatcacttgaacccgggaggcagaggttgcagtgagtcgagatcgtgccactgcactccagcctgggcgacagagcgagactctcttaaaaaaacaaaaaacaaaaaacaaaaaacccccccaaaattccatttaatttaatgccatcatttatgcattcagcaatatttttgagggcctactatgtgccaggcactagttggagttgctgagggtataagatgaggttccaattctcatggagcttatcgtttagagggaaaacaatacaaaagtaaacaagtaggtgaggatttctgagtgtgctaagaacaaagtagagcagggtactgaggtgtgagcacatcagtagatttcgtaggaaaggcctttcttaggaagttatatttgagctgagaactgaatgataaaggaaagccagctacttgagtatctgggggaggaatattctaggcaaaggtaatagcctgtgcaaaggccctgaggcaggaatgtgcttgctttgaggaaatgtgaaaaaaaaagttgttgattggaacagtgtggggatctggcagatgagctgggtgaggtaggtaagggctagatcttgttgtgccaagtaggcataaagagttgagattttgggtcgggcacagtggctcacgcctgtaatcccagtactctgggaggccgaggtgggcagatcacctgaggtcaggagttcaagaccagcgtgaccaacatgatgaaaccccatctctactaaaaatacaaaattagccgggcgtggtggcacatgcctgtaatcccagctactcggaggctgaggcaggagaattgcttgaacctgggaggcagaggttgcagtgagtcgagatcgtgccattgcactccagcctgggcaacaagagcggaacaccgtctcaaaaaaaaaagagttgagattttgttttaagggcaacatgaagttattggaggatgagctattaggaagtgagcaacataatatgaagctttatgttcaaaggctttcttggctactgtgtggcagtcaggggaagcagagagaccagttaagagtctgttgcgataactggtgatcttggtaagaaatgacggtgggggtggagggagtgagaagtggatgtatttcagaggtggagctgtcaattcatgggattggatgtagggggtaaaggaaaggagaaattttgtggcctcagctactgcgttggtgctggggctcgtcagtgagacaaggaagtggagattaagagtgttcttctgggatgtcctggttgtgagatgtctgttagacaccagagtgatgatgttgaataggcaacttccataagtctggggagaggtcctgtctggagataaaaattggagagccgtcaatgcgcaggtgacatttaaagccatagactaggtgagatcacctgggatgcagaagatagatggagaaagggagactaagccccgagcagtgcaggaggagccagcacaggaggctgcaggggagccagggaggcagtgctgaggcaggcaggtgtgaagtggaagccaggagaaggacatgttttaaggagggtgcgtcacttttatgtttgctactgtaaccagttatcacaaatttagtggcttaaaacaacacagatttcttaactgttctgtaggtcagtcatctgacatgggtctcactgggttgccatcagggtgccagcagggccatgttctttatggaggccctagagaggaatctgtttccttgtttgttccaccttctagagtctgcttaatgttccttggcttgtggctccctccttcatccttgatgccagcgacgtagagtctttgtgaccctgctctcttctcattcactcaccctgacctcttctgcctctttcttccacttttaaggacccttttaattacgccgagtccacctggataatccaggataattttcctattttaaggtcagctgattaacaacctaaattctatcttcagccttaattcccctttgccttgtgatgttatttatttacaggttctggggattagggtgtgtatatctttggggttcctgttcttcctttcacagagggtatcacaaaggttactgggaagttggataaaatgaggacggagaagtcattgttggatttggtcaactgattagtaacctcaatgggtggttccagtggagtgttggtgcggtggcccaatgggagtgagttgaagagccagcgaggtgaggacgtggaggctacacatcttaatggttcttggtggcagttttgctttgaaggaaagtaaatagtggcaagaattacaaaggaaaagcacagaggacagctctgagaggatgaaatgggagacggaatgtggaacagaggttcagggacgactgctggaaggaaggggcattagtgtagtgtctactggaagagattaactggatgaagaacctggagtgaaaccaagaaatggtttatagggatggggacatatgaaagtgaaattcacagggttatttttaatagaacagcagaaggtactgatgactcctgttgcttgcgcctgggtcagtggacaggatccttgtcagcagccactacagggcccgcaagcccacctcagatgctgtcattccacgggtggtggccaaatctttgaagtcagtgtagaacctctgccctttcttcctggggagcctggatcagccatgatcttgcccagactcagcgccatggtggagggacatctcctttcctctcctgccccccaaccacttcccttacacttctgctcttctctcctcacccgctaaattgtaggcctgcctccatttctttctttactttgttacgttttaataacatttattcactccacaacatgctcacagaggtggaagaccaagttagtgcagacccattcattcctggacccagtggctctcaagtgggagaggtgctggtcttaaagggtgtttaggaacaagtgggcgtcatagtgagtgtaaaaacgccctcgccgtgaggctcagaagagccaggcctcctcctgctcctagtccagtcagtgctcctccttcatatgggtggttcgcagccctgctgcatgttagactcaccaggacagatttgtaaacatatcacgacctgggccctaccacaaactaattcaactggagtctcagggatagggcccaaactgaggattttaaaaagctccctaggagattctgaagtgcagccagggctaagaactacagccttaaatctactgttgactgctttcaaaagaagtcttcactgtgcttaaacaaattgtggttaaaagtaagcaaaagggccaggcgtggcggctcatacctgtaaatcccagcactttgggaggccgaggcaggtggatcacctgaggtcaggagttcgagaccagcctggccaacatggtgaaaccacgtctctattaaaaatacaagaaaattagctgggcatggtggtgcatgcctgtaatcccagctactcgggaggccaaggcaggagaattgcttgaacccgggaggtggaggttgcagtgagctgaggtcgtgccattgcactccagcctgggtgacaagagcaagtctccatctcaaaaaaaaaaaagaaggaagcaaaaggaaatctggaggggaacatttgtaataggcaagtggtcattattaaatgtacagttatattattaaaatgtagatcatttgaatcaactgacacgtctgaatttggattaaaactcctaagcagtatacggtactcaaagcttggtactggtagggcacagtttgttcatttctgtttttcacgttgccttctttacacttttttcctttctgaatagcctaatatgacgaagcagctatttgtaacatgtgggaattattttttcttcttttcctcccatagtctgtctccatctttgagctgctgttctttctacagcttaaggttcttagatgtccattccattccctacccagtcttggaacactgtgagatgagcattcctgataagtggtcatccaatttggaaagacagtattttacaaggtgatcagtttctgaggaatttcagttagaaaactttgtgtttttggtttggtcagggaaagatccagaaaagtgatcaagaggttagctcaaacctgatatagggagttctcagaatagagattggctgttaatggtctcttataattttttccttgaggatagttttattagtatgagagtaacttaaccatcctcattgtgcagttcttccgcctcagtctcccaggtagctgggattacaggcacgcaccaccatgccctgctaattttagtatttttagtagaggcagggtttcaccatgttggccaggctggtctcaaagtcctgatctcaggtgatccacctgcctcagcttcccaaagtgctgggattataggcatgagccactgcgcccggccccaaacttttttataattctctatgacattgacatactcccacaacagcttcagtataatttagatgcccttatacatctgcgtggccaaattaaaaaagacaccatcaggtgtcagcaagaaacagagcagggggagctttcatgtactgctgatgggaatctacattagtttaaccactttgggaaactagaattatctatgagagtggaagatttgcacaccataaagcccagcagttctactccttatgtatattcttgacagactgtatagctgtgaaaactaatgaattgatgaatattcaagaagtgagtaactctcacaaacataatgttgagagaaagaaaccagacactcagaatatatattgtttgattctgtatacaggttcaaaacaaaggcaaaattaatttatggtgttgcaagtcaggagatgtagttacctttggagagtagggaggatatattagcagggcttctggggtgttggtaatgttctttcttgatgacaggtgtgatacacatgcacacatacacacaaatatatttacaatttgtgctgtttcctgtttgtatataatattttaataaaaagttcactgaaatggggctgggcacagtggctcgcgccagtaatcccagcactttgggaggctgaggcaggcagatgctggagcccaggagttcaagaccagcctgggcaacatgacaaaaccattgcattacaaaaaaaaaaaaaaaaaaaatgcaaaaattagcccagcatagaggtgcgtgcctgtagtcccagctacttgggagcctgaggtgggagaattgcttgggcctgggaggtggaggttgtggtgagctgagattgtgccactacactccagcttgggtgacagagtgagagagaccctgtgtccaaaaaaaaaaaaaaaaaaaaaaaagtttactgaaatggtatatggtgtagagtagattattgaacagcagtgagaaatgagcaaaatacagctacatgcagcaccatagaagaagattctcacagaatacatacgatcagattctagttttctaaagttcaaagagtcaatgctaagctattgtttaaggacacataagtaactcgtggatatcagtcaggattcagtcagggaagcagaaccactgtattatgtaataagggatttattttttatagcaataagatattttacaactgtggggaaaagctggaaaaatgacagtctggaaggaagaattagaggaccagagaagagccacgaaagcacctctcctgaagcacctgtacgggtggctgagttagaacttgtgggaggctctgagaagccaggcatgagcagctgctagaacgggaccacaaaggaaagctgatgaaaaagtctatgaaaagctattacctctgcatagcaatcacttctctaggtctgctggccagcagctgatggtccaggggcttctgttcgctgacaaggccggcagttgggggaaaaagctagtgacagaagcagcacgtggacaagctggaaccctctggcatctccgtttatatctgctaccacctctaactacctcggccctcaggaagtaatggtggttttacttttcgctttttaaatcttgtccagattcagggaagggaatcctgagaaaattctagcctaaccaaattgagttaaaagctgcaatagtgatggttgcacaactctgtgcatatattaaaaaatatactttaagtgagtggactttatgatttgtgaattatatctcaataaagctgttatttacttaaacaaaactgccacatgttgaaaactttaaagaaacaatgttaccatggatgatttaagtgctgcttcttggagatatggaagtttcagtttagtaattgcttcttagcaggttgtatctatgttactctacactgctattctttggaaagctagagcgtagtaactaagatctgtttgttaatgacagacctcaaggtctcctgacaggtctgggaataagttttgaaaataggttaatgggatattgtattagtccgttctcatgctcctagtaaagacatacctgagactggataatttataaaggaaagaggtttaatggactcacaattccacatggctggggaggcctcacaatcatggcagaaggcaaaggagaagcaaaggcatgtcatacatggcagacgagagaatgtgcaggggaactcccgtttataaaaccatcagatctcttgagactcattcactaccatgagaacaatatgggggaaacagtccccatgattcaattatctccacctggccccgcccttgacacatgggaattattacagttcaaggtgagatttgggtggggacacagccaaaccatataagatacattttctcacttttcaccatgtatatttggttttaaaatttgaactaggatttctttacttatacttaaaagtaggttttacagattcattaaaactttcatatcaaatctgttttgataatctgagatattctcatcatctcaaactattggaaaatgcccttatctactctccatttacgtggagccacttttcatttgaatgtttgttatggctctttttattctctttataaggagacaattgcccaaataaagatatgcagctttcctgcctggggctgtagttgtaccatagtaaggaaatggatatgaaggttttttaaaaagttcaaaaacagagtagcttgtatcatttatatgcaaaaactagaaacatttttagctgtagttacgaagacttctagctttttgtcaactttttaactaaaaggagtcccaaaacacaggttatttctacatggattaaatttataataataaagaatcattagtattactaaaccatattgacagaattcttgctaaaactaggctagacagacaaggatggatactgaaggttgacactgaagacctagttgggaagaggattcagaggagcttggctagagtttggtcaaggagacactcttggtcagtatgtaagtctggctaattggaagtaaataaaaggcagccatagtcttggagggaagacagacataaaaaatgattgcaatatggtataaaaggtataatagaattataaagtatgtgtgtataagatgtatctgcggcaaaaaggagcagtgatggtctgcttgagcacatgaaggatggatttttttttttttttggagacggaatcttgctctatctcccaggctggagtgcagtggcgccatcttggctcactgcaacctctgcctcctgggttcaagctgttcttttgcctcagcctaccgagtagctgggattataggcttgtgccactgcgcctggcttatttttctactttttagtagagatggggttttgctgtgttggtcaggcatgtctcgaactcctggcctcaagtgaaggatggattttttttttaaaaatgacactaaagctgtattttgaagatgattagaaagtttgctaggcagacaaagagaatcagcaagaaaactttctgggctgaaggtactacgtttagtcaaactattaatacttcctttcctgtgcaaaggaacggaagaaggaagtagtttgagttgcttggataattcgctatggctagtttagggtttaaggagagagatggatgagttaaggttagagagtagcagctagatcatagaaggctatgtatgccacgttgcgtttaaattttgtttttttttttttgagacagagtcttaccctgtcacccaagctggagtgcagtggtgtgatttcggctgactgcaacctctgcctcctgggttcaagcaattcttcctgcctcagcctccctagtagctgggattacaggcatgcactgccacccccagctaacttttttttttttttgagatggagtccccctctgtcacccaggctggagtacagtggcgggatctctgctcactgcaacctccgtctcccgggttcaagtgattcttctgtctcagcctcctgagtagctgggattacaggcacgcatgtggcacccagctaatttttttttttttttgtatttttagtagagacggggtttcagcatgttggtcaggctggtcttgaactcctgacctcgtaatctgcctgcctcagcctcccaaagtgctgggattacaggtatgagcctccgcgcctggcctaagatttttatttctagtagaaaaagagtttcaccatagtgaccaggctggtctcaaactcttgaccacaggtgatccacccacctcaccagtgtgccaggattacaggcatgagccaccacaccagcctgggtttacattttaacagatttttttgttgttgttttctttgaaggtctcactctgtctcccagcttgatcatagctcaccatagacttcaactccttggcctcaaacaatcctctcatacctcagcctccagcgtggctgagaccacaggggtgcaccaccatatctggctaatagttttatttttattttgtaaagacagagtctccctacatttccccggccttgaactcctagtctcaagtggtcctcccgtttcgtcctcccaaagtattgggattacaggcataagctactgcatctggccttttagcacagtttaatcagaagaggaaaatgagcagatttttattttatgcagttaccctgtggaccatgtagagaatggtttggaagaacgctgggagtctggtgaggaatccatcccagaggtagtaactaagacctgtttttagacattggcagtagcgaaggatctgacttgggaggtagagttagtagcatttatgtgacctctaagacgtgatcctgtcacactttttctctactctgttaggttcagtacttgagggcctttgaattaaactgacagatgatagattagcaagagaaaaggtagattttaattttgtaaatacttaggggagttcacaaataaatgtgactgaaaagagttgttagaatttggggtttatgcaccatcttaatagatgaagaggagagggagaaagggtacttccgggaaaacaaagaactatttggaaagataaatgggctcataggagaataaatggaagctgtatattttcgtgacattttctgtttggttgtcttctcatctcagatgattagagttgcccctgtgggaaagggttcatgacaattgagttctttgagttcttttgggaggctctgcttttaggcagataaggggtttcaggaactcaaatgccttcagctcaaaataatttttatgctatagtggcttattctggatcctttcacggtgaaggagaggagaaattcctgagattctggtttgagtgatggtggtactgtagataatgaaatacataaagaagagcaggtttcaggacatactgtattttcatttgtatggttgagcttggagcacctggggaacatctagagatcctagaaagcagttggatgtagatttgggacctagagagagctcaaagaagctgagagtacggataaaattttccttggagagtaggagaatgagagaagaaagagcttccagaaatgaactgaaggaggctggaaaatgagagaggatgaaatgagagaggggacatagaaaggaaattgagcctacaaaggagactaagaaggaatagttgaagatgaggggagctgggagagttacagaaaccaaggcaggacatagtagcaaggagactgagcaatagggatcagcagtgccaaggtgcagagtaaaattatagaagtgttaaggaaaaaaaaaattatatatatatatatttagtatatgataaaggtacagttttgaggaggaaatggagggctgtttatttaaatggacatttgggacaattggcttaccacttaaaaaatattaggttaggccggatgtggtggcacatgcctgtaatcccagcactttgggaggctgaggcaggaggatcacttgaagtcaggagttcaagactggcctggccaacatggcaaaaccccgtctctactaaaaatacaaaaattagccagatgtggtgacgcatgcctgtaatcccagctacttggcaggctgaggcacgagaatcacttgaacctgggaggtggaggttgcaatgagccgagatcatgcaactgcaatccaacctgggcgacagagcaagactttgtctcagaaaaaaaaaaaaaaaaaaaagttagtttaggtccccacctcatgccttataccaaaataaatctaaaaattaaatgtagaaattgaaaatagtaaaaatattaggagaaaacgtgggtcaatacttactttgtgttcaagttaggaaggaccatacccattctaattataacagaaagaaaagactaagaaattttcatgtaaatccagcatgtctgtgtgctaaaaatatcataaaattaaagtgtaaatggcaaactaggaaaagtatttgccatagatttgacaggcagaggtttaatatccttcatatctaaatgatctatcaaaaaaatgaataactgaaggtttctggttaagtaggactcattgaagatgtctttatcttccatccttccaaaattttgataaaatgacaggaattacagaaggggtagacccacaaagagtgaaaaagggagagtagggaagatttttctggttgatgatagactaagttgttgggccttatttcctgctgagagcaagtcgagatgatggacaaaatttaaaacaaaatttatgtgaaggaaatggagagttaacaaaatagtgaagatttgtgggtgtaagaggtggggcgtggtgatgaggtagggaagcccaagatgtgagaccagcatttgcagtcatttctttcccagaggaatctgctcattccagaagaattaggcagatgagaagctggacggctgaacagagtttttgttagactcagagggcggaggacaaaaattggagtttggctcagatcagggagcaggaaaacttcttaggctttgagtaggagacccaaaagcctatatcttagagatagtagctcctaacaggtattgaagtccagctccagaccctctcagttcctggctggatcaaggtgttctggaaagaagcaagtataatttctttcattaatagaagaagataacatcactcagaacctcagatgagctctatgtttatttacaatgtttggcactcagaaatcaccaggcagatgaggatttaagacaatgttactgaacgccaagagaaacaacagactatggaagtggatcgacagggatccagatagtgaagttattagaaaagggtaaggtatgtagtatgtttacggagttaaaagattaagaatagggaaattggaaccacaccaccccctccccagtagaaaaaccaaatgtaaactgtagagttaaaggactgtaaatgaaattaagatgtcagttaatgggtttagcagtacattagtaataagtagaaaacaaatgttcagaatgaaatatggaaataaaaatggtctggacatacattatagagtgagtcttagggattctgtggaaaggtctaaccaacatgtaattgaaatcctagtaggaaaggaaggaggagtgctgcagaagcagtatttggagtgatgatagctgagaattgttcataacaggcaaaagccatctcatcacagatttaaaaaatactaccagaaatctaagataaggagaacattttaatagtaaccagaggccaggtgcggtggctcactcctgtgatcccagctctttgggagactgaggcggatggatcacttgaggccagaagtttgagatcagcctagccaatgtggcaaaaccccatctctactaaaaatacaaaaattagctgggcatgatggttcatgcctgtaatcccagccacttgggaggctgaggtgggcagatcagttgaggccgggagttcgagaccagcctggctgacatggtgaaaccctgtctctactaaaaatacaaaaattagccgggcgtggtggtgcacgcctgtaattccagccacttgggaggctgaggcacgagaattgcttgaacccagaaggcagatattgcagtgagccaagatcccaccaaagtactccagcctaggtgagagtgagactctatctccaaaaaaaaaaaaaaaaagtaaccagagaaaaactacgtactacattgaaaagagcagtgagattgacagctaatttctcaatagatgtaatagtgcatccttctcagaaggcaatgaactaatgttttaaaaatgtaaaaaagaaggtaaacagccaaactagaatgttatacccttcaaaagtgaggacaaaattatcacttctttagatcaacaaaaatgagaaggatttaaaagaaaaagccaaaaccccaattctctttcttctacactcacaaaacttctcataccaaatgtgtagggtttttttcataccaaccaattctccagttctctgtggactccgggtattctgcaatttaactcaatttggatactaactgcctggaattacttgcttcacaggttgagagcttggcctcacaagattgcttagaaaccaattgcaagtccaggtctccgatatttcttaccgactgctatgaagtgattcctataaccccctcctcagattcagtgatttgctagaatggctcacaaaacagggaaacatttacctaggtttacctgttgattatacagaatacaattcaggaacagctaaaagagagatgcatagggcagggtatggggaggaactcagaacttgcacaccctctccaggtgagtcaccctcccagctcccctatgtgttcaccatcccggaagctgtctggactctgttgtttgggtttttatggaggctctattacgaaggcatgattgatcaaatcattggccattggccgttggttattgaactcagtctctaacctctctcccttcccaggaggtggtggggtggggagcagagtgacaggggatgaaagtctgaatcctctaatcacatgattggttgctttggtaaccagtcgccattctcccgagagtcctctcatcataaactcaggtatgtctgctcttcttactaccgtgtttcagggctcaatgccaggaacttgaaatgaagaccaaatatatgtttcttattatatcacagtatcacagagttaattacaccagacctgcactaaagggaataatagaaagattggtctttggcagaagagaaatgatcctgcatggcagctttaagatgcgtggaaaagtgaagaccaaagaaaggagaaataagatggtaaatgtaaatgaacactgttgggtaaaataattatttgtggtttaaaatacacatagaatttaaaaatatagtagtagcatataagttgtgggggtgttaaataaaagttaatatcttacggtcttttcattgcccaggaagtggtaaaaatattaatttacttgagactttgataagtcaaggacacatgttgtaatctctaagatagtcattaaaagagtagtaaaatatatgtaattaacaaattaatagaggggaaatatggaatagtaacagcagtagtagtagtaaaacttgattaatctgaaagaaggcaagacgaccaaaaacagaaacagagcatgtgggaaaaataggaagtgaacagtaagttgttagatttaaacttagtctatcagtaattatattaaataaaaatgaaccaaaatttctaattaaaaagcaaagattgggaaattggataaaaaatcaaagcagatcacaactctgtaccgctttcaaggatgtagaaaagttgaaaataaaatggtagaaaagccatattactcaaacattaaaagaaaactggtgtacctttattaacaaagtgggctttagggtagaaataattgcttgggataaagacatacataatggtaaaatactcaattcagttctccaggaagttacaacagttctacctctgtatgtacctaaaaacactatctcaaaatacataaagcaagaattaacaaaaatgacaaagaacagacaaatctgcaattcatagtggaaagttttaatataccgtcttcattaactcagaaacaaagtatcagtaaggacatagaagatttccataacataatgaacaaacttgacctaattgaaatctcagtgggtttatgtgtaatctagacgtactactgtcctgtgcttcataacgatgtttcagtcaacaagggactgactaaatatatgatgctggtctcataagattttattggaactggaaaattcctgtctcgtagggatgtcatagtgtcatagtgtaacacattactgtttctatgtttatatgtgtttagatacagatacctatcgtgtcacagttgcttgcaatattcagtacaataatacgcagattcatagcccaggggcaataggatataccatatggcttaggaatgtggaaggttgtactatctaggtttttgtaagtacatctttgtgtaagtacgtttgtgtaagtacattgtcatctttgcacaatgatgaaatagcctagtgatgcatttctcagaatgtatccctgttgttaagcaacaaaagactgttgaaaataagatacattcaaaatgaaatatggaatataatgaaatatgaaatacaacactgcacccaataactgtagactgtacattcttttcatatgcatagggaacattgatcaaaattgttgatttatagagtaaatctcaacagatttcgaaagactaaattcagaatatcatacttacaaagacaggtttaatatttgaaaaattgatcagtataaatcactaaattaatagagtagagcagaaaaatcatgtgataatgtcagaggtgcaaaaattgcctttggcaaaatccaatacccattcaaaatggaatctcttaatacattatgaatgaaagttaacttccttaatttgataaagattactcagaaaaatcctatagcaaacaccatgtttactggtgaaatgttggaagttttcttttgagacagggaaagagaagttgttttcactgtcaccaattctgtttattattttactggaagtcctacctagttgagtatggcaagaaaaatagtacagggatgagaaagggaagaataaaactgtgattttgtagatgacatgattgtatatgtagaaaattaaaaaaaacctctttataacttattataaataataagctaggttgcaagattcaaggtaattctggacacaattgcaattttatatgccaacaacaaacacaaattccaaatttgtatcaatctggatccaatcaggagagagaaaccagttgtattagtttgtcctcatagggctataaagaaatacccaagactgggtgatttataaagaaaagaggtttaatttgttcatggttccacaggcggttcaggaagcatggtgccggcatctgcttggattctgggggaggcctcaggaaacttacaatcatggcagaaggagaaggggaagcaggcttgtcttacatcgccagagcaggagcaagagagagagagaggaggggaggtgctacacacttttaaacagtcggatctcctgagaactcaatcatgagaacagtaccaaagggacggtgctaagccattcgtgaaggtgcacccccatgatccagtcacctcccaccaggccccacctccagcactggagattacagtgtggacatgagatttgggtgtggacacagattcaaacttcatcaccagtaaattgaaagcagcgtttaatgtggataattactaattataacagggaatcgaagtaaggagggatttggttaggctagtgaaaagtgaagagaattgtaaagaatatgaaaatagcagataaacagagcaactgctgcccctggggctgaggtagagtctgcaaggaagagtctctccttcccccaggaccaagatccagacctcatccagagagggcatggctggtttactgcatggccaagaagttgctggcatgtcatactagtggaacttaatggaaatccaccctctgatacctgccagaagttgctcactagggcgccacacaaaagctcttcatggggaggtgtctcactggaggtaccctgctacaaaacctccagagtgggatgctggggggagctgctggctgctgggtatggcctgctgttgtgtgctgtagtctctggaggctggagcagctgcaggtgcttgtagagatgggtactggagaagccacctgcgttgcaggagctggacgccatacaattaacacaatgtagagcaatctggaaggctgtatatatcaagatggccaagatggaaccagtgtttttttttttttttctctgtgacagatagaattatgatgcttccccctgccgcttttttttttttttggtattcattcagcatttatttaatgaatgttgagtattttctctattccagacaatgtgtttgttacgagatacataacagcagacaaaatagacattgaacttgtttttgcagtttataggctgataggacagtcagtcattcatctgagctcttttgtgccaggcactattctagtcactggggggatagatggatagattaaatagattggttagatagatgggatggatgtatggatagatagatggatcaagataaaatcttgctttcaaagggagacagccattgagcagataattaattataagaatgggtacatacttacacagtgctataaagggtgtaagaaggaaaaatacaggctgctacaagagaggacaatgtaattcagatgagaagccagggcagacttctcttagaaagtgatatttttatgatgaaagtgatgaggaggaggttagcttggtgagatgagtgatcagagaagaatgatctagatggaggggaggcttgcgggcagacttcatgatgggaagagctcggcatgtctgaagtgaggagtgggaggtctctagagggtagggggaggtagagagtggcaggagaagaggccacagcaggggtcatgctactcacagccataggccaccttggaaactagggtgtccctgtgaagggttgcccgtgatagaggtctgaaataggagattcttggactgttttgctatttacagccaccgtgtggggtgctgagtggtcaggggattggaggcaagaatggaagttgagagaccactgggtgcaatttgcaggaatccagtgaaagttaacggtggaggtggcgccaaggcccagcagtggagctggagataactggatggcttggagatggggtttggaaatagagtcattcagaactggtgatggattgagtgtgggctgggagagacagggagacattgagaataactcccaggtttctggcttaagtcattacatggcatgtgatgccattttctgtgtacttttgtagtgaatacgaattacttgttcaattaaaaaagtaaaataagtttggatttgcagatgaagaaggctttggtgaccaaacaaacaaaaccaaagcagttgcagtgaaagtgaagaggtggagatagttgctacagactactgcagttctgcatcttcaaagaagccagaaagtagcaggcaaggtagggtcgggctgtaggacaaggacatgtgttttgtttacagagtaggatagatgtgagcaactttcattgggagagagagctagaccatagagggaagagaaggcattcgttaactcaacaaatatttgaatgtctgtatgacaggcaatactctaagctcttggaacatacaaaacataaaaaacattcctgtcttctggagcttaatgttctaaagtggggacactgaaaatcaaatcatgtgccgagtgcactgtaaaaagaaaaaaaaagcctattaatggggagatctagggatgttgaggtgggacggccagaaggatgtaattttatgttgtgggtggcactgatggatttgatgccactagaatgcaagatatgccagggcagagattttagttttactcactgctgcatctccagtttagaatggtgcctggcacatagtaaatgctcaataaagaattgctgtgcgaatgaattaatgattcaggatcccaggaatgggaaggaatgaggagtgggatactgaagaaagaaagataggccagtcataaatgaagacatattgtagggatgttagtactgatatctccaattcaaattacagttgtttttgcttttaaaggattttaactgttcaattgtattttgaattctttgaattagctttgtttcatggcattcattttgtttactgtatgtttcttagacacagtaatatagtttacagaactacttatccttagggacattacccacttaagaagtgactgttttcagtattattacaataaaattgagattacatatcactttgtatattgaggttctgttacaacctgtcttttcagcattatccttaaagtggtgtgtgtggtggtggtggtggtggtggtggtggtgtgtgtgtgtgtgttggggggggggtgttgtgattgttttatgcccattacagaaaccagtttagccggcattatactggtgtggttatatattaaataagttaaatttcttgcagctactcttttgatcagttaattggtctgatcctatagtgggtattttcatgggtctctgctaagtttagcctcacaatgattttgtgtgtctgaaatcgtattgacaggctgtagctccttctaatttatgcatgcgtgaagaagattgtcctctatttgctgagtcttatgcttttatatgaggaccccagtgtcgtaactttgccataactcaggaagatctaacttctgactgtgcagtatagagcattcctttgtctaaaaaaataatatggatgttttaagaccattcagtcataactggaagctgccttatagttaaaggactttacatattaatgaagaaagggaacatacaaatcattatgtcctttttgccatagattgctgtcccctcccatagaaattatcttattatattttattacaacagtgtatgtaaaatatatacttataaaagtaataaatggtctttgaaaaattctaataacaggagtgtagagattataaactgattttatcctaaaattgtacatcctaggagataaccattgtgagcaatttgatttatatccttttttggactttacaaatgcttgtgtaaatcgcgtgtgtgttgtatgtatatatgtttgagtgtacatacaagaggaatcatatacagcttccctgttttttcctccccatttatacaccatgttgtggacatttttgtgtcagtgcctgtgtgtgggtatgtgtgtgcataaagacatagcacgggtatgccataaaaagttttcagccaatcccttattggttgtcgtcatattttgctcttacaataagtgatgcacttaacatctccagttatgttctaggacagaagtgcttgtcagagtgtaaatatttgacatatgcccttagaaatgttgtaccaggccaggtgcagtggccactcctgtaattccagcagtttgaaaggtctgggcagaaggatcacttgagcccaggagttcaagaccagcctgggcaacatagggagacctggctttacacaaaataaacaaaattagctgggcatggttgtgcgttcctgtggtcccagctgctcgggaagctaaggtgggaggatcacttgagcccaggaagtcgaggctgcagtgagctgtgatcgtgcgagtgcaccccagcctgtgcaacagagtaagtccgtgtctcaaaaaaaagaaaagaaaagaaatgttgtagaataccaatttggactctcattagctaaaagtgagagcatccatttccccaaacccttaccaatggtaagtgttgtcagtcttttaaatcctttctcagcccaacaggtagaagactcagatctccttttaatttacatttctttgtatattcctgcaatttagcatggtttgaccatttatgctatttttttggatatgttactttttataatagtcttcagtctttttttctagtaggttcttcgttctttttctttctgatttctgtttttcttttaaaagaagtatgtataatatttctccctttagtcatctgtatttcagtcttagttttcttaactcattatgtcctcatgccaatcctatgagtcatgctcccaaactctgaatctttttggccttgatggcatgtgtacttggtctttcccacaccagtaattaagtattctccctagattttcttctttgttttgaatttttatccttagatgtttaatatagctgaactttttttatatgtgaatgggatgagttagagctctaatttcatttttctccaaataagatggttattattgagtcattgatcattttctactgatttgagatgttgccattaccatgtgctaagtttccacaaatatgtggttttttacctgaactccttgttcattgatctgtttattctgtgcctacaaaattaccacattgttttttctttccttatacactgatttagtttttgtcattctaacatattgtaaagaggaaagtattgctcctattctgttcttaaaggtctatcagggccgggcgcaatgactcacacccgtaatctcagcactttgggaagtcgaggtgggcggattacttggaggtcaggagttcaagaccagcctggccaacatggtgaaaccccatctctactaaaaatacaaaaaattagcctggcgtggtggtgcatgcctgtaatcccagctacttgggaggctgaggtgggagaactgcttgaacccgggaggcagaagttgtagtgaccccagattgtgtcattgccctccagcctgggtgacagagtgagactccatctcaaaaaaacaaaacaaaaaaaccaaaaaactgtcagaagtggagtgtgacttacttttttttttttttttttgggtcagagtcttgccctgtcacccaggctggagtgcagtggtgtaatctcaactcactgcaacctccacctcccgggttcaagtgattctcgtggctcagcctcccaagtagcaggcacatgccaccacgcccggctaatttttgtgttgttggtagagatggggtttcacctcgttgtccaggctgttcttgaactcctgacctcaagcgatccgcccgccttggcctcccaaagttctgggattacaggcatgagccactgcgcctggccatggagtgtgactttacagtagagattcatttgtctaacatctctgttactggtttcagtaagatcacatcatcttttttgtcctttggcagcagaagttgtaggttaacgaaaactaaagcaacttttcttgtcactgagatggaattgaaatgatctctaacccatacttcttcagccatgacttctcacatcttagaacacattaaaaataagaatatttgtaggacgtactggagaatgaatgagtatccttgaggtcagaaaccactggtcaggggttagcgtggcttagttcccctcacaaggcacgtgtaacccatttacattgaactgcatgtcagtagggaagtgtttaggaagtgctgctgtaggctaatgttcttcaactttaaaattttctcatgacacgtcattgtagcttgatatggattggccaaactgctttaaaaaatttttaattgtggtaaaatatacatatataaaatttgttgtcttaaccatttaaacattcacattgctgtgcaaccatcagcaccatccatctccagaactcttctcatcttgtaaaaccgaaactctgtacccagtcaacagtaactccccattctccctacccctcgcccccggcaaccacccttttactgtctgtctgtatgaatttgactattctaagtacctcataaagtgaagtcatatagtatttgtcttttttttttttttttgagacggagtcttactctgtcacccaggctggagtgcagtggtgcaatcttggctcactgcaacccctgcctcccgggttcaagctattctcctgcctcagcctcctgagtagctgggattacaggcttctgccacaatgcctggctactttttatatttttagtagagacaggatttcaccatgttggccatggttggccaggctggtctcaaactcctgacttcaggtgttccacctgcctcggcctcccaaagtgctaggattgcaggcgtgagccaccacgcccagcctagtatttgtctttttttgtgactggtctatttcatttagccttatatcatcaaggttcgtccatgttggagcatgtgttagcctttcctgccctttaaaggctgaattcgttatgtgcacaccacattttgttgatttgttcatccatccatgggtgcatgggttgtttcagcctttgggtattttgaataatgccatgaacataggtgtaaaatctgagagccagacgtcttgaaagagttttgttttttttctttcattttttaactattccaatttgaatttagcttccattattccgccaaaccttctttcttagatcactattaagtagaaggaacatttttcctttttaatgatttttcagacatactcacccactttggctgtgccatcctcccttggctcttgggatggtgcatgccccctgtttctctcccacttaggagatttcctttgtgaccctcctctcgcatcatttaaaggtggaatttccccagagcttgaccctgggccttctgtctgtgaccattaaatgtgggtatttctcagcaattagagcgaggctcttttcttttcccttgttttggaaagaagagagtcaaaaaagcttaatcaaataatctcatcttttacccaaaaaagataactattttcttcgggaaaaaaggtgacaagaatataaatcatcagaattacactaatttgtttctgaaggaaatgataaactttcccccagctttgttgaggtataattgacaagtaaaaggtgtatatgttcaaagtatacaatgtaatttgatgtgtgtgtacattgtgtaatgattagcacaatcaaccagcacgtccctcactatacggtgttttactgtgtgtgtatggtggaggagaggagtgaggacacttaagatctgcttattaatttgcttagcaaatttcaaataaacaatacagtattattagctgtagtcaccgtgctgtacattacagccccagaaaatattcatcttataaccaaaagtttataccctttgaccaccatctccccattccctccccaacccctgtgagttcaggcccttctctatattccttcttattctaggtgacccccatctgcttacagagatccaatctgctgatggctcctaggtttgtttcatgaggtcagagctctttgctgagccccactccagagctgcctccttgctgtctatgctgagtgtctgatgggtgctccagcctcatgtctgagatagagcttcatgattttcctcccacgtccccttccgtgttctcagtgaagggtacttgagcctcccaggcgatcaagtcaaatttcagggatcagttttaaagtaaactttttaatttaggatagtttcagagttatagaaatgtctgaagaatattaaggagagttcctgtgcactccacacctgtttcccctgctaacattactgtggtacatgtttcacaccagtgaaccagtaccaacacattatttacactgaactctacacttcattcagatttccttaattttcccctaaagtcttgttctttttcagaatcccattcaggatgccacgttacatctagttgtcatatatcttcttaggctccattagactgacagtttgttagatttcttcttgtttttgttgaccttgacagactaagtattttatacagtgttcttcaatttggatttgtctactgtttttctcgtgattagacttggataatgggttttggggaaggaagaccacagcggcaaagtaccattctcatcacatcatatcaagggtacctgctctcaacatgatttactactgatgatattaaccttgatcacctggctgaggtagtgtttgttagatttcttcactgtaaaattactgacatttttgacactttcctcttctttttatctgttttgaatccaaaacaattcctgctggttctttttcccaaataaatttccattctgtccaagtcactctttgcagccactgctgcagtccaagccacaattgcctgtgcgcagacggtattgagcgatcttctgactcatgccctgcttgtgcccttgccttctccagcccagtctccacccagatgccaatgtggtccttttcaaatgccagttggtcagtggtactcttgttcccaagcctttgagcggcttcttgttgtacttgagataccaccccaccttctagacacagtctgccaggcctgcttaagctcgtctcttgtcacctctctcatctcctgccaagcccctctcgccttgtcctctgttccagccaccggtttcttgcccgagtcccttcaacactctcagctcccttagacatgtcgttgcctctgcttagaatgatggtcgccctccaccttggttcccttgggaccccagcttacatgccatttacatgttgtttcttcaggggacatttcccatccacttgcagggtccatggggcactcttgctgggtgtttctggagcatgccacactgtacccctgatgctgggagttacttgttctatgtcggaattgttcctcagtgctggggtggacaaggctgagacgtgcctcggcatgtcactgtgtgtccctgttacctgtactgagcctgtgccagagtggatgcttgataagtatttgttgactgggtgaaattttttaaaaattaaaacatttttaatagaaatggggtctcactatgtggcccaggctggtctgaaacttctgggctcaagcagtcttccctccttggcctcccaaagtgctagaattacaggtgtgagccaccgtgcccagcctgaatgggtggattttatcttttgaatggaaaacactcttcatttttagcatgccagtatgcaaaaaagtacttgaatttatttttcttagtccattgatttaaatcccacatgtattcttttaaatctgtcacataaggtgctgtggtgggtacagtagtggatctagaaagtgtgttcagcctctgccactcctgagggcccattcattcattctctcattcaccagacagttactgggaacctgggtctgccaggcctagtgcagagtgtggggttatgagggcttgtgagtgagcctgttgagggagagggagaaacttatagatccttcagcatttccagttgtggttaggatagatttgggcggatttagtttgaattctggctctaccatttttaagatctgcactcttgagcttaacctctacccgtctgcaaaaatgtgggcagcattgtctcccttgtaagttgtggaaagaatcagctaagaaaaggaatgtaagaggatcagtataatcatagtaatcacagaactaatggtttttgcctttgaggtcctgagtactagcctaagtagttacattaattatttttgtttattctcacagcaactctgtgaggtagggatgttactgttctcatgttgtaaatgaagaaagtgagaccttagttgaaaaattaaatactttgtccaaggcacagaagtagtaagtgggagagctataacctgaacccaggttcaaggacggcgtgattttaaagcccagaaaggactccttacattctgtgtagctaccccatcttccagtgtggctttattctttaaagttgtaaagactttttaggtatcttggcatttaaaaaaatgtaatagtctttagagggacgattaccttaagctattatcaacttgaatttgtttctttattcacattttagcagctttgacatctgtgacttggtgcctgtgttgaggagagagggtatatgttgggactggaggatgaagtttgaagttagacccatctgggcagtatttatcttaaagtgagaattgtgaacttgtaatcagactcacctggaagatttatcaaaaacgtaaattccttaaccacttctttggtaccccacattataatctcttaggggtaggacttagaaaacatttttgcaagtgatgttatttagatagtggattctttttcattctgaagtttgagaatcagtgaatagagggaatgggaaatgtcaactccttgatgatccagactgccctacaggaagccagtggaaagatgaaagtgaaccctggtatgcctggctagtaagtttaaaaacaagtaatgtggaaataaaatcaacagtcggtgaatttgtctccctgttgttttactttttatattatttgtgtttgggaggaatttgatttgtattttatgatcatttttccctagtgggtagtggggtagcacgagaaatgagtgggtctagactatgatagagttggtgcaatgcagcaggccaatcggaagaaaaaaatttaagcatattttgtggattagcatgtcagttgcaaaaataggagtatatctaaagctgatttcagatagtctctttttagcgaaactatgtcagactgtgcccggacttttgctttggaaaatatggtaatttcaggtttgtggctaatttgaaaattagtaatcaatactaagggttttaaatatgtagcatttatgtgtttattatgtatttctatattcataaacattgaggattcttttattgtctcatgtaacaagaagacaagcagctcagggatggcggctcccgtgtgcttctccatgatctctcagcttcctttgtgtggatggccacagcatggctgcgtgcctaaagcacgcggagagggcagcattcttgtctcaggctccccacccaccattcttaagcagctttgttgaggtataattggcatactaagttgtgcattgtcttgtacattttgcaagtgtgcatctgtatacaccgcacaaccattaccatactatgataatgagcatgttatcactctccaaagtttcctggtgccttttgcgattccttctgcccacccttctcctccttttgtgaaagctttgatgtttttagggaaaaaaaaagttacattattgaggataaaatactaggtagaaagatatttaacttgtagttttcgctttttttttctttttgaggagtattgtggaaataatatgattgtaggtataggttgctgtaatatttatagaaagttttgagaaacagattctctgaacagaccatcttggaagagtttgacaggaaatatattttcggaaaggctggaatagaggtggagatggtgcctgctggcaggagagggagagaaagggaggacagcacctgccggccacttgcgggtgagctacagacatgaaagccaaaggctgcgcttttctttggtttttcaatagatggcatttttatcatgctagaaagactaacatgaattctaacatgaaatggtaataaaaatgtaatccccactaactgtagtgtatacatagctcaagtgcatttttttgttgttgaatggcatgctggtgattgatttatttatatttatagattaaaaataataaactttgctctcattgtaatcacctctttttttttcttttttttccctcccccagagactgggtcttgctctgtcacccaggctggaatgcagcgagtggcacagtctcagctcactgctgcctccacctcctgggcttgtgttccttctgcctcagcctcctaagtagctgggactgcaggcatgtaccaccacacccagctaatgttaattttttgtggagatgggatctccctatattgcccggctagtctcaaacttctgggctcaagtgatcctcctgcctttgctttccaaagtggtgggattataggcgtgagccacagaagcgtgcctggcctgggtagttctttttaattgttgaatatacttgctgaggttagtttctgctgcagaaagcattatataatgttgagttaacagcgatcttgtaaagagttagtagaatgtgtaaagttttacctgggaggcggaggcagcagtgagccaagatcttgctactgcactctagcctgggtgacagagcgagactcttttttttttttttttaaaaacaaaacaaaacaaaacaaaacaaaacaaaaaacgactgtatagggttaaaaaacgactgtatagggttttattttaatgggtttcttcagctgtctccttttagcttctatgactctgcattttcttggctctttgtttttcatttctttacagttcttccatgtattttgttttgaaagtaatatgcctgaggtgaaaatggcggcatttctgtcatgatttaaccttactagaaatgacattctttgttctttgtctgtttagttgagaagtgaaccaattccctgtgcttaaagtactactccttggtgtggggcagggagggaggggggaagatttttaacatagaatacaaattgagtttgttggaaaaggtatccctataaaatgttgtccaggtagttagagcttaatatgggtgataatttccctagaagaatattctttgctgtaacactgatgacttgatggacttgtgaaagtgaaacttggtgtgtttcttctttcagcctccatgtaactcacagatagggcagtgtagagtagatttccagttttagattaaggatagcttgtatcctatgcaaggttttgggggttggttagggtctttgagtatttcctgtctaattcacttactagttacaaagagacaagctgtaatgtaaaaagtcttccttgagctagactagctttctgtactctttgatttaaaaatacctggtagttctgccagttggggatttgtttggggtgaatgaaaacccctcaggctcagtctgttcatgcactggtgtgtattaattcagtccattcatagtcatgagctgactgtgccttattgaagaaagggaggcttctggaagagagaggaagatggataatcttggatcctgaagcactgctgctggcgcctgggagtggggcaggaagacaggaggttctgaagagagggctttgtatccaaagttaagacttaggccagcccttgatggggagagaagctactcaggcccaataacctcaaatagttcaggttaaatcgacagttgtcaagtctaattcctctttacagcattatttctgtgggaaaatgtgtgtggcttatatacttgcctcagcaaacagaccggactcagaatcagctctttgttgtcataatttaagtggaattagttactccctagggttgcattgccccttggatggcttctagccttctttttacttattaaattatattccaggttccttgactgtgagggacatagtaaactcctagtagcctttaccttcccctccctaaatagcaaactcatgtagaaaacattagctaaaatcctttgcagatttttttgaaatcacctaaaatgttgttattggcaccatttcatttggagccattttgtcagaaccactaagtatttaggtgaggcgattgatttcattcccacgtgggaatttggttggttgtaatattcaggcactcagagcaattcctgcctggacgtcacgttcaggtagtctggtgtctgaaacttttggcagagattaagctgatagaagatttgggctaacattttttagtgtgtgagttggtgaattttcaagatgatttagaagactttaaaaaagcatctgtgaatactgcatcatcttgatgtcaagaagagattgttatttaatacatacatgttttagtaatgaaggaggtacatagagataattgatttgaaccggtttactttttcccctttttaatgcaaaatatttttgggaaacagaacttgactcgtgttacactactcgcttcttgttttttgttacaaacatgctgaaatggtctaaataatgatgctactaaaacaacgtatgcattgttttcatggggtgttgattccttctgcagtgttcaaaattacttgcatgcctccgagcaacaaacacatatgtgacagactttatgtgagatgagcattccagagaaatgaaatgcaagtttacttttcagtagctatgcaacttaaaaaaaaaacattgtgttttttgaaacatggctttagggcactaacactcggaccgagtgcatgagctctgcaagttattttaacaaaacctaatcacaggaacaaacatctggcatttatagagtttgtttatttattgattgccgtaagcctctagaaagaatattctgtttcttttaataaaatccttttggaagttgtctatattttaatatctaagtgtttttggaatttagttttaacaaggttaactcaaatgttaaatttattgtgggctacagctgaagtaggagaatgtaagaagaaatggcaagtgggaactcttgtaaaaagaatggtaactaagttctttttcctggttatgctcctgccatttactcttctgtatggcaggccatcatttacactgctttgtagaatctgctgtctagtaagcactaaggaatttggatccctaaaccagggagcatatagcctgctaaagcttaatttttagacaggagacactaaagatgattgtgttatgatactgttcattttatatactagtgaaatgaatactgaaattatttagtataaccattaattatagtgcttaccattactgcaaagtttgtcatgatttgggtggtagcttcatgtttcaaaacaaaaccataggtctatccttttaaaaaacataaactgctttagtttgttaatgggaaaagtgagtaaataataacacttattgatgaaatgaagcctgtcagatacaggaaaaacaaaacaaaaaacccttgtagatattcctcgtgtcaagcccctattaattctgtgtaattccagtagaactagcaagttattttgcttaaaatgtcttttttttcccctgtgcagtgaaagttgaatgtgagaccacatcttaatagatatagttacacggtttattttatcatgtatcactttattgctgtcttctagaacattgttatactaaatgttccaataatggaaattttatgcagctacttcaaatgaaacaaatttgcaaaaactcaattttggaactcattccttgaggagaggaaaaactcaccatgctgtgaccacattagatttctgatatgttggcaacttatcaaacactgtcatttccagaaaacaggttatggggtcaaattgaaatatcagcacttttggtcactttcagttgaagatattttaggttttaatgattgaatggttaaattaaaaaaaaattgttggtaacaggtaatgaaagtgtggttttgtatgtaaataaaaatggctctacacgacatcaggaatgatggggttcagttacagtggaatcttttcaagagcttgattttaaattctcagagatactagttttacttactggagctcctttgttttgcagagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtaacacgctgatttcctcaaatagagatacccctttgagtgataaatttgcaaaatgctgtcttcattttctgtattaaaattcatttcagttttaaaataaagtgtaatctgtgttttcatccttttaaaatttaagtttaatgagtgcatttccccatacagtatatttccttttttattcatgttttgcagaagctgaattaacttgatatttacgtataacttacacacacccaggacacccatacctcttctctactcccaaaccacccaaaccattgcccctcaccttatcacacatacaccctcaccatcaccaccaccaccaccaccaccaccaccacataccctttcctctgcagagtaacttatctttctttcagaaatagtagcaacttgaatttattagtcttagctgccacattatacatcttcagattatattttgtattctgaagtattttggggagaaaaagcttagacttttaattttaatttcatttaaggactagaaaaatacaaagttgcctcattacccaaattcacctttccccactcttttaatattttatttctttaattttaggcataagttaagaacaagcaatttaacatgaccaaaaaatgtacttttgtctctgccaaaacctggtcagccagccctggtagtctcaataccagattgatttctgccatatgcaatttcatgactgtttttcaaacaatgcatttttattgtatttctcttttcagaaaattcttaatctaaagcaaaacaaaccaaaaccgaaagacagaaaccaaacttgagtcagttctttgaactggcaagatactccttagaaatcatgtccttaaaaaaaacatgtgaattctctcagcatggcccactgaagcacagattactttttaagtgtctcattattttattctctaacatttaatgctgatgttttaattgcacacagctgaagctgctaaatgagtactgaaatggatttaagtcctctttgagctttgttgatacctataaaagtttatgtcattcattagaaccacaaattaaaattagtcgtggttagctgttcactggcgattggaactctcacgaacagttttgttcaggctcacgagcttgttcttgcctagtatacttggatgcctgaaaagctgcctttggcctgttgggtatgttttcttttcacagaattgcaaaatatcagagctgagaaatacaaataggtaaaccatcctatgattataaagcccctgtgatttataatgtcccagtagtcaggagcaacttttttgctaaacctggaattttaaggtgattttttttttttttaaataatgcttttcacagttgtgctggcatgtttaccagatccccaaagacttttttgccttaagtatgtcctttatttgttcctttgatgccatgtccttctagcactaaaggaatggcatctggctcagtggatggtacatggaagccatgtggggggccatgactgcttgttgcctccattcctcttgctcaagcagccccaaaccggctgacccctgagggatgagctggttgatggtccccaggagagtcacagctccctgctgttggaatcggctcccctggggctcccatctgcctttgaggtagacagtactttatttgtaagtccagtagcagctgaagagaaattaataggttaagacgagaaaagtttttaattctcttattttacgattagatcagttagattttctttaaagttttctgcttaatacattttaagataacctcatttttctaagagagctagtacatggacacatttatggcttatttccaatgagccttgtttatttggttagcatttaggacatttagtagactgtaagccaatggatgtttttgtaaatgtgattcattgagaaaaaccttcatttgagagtcaggtaacctgctttggactagcaaagtctctggatatgttactggtatctgttgaggtagtcacacaaaactgaaatactccaacagaaagacttcagaagactttcattttggtgtaaaaacagtgaaattagctgtttgacttaaaatataggagttgtaagacatttcatcgatgctacttctgttttatcctctgtgaaatgtagatactgtgtgtctcccacttgctttttagggttgttgggaggataaatgaaactgtatgacagacacactgggaactcagaagaaaggtgctgttgaaactgaacctcatcctatggctgtgccgttggcaggcataaccggtgtgctgagaggcagtggtagtgaaccccgtggtgaaaggccaggaccatgggctctggagccaggctgccttggttcgaatcccacctcgacctcttgcaagtggtctgaccacagcaaatcacccaacctctctgtgcctgagtttccccctctttaaattggggatgataatagtacccactaaaggatcctggtgagttttagctgagcacatgtccacaaagtccttagagcagtgcctgccatgtagtgtggctgatcctcacacccagaaaaccccagcagggggactcacaccttacagaaaatcaggttcgaaaccattccccagtagtcttctaacactgacttagagacccttatatgtttagagagaggaaccgaatagtttatggtaattaagctcctctaaaacagatgcaagttcaggtgcataaagttaaatctgggtttttaatctcttaggaagaaaagtttagatcacaaagagctccataaccctttgttgataggttcttttaactgtttttggctatggagggacaaggaaggaaacctgagggacagacccaccttttacctgcttagcctttctcgttcccttttacgcttggtaaggtgtctagggagctttgaaggagtcagaagtgttgaactgtttcaaggttttcacccagctgcgggaggcttcgttgtcctcttgagtgaggtggaagggacatcactgcctttcctgagtgtgtaagaatgcctgttacatattcatcccagggctttccatacattttaatcatccacatttacctacaaggtgggtggtatgttcaccccattttgcacatgagaatgctgatgcccagataggttaaataaattcacccaggctcacaccctcagtaaactgccagacaggcacttaaatccaagtgccattcatatcacagcactgctgccttgcattgagctgcaaacctggctgagccactcctaggaaacggttttgcccttttagttgtagggacctcagctgtacgcattatcatccttcagccatcagacctttttttgtttttgttttttgagatggagtctcgcactgtcacccaggctgagtgcagtggcgcgatctcagctcactgcaacctctgcctcctgggttcaagcgattctcctgcctgagtagctgggattacaggcgcccgcgaccacacctagctaatttttttgtatttttagtagaaacgaggtttcaccatgttggccaggctggtctcgaactttcctgacctcgtgatttgtccactttggcctcccgatgtgctgggattattggtgtgagccactgtgcctggcccagaccttttaatgcaacagcgcccctaacttctgaaggcccctagctggcttcaacaaccgcccctcttcctgccccccatggagggctctgtcatacatgtgtcacttttagggactcttattaccaatggcttccttaatcctggctgcacatccagattcctctgtacagcttttaaaataattcactttttaagaaacacttgccccatcccaagactcttgttctagagagatggataggttcagaaatacaggaagtttattttgtaaacaagaaaacaaataggtccttacattgtgcacatatggatctgtgcttctggagtgtgggccaatgctgttaattctgtagttgactccattgtaaggtaaaatgagttttatgggccagtttagttgttcagccaacaattgttagtactgtttctgtaggaaaagttcctggcatccaccctgtagaataccatcttccatgagtgagcacttgatcaccacagaagccaggtttgaatttagttagagtgaaatgaagtagagggccctgcttgcttgcttgttctttcatttttttttctcttcctctcttttatgggtttatcgttcccttcttttcttctccttcgtagttccctctttccttgttttctctttcttccaccatctggcgtatgtttacaatgtatctgtcatcagactgtgaggtccctgaaatccttcaggtgcctaccacagagttgacgtgcaaatgaatgtttctttattttttaattaattaatttttttttttttgagacggagttttgctcttgtcgcccaggctggagtgcaatggtgtgatcttaactcactgcaaacctccgccttctgggttctaccgattctcctgcctcagcctccaaagtagctgggattacaggcgtgtgccaccgtgcccaactaatttttgtatttttagtacagacaggatttcactatgttggctaggctggtctcgaactcctgacctcaggtgatccacccgcctcggcctcctagagtgctgggattaccgtggtgagctgctgcgcctggccaaatgaacatttcttaatttgtcttagtatctgtctttcaaagaagtaggtactgcccgtcattagcttgaaaattgtcagattttgtttgtgattgtctgtcctaacttaggtggtttatcttgaagatcttaggtaatttagcctcatagatttagatagatcgagaaatggcaggcttcaatcactgaatagtacagaatgttgggcaataagatggatttggaccattcaagggagcacttatgtcaggcttttagcatatctgctgcatagtttttagagctggaaggtctgagatcatctgggttggacccttcatttttggtggtgaggaacccactcctgagagagaaaggtgcttcttcggtgcccgcctccaggccaggacttgcctcctcctcctctgtgtccttagctgagtgagagttgggatggcggagagcagaggcaatgtgaccgcatagctgctgcgattaactgcctgcctctagacatgttggagaaacagtcaaagtaatcatccttctgcgctccccctcccatggaaacaaatgatagaaggttagggcagttttgagggcaagcggcagacttcctcactgtgaaagtcgggaagctttggttgtgccctagaccctgtccttttggccttggcaccaccaagtgggctgctttaggtgtccatcctgatggtgtttaaccctgcttgaggcttttgaggacactaagaaacacatggtgaaggtgtggaaggattttttgtcattcctcaatgaagatctgccctaggtagaaagggagttaatgaaggaaaagtcggcaacgctattgctgcacgatcaggaaataacagaaaacgtctcccatttgttctcatttgtggtgattgtttccctgggaaactggccgtggttaccatcacgctgtgtgatgctcctcagaatcctagaattagacgagattttccactttccgcacacatcttcaggtggggtcgcaaatactccatatgacagactgtcacatacgctggccacagaacttcaattattcaggtttggatatccagccccttttctctcttctgtgtggatccttttgagtactttatacctctaagcctttcgtatttccaaaggagaaaccagaatgacttttgtcactcttttgtaatggtgggaaaaggactggtaggggaaactaccaaggtttgacctgggatctactttacctgctctagttcaccttggagcatctgaccatacataggtccttgcacatagtagatactcagcaaacattaactgtcttttcatttctcattagcacaggtaattaggaacaggagctgatagactgcacgtatctgtgcagagatatatctgtaattaaagttttaattaaagaaacaccagaccaggcagatggttcttatccctgcatcctgtaaaccaaacagccgtggcttttcgatcttgcaaacatgcaaagctgagagtagcaacattcatggtggtacaccaaagggaataggttgtcttataaactaaccataatctaattttggtagcactctatgtgatgccagattcaaggataatcattgcagtttgaaatgaaagacaatacatcaaagttatgtcccaaccaaagcttttaagcctcaagtcaagggcattaccacagcccagctcgtagatcacaagacgtgtggttttgtgctagatcacaaaagctgacaaggtgttatttaggattatcagctaaatacagtattaaattagagggctatcattctgatttttcaggcattgccacggtatagcagtacagaattgagaagtgacttgtacctgcctgcctcatgcagatcctctcagccatgtcacagtgaccttaatggtcaattgagtgcagaatttgaaaacaaaaaacaaaaacacccacaaagagtgacagaagacgacttctctcatatcttagcacttttccaggaaccgctcccccaaggatccccagcgatttgttctagttccgttgccatcagcaggaagctggatcagtaagggacgtgggcagatggtaaagtccatggcagttcaccatgaccgcttgggcttcacccattccataacccccagtttcttacccctcctcaaaacccttcactttgtcacacatgtcattttcaggcattcagtgcagataggcagctgtgcaacgggattacatactagttgatacaagtatgtttttaccacctacatctcactaattcattttctacttggtagaaccagtactgaagatgttcatttcttttatcacagcgaagagttttagtttagaggctaggagagtaatttctactttgctgaacagtgaattaccttaccatccctgcacttcttttaaaggaagtagagtttccgcttgaaaaagagtccatgttataccgggataaatataaggatcttcacattaaagaatatgtcatcaaatgtagagcctggaagtattttatcttaataccatctataaaactcagtcatcctaggagaaatgtgtgtgtgtaagtgtaaggagacataccaaacccacaagaccctgtgatgtgctgtgagcgaagcctgtgtcttggctggtagacagaaatgtgtccattactttctggcttggggaagacttcaggtatttgatgatatgtcctttggtttcagaagtcaattaaatcttagctgctctgagtaaacagccatttgtggttgtgtttagaaaatacagtaagatcagatttgtgctgctaggtattaggttggcattttacatgtggaatttgaaccggactatgaaatctatttcttctctaatttggttcaagacctgaacatgtaacctttgagtatacaacacaggtttagattataaaggcttcttttccttttttctttttttttttttttttgagacaaggttcttgctctgtcacccagatgaagaacccgcccactggagtgcagtggcataatcatggcttgctgcaaccttgaactcctaggcccaagcaggcctcctgcctcaacctcccgagtagctgggactacctttgctgctgcgcctaattttttttttttttttttggctttgtagagacggagtctctgttgcccaggctgatctcgaactcctgggctcaagtgttcctcctgccttggcctcccaaagtgatgggattacaggtataagccaccatgcctggccctgtgggaggtttcttataaagtgaaaccacttgttactcagaacggcattatgcctcgcttcagggtaggaaatagagaagcatcagcaaacccacctggaatggtaggctttttatttctctttctctagtagggtttttttttaaattttatttattttttatatttatctttaatttaatagagacagggttttattctgttgtccagcctggagttcagtggcacgatgatcatcactgtgacctcaaatgcctaggcttgcctctggagtagctgggaccagaggtgcataccaccacgcccagctaacttttttgtttttcttgtatagacagggtttcactatgtgtccaggttggtctcgagctgttggcctcaaatgatcctcctgtctcaacctcccaacgtgtggggttacaggcatgagccaccaggcccagcctctaaaagtgttttttttttttttttttttttttgagacagggtttcactctgttgcctaggctggagtgcaataacatggtcttagctcatggcaacctccacctccagggctcaagcagtcctcccacctcagcctcctgagtaactgggaccacaggggcatgccaccatgcccagctaactttttgtgtttttgtagagacagggtttcactgtattgtccaggctggtctcaaactctggagctcaagtgatccgcccgccttggcctcccagagtgctgggattacaggcctgagccattatgtccggcctctaacagattttaaggaagcttttgttctgtctgatatctgtatgatcatgggaggggagtggagtgttctgcccaccccagagtgacttaaattcaaatatttgtttgttcaataaatacttattgaataccgagtactaggcactgtcctaggtgtatctagaatgaagcaataaacaaaaccatgttattcccctcgaagagcttattttctggttgggggagaggaataataataaacaataaacaaaaacaaaaataaataacagtaattgcgtgcttatatatgccaattacatttattaactcactcttcagaatactgaggaagtagctgctgtcattatccccatttcatagacaaggaaaccgagatacagagaagttgaattaacttgctcagtgtcacatagctagtaagtggtgctgttgcattcctgtccaggtcattggactccagatttcatgcccttaatcactgtggtattttgtttctcttttaaaaaactgcccaatctgtttatttctaaagaaggaaagaaatgtcagtgatagtgtggtgaacagtgcagcaaggtacacagtgagagggttcttgcatgtctgtttgtgcatgctattctagtgtgactgagcgggtatctctcatgaggtgaattgaaggaagcaacactgtgaccacttgaaggaagcaacaccgtgaccacgtaggtgtctagagtgagtattccaagcagagggaactgcaaaagcaaaggcgctgagatagacagagatagatttggcaatggcgagagagaagccaggagaatgacaaggaggcctgtgttgctgtgcagagcgtgggaaggggcacgggaggggaggagccaggaagtagtgtcctgtgcagccccgcagggcttggcacggtcttttggttttgccgaaagagaaggaaagccacctgaggatttttgagcaggaaaaagacatgacagaaaggatcattctgggctgggcatgatggctcacgtctgtaaccccagcacttcgggaggccagtgtgggcggatcttgaggtcaggagttcaagaccagcctggccaacataatgaaaccctgtcactactaaaaatacgaaaaattaactgggcatggtggcggttgcctgtaatctcagctatacgggaggctgaggcaggagaattgcttgaatctgggaggcagaggttgcagtgagtggagatcgcaccactgcactccagcctgggagacagtgtgagactctgtctcaaaaaaataaaagtaaaataaaataaaataatcactctgaatgtagtgcagagaatcttccagggcagggccagcagaccacagcccatggcaggttctggcccactgcctgtttctatatagctagcaagctaagaatgctttgtatgtttttaagtggttgaaaaaaaatcagtattttatttcacatgaaaattatatgaaattcaaatttcagtgtccagttccagttctattgaaacagagccacactcttgtgtgtattatctgaggccgcttttgagctgcaacagccaagctaagtagttgtaacagggagcatatggcctgtagaggctgaaagatctatactgtttggccctttacagaaaagagttgttgatccctggtttgggatagaagtagggagaccagtgaggagactgttgcaagaactgatggtgccttggacagagcaggaagaaatggtcatatatgggttatgtttgaaaggaagagctggtagactgtattaatataggaagagtcagggatgatgactgtgtttttgcactgagtaactggaagaatgctattcttctttactgagatcaggaagactgagaacagcaggttggggaggaggggtgaagagaatgtaggttgtgttttgcacctgttgactgtaagatcaggtggagatgttcaataggcagtcgtatgtttgagtttgtaacttcaaggagaggctgaggctggagctagattttgagtgttttcagcatatagggggttctaaaagccgtaggactggatgaaattttttagggagtgtatacaatagagaagtccagacatggagccctgggacacccaatgttaaggggaagcgggtagaagggaggcaaaggagaatgagaagcaatcagagaaggaagacaggagatgggggtgtcctggaagtgcatgtttctctttgctttgctttgcttttttgagacagaatgtccctctggtctcagctcactgccatttccacttcccgggttcaagtgattctcttgcctcagcctcccaagctgggattacaggtgtgtgccaccatgcctggccaatttttttatttttagtagagatggggttttgctgggttggccaggctggtctcgatcccctgacttcaagtgatccacatgccttggcctcccaaaatgctgggattacaggtgtgagccaccgcgcccggacaaggaagctcatgtttcaaagcagagtgatatctatgtcagatgctgctaaagctggagcaagaaacagacgggtttcactgtgggcttggtagcggggcgatcgttggtgactttgataagagctgtatgagtgaaatggtgagaataaaagcccagttccaggtggttcaagcaaaaacgactggatagggagctgagctggtgctctgaaggaattctgctttcggcagcctaagtgtagggcaggagagggcaggagagggcagggagttggatttaacctgggattaggattttgccaggtgagtacagtggagggaggaggcataagggagttgagcattgcgcagaagaatcgatgtgaggattgaggatagaccatgtggtctaagccaggcaaggagccaggaggcatgaaggagctgagggtcagtaagaggtcatggggtcagtggattcaaggaataggatcgaggagttgttggagttgggatagtcgaagagtagatagagggcttgaaatcggtatcatggaggggtcagttttggttacatcaaggtcaggggctctgctgtacagtagcagtgtcagtgagtcacgtgtaatttttaatgttctagtaaccatatttttaataggtaaaaataaaggaaactaattttaataatatattgtaatatattttattttacccagtaagtctacattacatgaccatgtagtaagtataaaaattgagaagttacttattttggtatgaagtctttgaaattggtatatatcttatatttccattaccttctaatttgaagtagacacatttcaggtgctcagtggctgccttactggacagctcatgggatggtcatggagtgtagtccaggattatcacaggggaagtgtttaaaggaacaaggaggtcgtggttcatgaaggattggccgtgtagatctaaaaccatttctcactccttctgaggggagcaaggctgaagaggaaggaggggacaccatggcagttggtagaggtcatgtgcttcgatggctgaacctagcagccttttaccatgcagagaatttagcttattctctagagacacacacacacacacacacacacacacacacacacacacacacaattttgtttggctttgatccacacaatgtgtttttaaagatgaataaaaattgataatatcaggtattttttagcctcgtaggccaggaaaaagtaaaatattttgaaagagtaaacaggagcgtctcagcagcatacatgttacttttcatcttaatcatgtgagcctctcatgaaagcctccaaggaggaggttaatggatgccccaattctgtacctttatcaggtttaagcttacttcagtttccctttagtttgttgcctgcagtatcataattaaccaaagaattcttctcaaaaattaccctcaaaaatcctacaaaccccactgttaggaagcgagcccattttgaggaagtatttgtgaaccctgtgttcttggatgccttatgtgttgaaggaataattacttgttcattttgtagtgctaaaatcctgggaatgcgcagtctaagcagtctagagcatgtcagtatcccacctttggaaatctcctaggagcatgtagagactctggtttatcattaactgtgttgctttcctatcttttacacaaagtattctccttcccgcaccattgtattcacatgacagaaagctcagttaatgccttttagtaataatgaaagcttactcattacatacattttcttaaactctctttattctaattaaaatgtttccatctgatgaggaagtgtatggataccaagaagtggaaattaagcaagaaattaaaagaacattaatggctttcttgtaatttgttttgaggtttttcttcctgctaaatggtgttttgcttacagagtcacccctcacacagaaatctttatgatgaatggactggaataaatcccagcaaaagaagagctattttatgatacctcttgtaaattacaacacatgttatggaagtatttgcttttttaaaaatattagctttttaaaggcattgttagtataattaatttggcacacacacaattctagtttctttgaaagtgaaggtcagtgtgtgtgtgtaggggattaagaaaatgagagttctgacatttaaaaaattattttctatttatacctgagtcattagaatgctcaaaccatccaaagtataacatttaaacttgcagttcattcattccttcagaaatttgctgctgaaacttaaactttaaccagcatagccagcgtagccttaaccagggcaggtatttggtctgcagtaggcaagcctttgcccccatccctcgtcttcaggctgcagagtccacatgcatgccattgctctggtgggttctttttctggtcatttggacttgtctctactaataaagtattcattaacttgaaactcctacctctgaatgtagatgcaggtgaaagcagagaaataccaaacccaccccttcctgatgaagtgcaacatgccccacccagctgcatctcacctgctgcctcccctcctcctcccctgatgtgtggacactctttctgtccgttcctacttgctgttcccttctctgcacgagtccttcccctggagggcagcccgcatgccactcctcccatgcaccttttcttgggaactgtgttcagtacagcctgtcctttggttcactcttaccctgggcactgcttcccatgtcctgtgcgggcccttgccatagcatattgtgatttatctctgttggtgtctttactccactcaagtgggagctccttgggcaagggtgctggtcctcccttatttttgttttccttgagcccaccatctgcacgtggttatgggtggatggatgggggaagtgacagtggggtaacataccttcaagcccaaaatgtaaacttaataagtgttttggaggaagagaagaataaatactgtttttgtttatacaggtcttaaaattttggtagcagaaagcaaatgtgcaaagagcaatggaaaacaagtcagaagctgctgtctgattccagaggaactcgtattttatgttaaaaaaaatgtaattgacatttgattgccttgaaatcttcaatttgttgtgctgatatcttaagtaactaattatttagttgaataactactagggaaataggccataaatgtcactcgtgctttccttgtaagaagcccacagctcttctcgcagcatgctcttttcagtacctgttctaggtacttgtgacttgtgaaagtcactggcctctgcgcattgggcacaggcctgaaggcgatgttttactcacattttgtccactggaattaaacagctgtgctgatattcagttgatttgaggtttgtttggaaatcagtcccaaatttgggaagcaaatgagacagaaccctccacaccctaccacatgcttccagctcatcccatgaaaactcatgagcacagtgtggagtgttttatctacagccactccctttttgacccttcccccaaaatagtgagggagagaaatgaaagaacagatctggggcttgccttcagcttcactgtgcatttttggtcattttggtcattttagaagtcatctttcacttgttaggatgttacattaattgggagatgctagtcgttttgttcatggaaaccagagtatccctttgaagtattatattcttctaatctatgaaactggcccaggaagtaacaatgggaagtgctggaaatggaatttaagaagtccaccttcttagtcctgtgcttaagcagagagtctctagcagggagcctctgcaagcattgtgttctgttgtatcaatatgtacttagatatgttaatctgaattagggagttgattgtacataatgactcccctgggttgctatgttagaagaaaacccaaaacttaagtagtttgctgaatatgcatagtaagtaaaaaaattcttccaaaattagtgttaattgaatctgagccttgatcttctttgaacctttaattttttatttgatcttttaaaaaagttttgtggcctcttaaagataaaacctacaacccaataaaagtcatgctgtaacgattgcaaaaagaccattgtatgagacccagttttggattatcataggcgaagaagtcagacatatatggttgtatgtacatgtgtatagtatgtgggtgggggtagatacatacctgttcatctgtatacgtatgtgtgtgtttaatatatactttagtttgcctttacccagatgtctcctcctctctctgcctctggaaatggggcaaatttttcttcagttaaaaacagaaatagaagcgacggttttgacccattttacacctatttatttcaggctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaaatgaaatagaataaagtgacctactcttgcctcatccggagttattacgaaggagctccgcagcctgactgagctctggagagcagggctctgtgcacacgcctcctggtccagaggcctccgtgaccatccatgatgccactctgtcccctcagcaagctgcctttttcttcctagcacctgccccagcggtggtatgttttccagtcagttaccacctgtctcatcagaatggaagctccatgagagcagggcctttgtcttgtccccttgtatcttcagtgcataggacagtgctgacacagtgcagagtctaaataaacgctgttgaacgaa

SEQ ID NO: 2384 - DNA, 102879 bp, Homo sapiens; identical to SEQ ID NO: 2383
